United States Patent 8,344,211 (PLANT NUCLEOTIDE SEQUENCES AND CORRESPONDING POLYPEPTIDES) - sequence listing, part 7

SEQ ID NO: 26285 - protein, 108 aa, Zea mays
  misc_feature: Ceres CLONE 1398656-F
MLFPKRINYVAPMLASAAILLLLLSGYFELPLICTRGAIPRGEQRASPPRSTRVGSRERDPFTSVLEGFGSWRTPPVGCPPRWVKFSPRGVGNWARAWPFQRRTPRPR

SEQ ID NO: 26286 - DNA, 667 bp, Zea mays
  misc_feature: Ceres CLONE 1398658-F
  misc_feature: Encodes the peptide sequence at SEQ ID NO. 26287
  misc_feature (501)..(501): n is a, c, t, g, unknown, or other
  misc_feature (548)..(548): n is a, c, t, g, unknown, or other
  misc_feature (549)..(549): n is a, c, t, g, unknown, or other
aaagctggagctccccgcggtggcggccgctctagaactagtggatcccccgggctgcaggaattcgcacgagaccattacctagaacatcctaatcgaaaaatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcacctccacgagcccgaccgacaatcaggtcatcgcagaggtcgtggaggcgtccgtgcacgactacgaggagggcatgcgcgcctgcttcgatgccgccaagacatggatggcgattcctgctccaaagcgaggagagatcgttaggcaaatcggtgatgcactgagagcaaagctccatcaccttggcaggcttgtgtcacttgatatggggaaaattcttcctgaaggnatcggtgaggttcaggaaatcatcgacatgtgtgattatgctgtggnngctaagtcgccaactaaatggatccattataccatctgaacgaccaaacatatgatggatgggaggtgtggatccccttggaagttgtggggggttataacggcatttaatttccctg

SEQ ID NO: 26287 - protein, 142 aa, Zea mays
  misc_feature: Ceres CLONE 1398658-F
  misc_feature: SWISSPROT Homolog: EC 1.2.1.3 Aldehyde dehydrogenase (NAD(+))
  misc_feature (130)..(130): Xaa is any aa, unknown, or other
MGAFAKEEHQFLAELGLAQRNPGAFACGAWGGSGPTVTSTSPTDNQVIAEVVEASVHDYEEGMRACFDAAKTWMAIPAPKRGEIVRQIGDALRAKLHHLGRLVSLDMGKILPEGIGEVQEIIDMCDYAVXAKSPTKWIHYTI

SEQ ID NO: 26288 - DNA, 764 bp, Zea mays
  misc_feature: Ceres CLONE 1398662-F
  misc_feature (682)..(682): n is a, c, t, g, unknown, or other
  misc_feature (764)..(764): n is a, c, t, g, unknown, or other
cgcggtggcggccgctctagaactagtggatcccccgggctgcaggaattcgcacgagaccattacctagaacatcctaatcgaaaagagtccagctcggcaggtcagtcagtagtggatagctccgctcgcggtcgcgggcggctcgagtcgcaccccagatcccaatgcgccccgccgcgccgctctaggccgcggaacggaagctaggtgcgtcacacgccggggccggtcgcggtcaccggaccggacgcacaggggcgccgtacgtgcagtcatcggccatgaaggtcctcgtcctcgccgtgctggcgctcgtcgccgccgccgccgccgccgatcagggcgagtccgctgccgggacccacgcataacttacaacttcccccgcccccgccgccccccgcctaccgcgtcacacaacaaagaagatgctgaggacccactcaacatacctccaaccgaccgcccggccagctccgttccctcctccgcacccaacctccattccgccatataaccgaggagctgaatagagcggccaacccgagaacgcgacccaccactcataccaccataaaaaaaacatacacagaatccactacaaccaccacgcgtccctgcgccgccccccctccccaccgtggcgtgcccccggtagcatccacactcccttatactntccggcctccttttccacctaccctacacgttcgctatttatgatactacaataaacaagtcggcagatcgtatgaacaccn

SEQ ID NO: 26289 - DNA, 714 bp, Zea mays
  misc_feature: Ceres CLONE 1398663-F
  misc_feature (307)..(307): n is a, c, t, g, unknown, or other
  misc_feature (331)..(331): n is a, c, t, g, unknown, or other
  misc_feature (398)..(398): n is a, c, t, g, unknown, or other
  misc_feature (402)..(402): n is a, c, t, g, unknown, or other
  misc_feature (403)..(403): n is a, c, t, g, unknown, or other
  misc_feature (410)..(410): n is a, c, t, g, unknown, or other
  misc_feature (413)..(413): n is a, c, t, g, unknown, or other
  misc_feature (414)..(414): n is a, c, t, g, unknown, or other
  misc_feature (428)..(428): n is a, c, t, g, unknown, or other
  misc_feature (430)..(430): n is a, c, t, g, unknown, or other
  misc_feature (431)..(431): n is a, c, t, g, unknown, or other
  misc_feature (445)..(445): n is a, c, t, g, unknown, or other
  misc_feature (446)..(446): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (459)..(459): n is a, c, t, g, unknown, or other
  misc_feature (460)..(460): n is a, c, t, g, unknown, or other
  misc_feature (471)..(471): n is a, c, t, g, unknown, or other
  misc_feature (472)..(472): n is a, c, t, g, unknown, or other
aagctggagctccccgcggtggcggccgctctagaactagtggatcccccgggctgcaggaattcgcacgagaccattacctagaacatcctaatcgaaaagactattcttcttcgtccctgatttttatccccaaactcaccgccggggcacaacaatccagttctcctttcgccggaatctgtccctcctccccctcctccccgcctctgcgggtactggaccaccgtggagcgggcattcatccaggctaggtccattccttcctttgctcgttctcttctccatcgcggaagctccacccgangtgacgccagaaagagaatcgtgncctagggtggtctcgcagaaatattttcagaagatttgcagatcgagtcgaaccctatgccccacgntagnnctggcgncgnnctgcccccttacancnnacggcgctcctggnncccgnnnaggggnncagtcccaggnnaaatgggatgatggccccgggaaggtcctggaataaaacgggcccggtgggggccgaggatgcacataccaccggttggggaaggggcccggtttccttcccctaaaaaatgggtgcccccggtggccccaacggggagggcctggagaaaaaaatttgggggaacaacgccggggaaaaaaaaaaaaatttgtgtaaaaaaaaaagggccgtttttttggcaaacccggcccccttatgaa

SEQ ID NO: 26290 - DNA, 773 bp, Zea mays
  misc_feature: Ceres CLONE 1398668-F
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (50)..(50): n is a, c, t, g, unknown, or other
  misc_feature (52)..(52): n is a, c, t, g, unknown, or other
  misc_feature (714)..(714): n is a, c, t, g, unknown, or other
gttggggggccccccccccccccccccccggcggggaaagggnnngcganancaaccaacgctggagctccaccgcggtggcggccgctctataactagtggatcccccgggctgcaggattcgcacgagaccattacctagaacatcctaatcaaaattccctccctagcccagccagggaaccagtctcagtgaatcccgcgcccggatcaatctcgcccaaggaagcagctcttcacgacttgcttccagatccatccatccatccatccgaggttgggccgtgggggtgtccgtgcggtggaaaatggggtaggggatccgcggtggacgcccgctcgcctcggggccttacggacaggggggtgttgtggaaccccgccgggggtttccgccgggcccgccccggggggtaaaaagttgggtgcccaagggggtttaagacagaccggaccttccttccccagggaagcccacagcgcgcgctcgatattgggggcgccaccccttttctcccttcacaaccacccctgctcacccccgcaatggactcaatatgctgtaaccaaaccccgcccccctcccaagccgtctctgccaagaccttttttctacccaaatttgggacagccggcagtcacgcccccaccccccgacaaaaacccaccccccgcaccacggaaacggtgacgaaaaacgtcggacgacccgtncccccaatccacgtacatcccgtgaccaaccgcgcaccccgcgccccagtggcgggcgc

SEQ ID NO: 26291 - DNA, 756 bp, Zea mays
  misc_feature: Ceres CLONE 1398669-F
  misc_feature: Encodes the peptide sequence at SEQ ID NO. 26292
  misc_feature (11)..(11): n is a, c, t, g, unknown, or other
ccccccccccnccccccccccccacattttatttttttttcctcctcacaaaactgaggctccaccgcggtggcggccgctctataatagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccgacagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcgggaagctgctctgctgctcccaccagccaccgcaccgagtgccaatggcgactgcagcgagttcgacgccggcggcgcggcagcctactctggtctgcgcgtcactgaccgcgcgggtgccccgggagatggcagcggaggttgccgccgctgcggcgctcggtgccgacgtggcggagctccaggtcggctgcctcgacagcttcgagccatgcaaggaacctgcccgtgcttctcgcccagcccccgctcgctccccgtcatcgaccacctacaggccggaaatggggaggaaggcccagtaccccaaggcgaaaaaatcgaccccaccggttttgaggccgccttctacctgtgaaatg

SEQ ID NO: 26292 - protein, 106 aa, Zea mays
  misc_feature: Ceres CLONE 1398669-F
MATAASSTPAARQPTLVCASLTARVPREMAAEVAAAAALGADVAELQVGCLDSFEPCKEPARASRPAPARSPSSTTYRPEMGRKAQYPKAKKSTPPVLRPPSTCEM

SEQ ID NO: 26293 - DNA, 543 bp, Zea mays
  misc_feature: Ceres CLONE 1398671-F
  misc_feature (167)..(167): n is a, c, t, g, unknown, or other
  misc_feature (183)..(183): n is a, c, t, g, unknown, or other
  misc_feature (543)..(543): n is a, c, t, g, unknown, or other
tggagctccccgcggtggcggccgctctagaatagtggatcccccgggctgcaggaattcgcacgagaccattacctagaacatcctaatcgaaaaccctcccccaccgcctttgctcagcagcagtagtaaagccacgcctgacagacagctgggtcatttctggntgctgcctttgctggnggagccctcgggcaggcagccagaaaagaaagagcaaaatggatgtgaaccacctgctgctaagggggttgggggggggcctggtggcatgggggggggccggggttcaaaaacggggggtgtaaaggcctccccccggggcctcgggtttggcggggggggggaaacttttcaggggattctgggggggggcctttttggggggggggggacaccccggaaaaaaaaagggccccttttccagggggggggggggggggaccccccttggggggccccgggggggatttcccacaagggggggggaaaaaaaacccccctttttttggagggcccccaaagaaaccccccccccccccn

SEQ ID NO: 26294 - DNA, 753 bp, Zea mays
  misc_feature: Ceres CLONE 1398673-F
  misc_feature: Encodes the peptide sequence at SEQ ID NO. 26295
tggagctccccgcggtggcggccgctctagaactagtggatcccccgggctgcaggaattcgcacgagaccattacctagaacatcctaatcaaaaaaacaatccagttctcctttcgccggaatctgtccctcctccccctcctccccgcctctgcgggtactggaccaccgtggagcgggcattcatccaggctaggtccattccttcctttgctcgtaagtgaccctgatttttgctctacgagtttgtttcgtgctccattgaatctaaatcccactccgcatttgcggattcatgccctactactattacaacccctttcatccatccattcctcgactaggttctcttctccatcgcggaagctccacccgagttgacgccagaagagaatcggtgccctagggtgttctcgcagaattattttccagaagatttgcagatcgagtcgaaccctatgccccacgttaagcctgccgccggcctgcccccttaccaccacgggcggtccctggccccgggaagggtccagttcccacgggacaggggatgatgccccgggagggccgggaacgaaagggcccgttgggcccgagaatggacctaccaccgggtgggcgaggggcccggctcggtccccaaagaagtgggggccccggcggccccaccgggaggtcccgggaaaaaaattttggggaacaaaaagggggagaagcaaaagggggttgtaaaaaaacccccgtttttttt

SEQ ID NO: 26295 - protein, 67 aa, Zea mays
  misc_feature: Ceres CLONE 1398673-F
MMPREGRERKGPLGPRMDLPPGGRGARLGPQRSGGPGGPTGRSREKNFGEQKGGEAKGGCKKTPVFF

SEQ ID NO: 26296 - DNA, 745 bp, Zea mays
  misc_feature: Ceres CLONE 1398674-F
  misc_feature: Encodes the peptide sequence at SEQ ID NO. 26297
  misc_feature (568)..(568): n is a, c, t, g, unknown, or other
tggagctccccgcggtggcggccgctctagaactagtggatcccccgggctgcaggaattcgcacgagaccattacctagaacatcctaatcgaaaactctcgattcggaaaaccctccaaccctagccgggatccgacaacgcctccatccctagccgcctcctgcaagtttcagagctcaagagtcggggcgccatggcgacagagacggagactttcgcctttcaggctgagatcaaccagctgctctcactcatcatcaataccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgctctccatcatcgacagcggcatcggcatgaccaagtccgaccttgtcaacaacctcggtaccatcgccaggtccgggaccaaggagttcatggaagcccttgctgctggcgctgatgtgtctatgattgggcagttcggtgtngttttctactctgcctacctcgtcgccgagagggtcgtcgtgaccacccagcatacgatgacgagcagtacgtgtgggaatcccaggggggcgggtcgttcactggtactcgtgcacgtctggggagcagcttggcaggggtactaggattaacttttcctcaaggaagatcagtaa

SEQ ID NO: 26297 - protein, 172 aa, Zea mays
  misc_feature: Ceres CLONE 1398674-F
  misc_feature (28)..(167): Pfam Name: HATPase_c Pfam Description: Histidine kinase-, DNA gyrase B-, and HSP90-like ATPase
MATETETFAFQAEINQLLSLIINTFYSNKEIFLRELISNSSDALDKIRFESLTDKSKLDAQPELFIHIVPDKASNTLSIIDSGIGMTKSDLVNNLGTIARSGTKEFMEALAAGADVSMIGQFGVVFYSAYLVAERVVVTTQHTMTSSTCGNPRGAGRSLVLVHVWGAAWQGY

SEQ ID NO: 26298 - DNA, 646 bp, Zea mays
  misc_feature: Ceres CLONE 1398675-F
  misc_feature: Encodes the peptide sequence at SEQ ID NO. 26299
tccccgcggtggcggccgctctagaactagtggatcccccgggctgcaggaattcgcacgagaccattacctagaacatcctaatcaaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacacctccccgggctcgcccgcgcagcgcttcgtgtcggaggacggcgtcatcaactcgcgccccgcggtgctgggcggcggcaactgcatcaacgccggcttctacacgcgggccagcgacgactacctgcggggcggtcggtgggaacctgggcgccccccggcggcgtaaccggtgggtgggaaggaaccgggggggcgttcacacc

SEQ ID NO: 26299 - protein, 156 aa, Zea mays
  misc_feature: Ceres CLONE 1398675-F
  misc_feature: SWISSPROT Homolog: EC 4.1.2.10 Mandelonitrile lyase
MSGRSRHFTMSTLLATSFFFVLLCSSLQVRGVNYTFVKDAALAPSVSYYDYIIVGGGTAGCPLAATLSERFRVLLLERGASPYDDDRIGDMARFADTLSDTSPGSPAQRFVSEDGVINSRPAVLGGGNCINAGFYTRASDDYLRGGRWEPGRPPAA

SEQ ID NO: 26300 - DNA, 668 bp, Zea mays
  misc_feature: Ceres CLONE 1398676-F
aaagctggagctccccgcggtggcggccgctctagaactagtggatcccccgggctgcaggaattcgcacgagaccattacctagaacatcctaatcgaaaagagaagagggcgggcatcggccagtgggggctcggaggccgaggaaggcaaggaaagcgtggggtgccgggccgcccgcgccggtgccgaggccctcaccagtcaccaccccctcccctcttccgtctgtcccgcgcttgccgccaccgccggtgcctgctcgcgacccttcccccttttgaacgctcccgcggtcccgcgtcgagctctcttctgccgccgctgccttcgtgcccgtactcgcgaggtctactcgatcctcaatctccgcgcctggacgcggcgttcgccgccggatctgggcgcgtcacggtgcccccgtacgcacgatgcgcggttgtatctcagattgggcgccgcgcgctcgcggtctcgccgtcgtgcagtggctctgctaccactagcagtccgacgatggaccaaacactgcaagggtgttggcaggactggacgtatccctccaccgggggctggaagacgggggacaactgaccccccaggatttgctcctcttctccacattctaaggacggaggcgcacccacctttgctgcttcaaagaaagg

SEQ ID NO: 26301 - DNA, 740 bp, Zea mays
  misc_feature: Ceres CLONE 1398677-F
  misc_feature: Translation starting site: 257
  misc_feature (545)..(545): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (642)..(642): n is a, c, t, g, unknown, or other
aagctggagctccccgcggtggcggccgctctagaactagtggatcccccgggctgcaggaattcgcacgagaccattacctagaacatcctaatcgaaaaagttgccattcctgtcatccggtgtggcctttgggagagggagagagaaggaaggggaggcttcttccgttccggcagcggctccctccgctttcggttctttgcaagatcgagcgagcgcaatcatcgatcgctgccatcatcaccaggcaagcatgacattagcggatggagaggcggattattcttcttgggacagtgacgacgagtaccagaaattcatccaaaacatgaaccctccaagggtcaccatcgacaacacatcatgtccaaatgctacagtcatccatgtgaacagcgcgtacaagtatggaatactgtatggaggtagtgcaggtcctcaccgacctcatgctcatagtcaagaatgcatacatatcctcagacggaggatgcttcatgtacgtcttcactgtgacgaactaaagtgggcacagataacgnacgaatctgtgctgcaagtaataaaagactacatctacgagtctatcgggcctgactcctgcttccttcctcgcgaatgagagccgtcgnnngtggnatccgtcctccgaccacaccctgatagagctagcggggaccgataggcgggctcccctctacgagggtgagcgcgggctcacgaaggctggattgcaa

SEQ ID NO: 26302 - DNA, 712 bp, Zea mays
  misc_feature: Ceres CLONE 1398678-F
  misc_feature: Translation starting site: 243
  misc_feature (191)..(191): n is a, c, t, g, unknown, or other
  misc_feature (289)..(289): n is a, c, t, g, unknown, or other
  misc_feature (326)..(326): n is a, c, t, g, unknown, or other
  misc_feature (327)..(327): n is a, c, t, g, unknown, or other
  misc_feature (356)..(356): n is a, c, t, g, unknown, or other
  misc_feature (358)..(358): n is a, c, t, g, unknown, or other
  misc_feature (360)..(360): n is a, c, t, g, unknown, or other
  misc_feature (378)..(378): n is a, c, t, g, unknown, or other
  misc_feature (400)..(400): n is a, c, t, g, unknown, or other
  misc_feature (409)..(409): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (460)..(460): n is a, c, t, g, unknown, or other
  misc_feature (466)..(466): n is a, c, t, g, unknown, or other
  misc_feature (469)..(469): n is a, c, t, g, unknown, or other
  misc_feature (471)..(471): n is a, c, t, g, unknown, or other
  misc_feature (472)..(472): n is a, c, t, g, unknown, or other
  misc_feature (493)..(493): n is a, c, t, g, unknown, or other
  misc_feature (501)..(501): n is a, c, t, g, unknown, or other
  misc_feature (512)..(512): n is a, c, t, g, unknown, or other
  misc_feature (526)..(526): n is a, c, t, g, unknown, or other
ctggagctccccgcggtggcggccgctctagaactagtggatcccccgggctgcaggaattcgcacgagaccattacctagaacatcctaatcgaaaaatccgacccagtatccccgacaaagtcaatgcgatgcgtctcctccttgctctatcgactatcgtagccgattccccgttgcaagtaactaanactaagtctcaagtctgcagagtaaccggagtagcatagcactagcaagcaatggccgctctcacttccgctctcctcttcgccgccctcctcgtggncgcccagtacgtgctccgcttgctccactccttcctnngtggtccgttccgcctggaacgccgcttncngncgcagggaatcccgtggnccacacgaaagctggtctccgntaacgcagncgactaccgcgacctgctagcnnngcgcagggtcgcgcccctctcctcttncgccanaangnngtcgtcgccgcgccacgcgcnagtacgcngtctggctggncgcgaaccgccggncgtcttgttaatattgtttcggccccggcccggggttttggtgatctcgacacgaactttggaaaaggcgggatgacgactccccccggggggtttttttataggggggccttgggggggaaacaccggctcgcaggagtttatatgggagggggggctcgcgggtttcccgcgggggaaaaaagg

SEQ ID NO: 26303 - DNA, 923 bp, Zea mays
  misc_feature: Ceres CLONE 1398681-F
  misc_feature (31)..(31): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
tttttttttttcttctttcttttttttttcncannnnnagcccnnnnnaaaagctggagctccccgcggtggcggccgctctagaactagtggatcccccgggctgcaggaattcgcacgagaccattacctagaacatcctaatcaaaaaatgccactgtgaccacaccaaacgccggcggagtcgtcagtcgtgcgtggccggtgcccgtcccgttctgccccactcccctcccccgactccctcactcttcctctttccgttccattcaagatccctgcatccgtccgtccatccatccattcttctgctaataggaaagcggaactcgcccgcactctacgggggaacccacgacgaccccccccaccccaactcgcccccgtttatccacacccttcaccccctctttttatttttccacactccctcgaggggggtggcgcttgttacctttattccttctccattattacctcatcacccccccatacttggtattacccggcctagtgccttactttcttctctcacccaccgcggcccacacctttctcaccaacgacacctcgtctcgcttccgtccctaccctctctagtcgaggtctctcacccccgccacatactgcttaccctcccggtaatttccccgtccgccatcactcaccacctctcccccccagcgcgtagaacaacacctcccccccacctcgcggcccgccccccaggtatcaccccgcgtacccgtgcaaatagacaccacacactcccaccccactactcagcccaatcaagtacactaagtaatatttatacacccagtcacagacagaaaaacaacaatacccgcgaccgctccctcaacagcgcccgcccgctgccgcctcccccgaccagctcccggcgccccgccgccaccccg

SEQ ID NO: 26304 - DNA, 741 bp, Zea mays
  misc_feature: Ceres CLONE 1398683-F
  misc_feature (347)..(347): n is a, c, t, g, unknown, or other
  misc_feature (361)..(361): n is a, c, t, g, unknown, or other
tggagctccccgcggtggcggccgctctagaactagtggatcccccgggctgcaggaattcgcacgagaccattacctagaacatcctaatcgaaaaagaaatacgcacctgctcctcactcttctttatatttttttctccatttggcaacttttgcttgtcgttcatgtatatgcatgaccctttcacacatatgatcagaagatagcacatgcaagacgatctcgcgtggatatgatgcatggatcagaactaagctctatatcatcaccaaacgctcgtagatgatgctattacatttcatgatgaattatatataagtaaaaaaaaaggaaccggacgtgcntaccataaatttanaatttatcggctggcaatggaccacatatgcctgggacagggtaagttggggatcccactgaaacgggaaggggcccaatttccgtccatgatcgcggattatccacgggaggccgagacttaaacccctttccaacccagtgggggccaaaagaaacggggggtgcagggggtggggcccctcccccccccccccgataccggggggaataaatactaatttttaatggaaaaaggccaccgcggggttccccctttttttaacaaaaaaaagggaaaggggggtttctcccccaccccaccttttcccgtgtttaggaagaactaatgggcccccaaaaaaatcttataaaaaaccccccttaatagagaaaaccccc

SEQ ID NO: 26305 - DNA, 674 bp, Zea mays
  misc_feature: Ceres CLONE 1398684-F
  misc_feature: Encodes the peptide sequence at SEQ ID NO. 26306
  misc_feature (434)..(434): n is a, c, t, g, unknown, or other
  misc_feature (494)..(494): n is a, c, t, g, unknown, or other
  misc_feature (500)..(500): n is a, c, t, g, unknown, or other
  misc_feature (584)..(584): n is a, c, t, g, unknown, or other
  misc_feature (592)..(592): n is a, c, t, g, unknown, or other
tccccgcggtggcggccgctctagaactagtggatcccccgggctgcaggaattcgcacgagaccattacctagaacatcctaaaaaaaaccttaatcctatactttcatcgggcgcggcgtgccccctcgcctccaaggctccaacgcatcaatcaatagagcgagcgcgctgtggcatggagcacaaggatgggggcacagcttctgctggtggtctgcccgccggaagcagcttgtgctcgggctcgccgttgctcgacgcgccgatcctccgccgcctctacgccgggcaaatccttgccagatggggcgcgagacatcctctctcgtggtgctcggtcccgtggtggggacgctcgttggaagggccacataccttcaggttttgggcatctggctgctgtcgcaaagcatatccttgattgtcgctgnaacctcggtgaccaccctgctcatgtatgccaacctgagagccacaagcttcccggattncatggncgctggtcgccgttaccaacgtctccggcgctctagctgccctctcagctctcgcggcaccatactgatcgagagagaaagggnggggtggngatctcaagcgggcatcctccgtcggggcggacgggaaacaatcctcgggggcccgggggatcgaactgggctgctcgctgc

SEQ ID NO: 26306 - protein, 122 aa, Zea mays
  misc_feature: Ceres CLONE 1398684-F
  misc_feature (43)..(43): Xaa is any aa, unknown, or other
  misc_feature (63)..(63): Xaa is any aa, unknown, or other
  misc_feature (65)..(65): Xaa is any aa, unknown, or other
  misc_feature (93)..(93): Xaa is any aa, unknown, or other
  misc_feature (96)..(96): Xaa is any aa, unknown, or other
MGRETSSLVVLGPVVGTLVGRATYLQVLGIWLLSQSISLIVAXTSVTTLLMYANLRATSFPDXMXAGRRYQRLRRSSCPLSSRGTILIERERXGWXSQAGILRRGGRETILGGPGDRTGLLA

SEQ ID NO: 26307 - DNA, 707 bp, Zea mays
  misc_feature: Ceres CLONE 1398685-F
  misc_feature: Encodes the peptide sequence at SEQ ID NO. 26308
  misc_feature (291)..(291): n is a, c, t, g, unknown, or other
  misc_feature (294)..(294): n is a, c, t, g, unknown, or other
  misc_feature (397)..(397): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (436)..(436): n is a, c, t, g, unknown, or other
  misc_feature (470)..(470): n is a, c, t, g, unknown, or other
  misc_feature (607)..(607): n is a, c, t, g, unknown, or other
  misc_feature (654)..(654): n is a, c, t, g, unknown, or other
aaagctggagctccccgcggtggcggccgctctagaactagtggatcccccgggctgcaggaattcgcacgagaccattacctagaacatcctaatcgaaaaacttccaccgccaccgccgagcgcggtggcaccgacacgacacacgtagctgcagacctgcagtgccagcacggctgccaatccctgctggcgctgttcccggctccgagatcatttggactcggcactcggcagggatggggatggggacggaatggccgccgacgcctgcgcagcagagaaaagcgntgntgagcgcccggtcggcgctgaagctggtactgttcgtgattctcgcgggcctcgcactgcggctgctggtggggcccccagcctacctcctggcgccccacgncgnnngcagagggggccgctcgtcttttcgcggtgcggnagagggaaagaaccgcccggcgcggcggcggcgnaatacctcccgtcgaaacggatgatgcggtttttactttgaccgattcagaaccctctacagctttaggcaagaaggaaggtccacaaaccagaagaaaagtgtgatcttttcatggcgagtgggttccattcatcnagccagctatactaatgcagctgccgctccatgagtctctcaaactngatgacaatggagactgaccagatatctcattgaaatgaagcatagggtggaa

SEQ ID NO: 26308 - protein, 84 aa, Zea mays
  misc_feature: Ceres CLONE 1398685-F
  misc_feature (12)..(12): Xaa is any aa, unknown, or other
  misc_feature (13)..(13): Xaa is any aa, unknown, or other
  misc_feature (49)..(49): Xaa is any aa, unknown, or other
  misc_feature (72)..(72): Xaa is any aa, unknown, or other
MAADACAAEKSXXERPVGAEAGTVRDSRGPRTAAAGGAPSLPPGAPRRXQRGPLVFSRCGRGKEPPGAAAAXYLPSKRMMRFLL

SEQ ID NO: 26309 - DNA, 731 bp, Zea mays
  misc_feature: Ceres CLONE 1398687-F
  misc_feature: Encodes the peptide sequence at SEQ ID NO. 26310
  misc_feature (438)..(438): n is a, c, t, g, unknown, or other
tggagctccccgcggtggcggccgctctagaactagtggatcccccgggctgcaggaattcgcacgagaccattacctagaacatcctaatcgaaaaacagcgaaccacccatggccctcgccaccactgccgtctccctccaccttttcctcacccggcccgcctccgtgctccgcgtaggccgcggcctcccatgcctcctcctccgagccacttcgtccacctccgcctccccggacttcaacatcaccttcgcggagcccgcgccgtccaaaaaggccccgtccgcgcagccgctggtcccgtggatcgtccgcggggaggacggcaagccccgcctcagcacctccccgccgccggacgtaatccagggcatcgcgctcgcggaggcgaaggccaaaaaggccgccagaaggaaaccctcagggccagaatgncgcagttgccgccgccgccgcggctgcttccaatgccagcgtcaagggcaaggaaaaggaaccccgccccgaacggggccgccaaagttctccaagggaggccggaggttttacaatgaaaataatcagggggcgggagccccaacgcttccccaagggtcttgccgccgaaggaagtggaatcaaaaaggaccaggggggggctccttttccagggggaggggcctgtcaatgggttcacctggacctcttcccaaaaaaaaattggaaatctcaaggatttttatctaggg

SEQ ID NO: 26310 - protein, 40 aa, Zea mays
  misc_feature: Ceres CLONE 1398687-F
  misc_feature (2)..(2): Xaa is any aa, unknown, or other
MXQLPPPPRLLPMPASRARKRNPAPNGAAKVLQGRPEVLQ

SEQ ID NO: 26311 - DNA, 753 bp, Zea mays
  misc_feature: Ceres CLONE 1398689-F
  misc_feature: Encodes the peptide sequence at SEQ ID NO. 26312
  misc_feature (435)..(435): n is a, c, t, g, unknown, or other
  misc_feature (436)..(436): n is a, c, t, g, unknown, or other
  misc_feature (449)..(449): n is a, c, t, g, unknown, or other
  misc_feature (465)..(465): n is a, c, t, g, unknown, or other
tggagctccccgcggtggcggccgctctagaatagtggatcccccgggctgcaggaattcgcacgagaccattacctagaacatcctaatcgaaaaatggatcgatctctaatccgacgctactgtctatggtttcctctgcatttcccctagcactcccgggggcgaccacccatggccgccggatacgcgtccgccgagaccgccgccatcgcgctgcgtctgacctcctgcatcaccggaacccgtgagcgcgagctccggtacctcctctcagaatttgtgccgggctccgagccgagcctctccgacaccgacctcttcaagctctgagaggacatcttcttctgtttctgtgacgccgatcagccggtctaccagatctccgtcgcctcgcctcagccgtctccagtccagctgtcacccgcaggtggnntgctgcttcctcngcgactacctaaccantggtccgacgggagtgggcccacatcgaacggccaccgcctcgacatagtctagctcctcaaccggcggttccatcaccacggcatccttgcttctcgatgctaacctccttcgcctccgacgtcacctctcgagtcgtgtccgtcctgacagaacaggcccctgcttcccaaaccagaaaaaggtcgcgtctgcacctcccggggactcggttaaccacgctccgaagcctttcatggaaggatttccggcctgagctccccgggagactggaaacggtggccccct

SEQ ID NO: 26312 - protein, 52 aa, Zea mays
  misc_feature: Ceres CLONE 1398689-F
MAAGYASAETAAIALRLTSCITGTRERELRYLLSEFVPGSEPSLSDTDLFKL

SEQ ID NO: 26313 - DNA, 726 bp, Zea mays
  misc_feature: Ceres CLONE 1398691-F
  misc_feature (192)..(192): n is a, c, t, g, unknown, or other
tggagctccccgcggtggcggccgctctagaactagtggatcccccgggctgcaggaattcgcacgagaccattacctaaacatcctaatcgaaaaaccaacccttgtagtctcagtcaatctgtagattgagactacgatgagcctgtcaccgctcgactcctcctccccgccggccgcggctgcggctgnctgctacggaggtgcccctcgccccgggcttccgcttccaccccaccgacgaggagctcgtctcctactacctccgccgccgcgtcctcggccgccgcctccgcgtcgacgccatcgccgagatcgacctctaccgcctcgagccctgagacctcccctccctctcccgaatccgcagacgcgacgcccggtggtacttcttcgcccgtctcgaccgaaaggtcgccggcgctggcgcccggggtccggggccgaccccgcaccagcaccaagggcgtaccccgtagaggctaccgcaaagacatcgtctatgcccccctacgttgcacctcgtcgtcatccccccgcacacacgcacaacaacccacatgtctcccgcaccgccaagaacccccccacccccccctcgcaccaaactgcggcgctgtggacgaatcgcccccgcctacttcgttcccgccactataatgattgaccaaccacgcagacgaggtatccctacaccctcctgcttcatttaatactctccctccc

SEQ ID NO: 26314 - DNA, 677 bp, Zea mays
  misc_feature: Ceres CLONE 1398694-F
  misc_feature: Translation starting site: 159
  misc_feature: Pfam Name: Psf2 Pfam Description: Partner of SLD five, PSF2
  misc_feature (319)..(319): n is a, c, t, g, unknown, or other
  misc_feature (320)..(320): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (350)..(350): n is a, c, t, g, unknown, or other
  misc_feature (352)..(352): n is a, c, t, g, unknown, or other
  misc_feature (355)..(355): n is a, c, t, g, unknown, or other
  misc_feature (357)..(357): n is a, c, t, g, unknown, or other
  misc_feature (358)..(358): n is a, c, t, g, unknown, or other
  misc_feature (360)..(360): n is a, c, t, g, unknown, or other
  misc_feature (362)..(362): n is a, c, t, g, unknown, or other
  misc_feature (363)..(363): n is a, c, t, g, unknown, or other
  misc_feature (365)..(365): n is a, c, t, g, unknown, or other
  misc_feature (371)..(371): n is a, c, t, g, unknown, or other
  misc_feature (398)..(398): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (420)..(420): n is a, c, t, g, unknown, or other
  misc_feature (421)..(421): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (472)..(472): n is a, c, t, g, unknown, or other
  misc_feature (527)..(527): n is a, c, t, g, unknown, or other
  misc_feature (584)..(584): n is a, c, t, g, unknown, or other
  misc_feature (589)..(589): n is a, c, t, g, unknown, or other
  misc_feature (590)..(590): n is a, c, t, g, unknown, or other
  misc_feature (614)..(614): n is a, c, t, g, unknown, or other
  misc_feature (615)..(615): n is a, c, t, g, unknown, or other
  misc_feature (620)..(620): n is a, c, t, g, unknown, or other
  misc_feature (623)..(623): n is a, c, t, g, unknown, or other
  misc_feature (625)..(625): n is a, c, t, g, unknown, or other
  misc_feature (654)..(654): n is a, c, t, g, unknown, or other
  misc_feature (663)..(663): n is a, c, t, g, unknown, or other
tccccgcggtggcggccgctctagaactagtggatcccccgggctgcaggaattcgcacgagaccattacctagaacatcctaatcgaaaactccgacccgcagcagcgcctccattgctctctctcacgagtcccggcgttccagtggggggcattcatggcggggcagtccgacccgcacctctccatcttctcgccctccgaggtggagttcgtggctgaggatgagattgtcgaaatcgtccccaacatccgcatggacgccctcaacatgatctggcggggatttcgggcccttcttcccccagattccacagnntgcctctccttggcttcgctgnnnnnnntnanaancnnancnngngccccntcccccccccggcctgggtggctggtnccccctccccccnnnttttggnnccggnnnnnngccgcccccgggttcccgcctttcccttcccctttttgggnttttctcggctctggttggtccgtgccggggggcctccccggggggtcccggggngggctccctttggggcgcctcgggggggccgtttccccgggggtggccgggggtttnggggnnttttggggcgcccccccttgcggnnggggngcncngggggggggcgcccggggggggggggggngcttttgcnccccccttgcgggc

SEQ ID NO: 26315 - DNA, 681 bp, Zea mays
  misc_feature: Ceres CLONE 1398695-F
  misc_feature (279)..(279): n is a, c, t, g, unknown, or other
  misc_feature (392)..(392): n is a, c, t, g, unknown, or other
  misc_feature (401)..(401): n is a, c, t, g, unknown, or other
tccccgcggtggcggccgctctagaactagtggatcccccgggctgcaggaattcgcacgagaccattacctaaacatcctaatcgaaaaagcattgcggtggagagggaagcaagaggtatcggagatagagagagaaagggcgaaaaacagaagggaacagcaacggagcagctgatcaggggctgacgcgcgcgacaatgctgctcaggagggtggcggcggacgacggctctggcgccggcgccggcgtagggagccacggctcttcgcatgccnagctgctggttcggctcgaggcgccccagtgcgcgcacagactgcgactcgccgatggcgggcgcagcccgacgtcgccgctcgatctcaggccctttcgctctctggtccgntcggcgggntcaccagaaaccaggagctgggattcccaccgcctgggcctccgggggcctcgtcgaagaaacgctcgccaaacccgcccaatggcccaagaaccccctggtccgcctcgggcccccggggggggaaaccctttaaaattgccaaaacgccccgtaagccccggccccccaaggggggggatggcccccccctccccggctcctggaaaaagggggggccccctcccctattaaaccctgcggggaaaaattctacagggggtggggacctctcccaacc

SEQ ID NO: 26316 - DNA, 673 bp, Zea mays
  misc_feature: Ceres CLONE 1398698-F
  misc_feature: Encodes the peptide sequence at SEQ ID NO. 26317
  misc_feature (275)..(275): n is a, c, t, g, unknown, or other
  misc_feature (324)..(324): n is a, c, t, g, unknown, or other
  misc_feature (325)..(325): n is a, c, t, g, unknown, or other
  misc_feature (327)..(327): n is a, c, t, g, unknown, or other
  misc_feature (328)..(328): n is a, c, t, g, unknown, or other
  misc_feature (339)..(339): n is a, c, t, g, unknown, or other
  misc_feature (340)..(340): n is a, c, t, g, unknown, or other
  misc_feature (344)..(344): n is a, c, t, g, unknown, or other
  misc_feature (398)..(398): n is a, c, t, g, unknown, or other
  misc_feature (414)..(414): n is a, c, t, g, unknown, or other
tccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtnggtggcgtcggtgctccaagaaccggcggtgtcgacggcctcccgccgnngnnctccgggttgnncggntggtggggaacctgttccaggtgatcctgcagcgacggcccttcatgtacgtgntgcgcgacctccgggnagaagtacgggcccatcttcaccatgcggatggggcagcgcaccctcatcgtggtcacctcggcggagctcatccacgaggcgctggtggaacagggccccatgttcgcgagccggcccgaggacagccccacccgcctcctcttcaggggcgggaagtgcaccgtcaactcggcgccctacggccccctggggcggggtctgcgccgcaaattcgtcgccaaaatcgtgccccccaccgcgaaaggccttctctggat

SEQ ID NO: 26317 - protein, 78 aa, Zea mays
  misc_feature: Ceres CLONE 1398698-F
  misc_feature: SWISSPROT Homolog: EC 1.14.99.9 Steroid 17-alpha-monooxygenase
MRMGQRTLIVVTSAELIHEALVEQGPMFASRPEDSPTRLLFRGGKCTVNSAPYGPLGRGLRRKFVAKIVPPTAKGLLW

SEQ ID NO: 26318 - DNA, 682 bp, Zea mays
  misc_feature: Ceres CLONE 1398699-F
  misc_feature (489)..(489): n is a, c, t, g, unknown, or other
  misc_feature (557)..(557): n is a, c, t, g, unknown, or other
  misc_feature (682)..(682): n is a, c, t, g, unknown, or other
ccccgcggtggcggccgctctagaactagtggatcccccgggctgcaggaattcgcacgagaccattacctagaacatcctaatcgaaaactagttttaagttaagcccccttctctctcacctcgatgcggcttgccaaccgccgatctgcccggccaaggattgttgagctcgccgcgggctaggtttccttccgtccaccatgacggggccaggctcagctccgacccaaacaccccctccagaacccaagcataacgcccgccgccccgtcctcctcctggggccgccactcctagccgtcgccgttgccctcctcttgggcgtatccaacaacccgttgccccgccgcttcatccgccttctctttggaacaaggccctccattctccgctcctcgccacctcctgacgcagcttacgaagcaaccggcgcggacgcacaccatgtgtttctatggatggccccattcgctcccgggcggcggntactgctcccgaggcatggtcctacgtctccgcgcttgacgcgcacgccgccgccggctggcgctggnaaaaaataatttctcgctcgcatagcgcaccacggcgactcgaattcggccggagttctggctcggcctcccggagcgatctaagcacctggcggacagactcgcctctgcgcgtgcgagtctcn

SEQ ID NO: 26319 - DNA, 695 bp, Zea mays
  misc_feature: Ceres CLONE 1398700-F
  misc_feature: Encodes the peptide sequence at SEQ ID NO. 26320
  misc_feature (380)..(380): n is a, c, t, g, unknown, or other
  misc_feature (387)..(387): n is a, c, t, g, unknown, or other
  misc_feature (388)..(388): n is a, c, t, g, unknown, or other
tggagctccccgcggtggcggccgctctagaactagtggatcccccgggctgcaggaattcgcacgagaccattacctagaacatcctaatcgaaaaaacccccctttcccgccacaccatctcctcgccgcttcccgccacctctctcccatggcggcgccgtcggcggccacgcgcaggaaactgcagcgcaagttccgcctacgaggcttcaccctcaaggtggacgccctcgaggaggccgccgccttcctcgaccgcttccccgacgccgaggacgacgcgctcgatctcctcctcgacgagctcgacaaggaaccgctgcagtcgtcgatactggaccgggacgcggtcaggcgcgtggtggcgctgcttgtcnaggccgnnagagcgctcgatggtgcgtcgccagcggcaccagcgcaggtctgcgcttgcggttggtggaccgttctcccgggccgggttcccctacgatccaaccaagaaagttttttccggccccacggcaaaattacttgtccatgggaaaactgggaaaaaaagcttccctttaaagggaaaggaaaaaaagggctgcccaaaaaaacggccccccgaaaaaataattccctaaacccggtttttacaccggggggacccaaaccctgggttgggggaaaaattttcgggcgggcccataatgggggggggg

SEQ ID NO: 26320 - protein, 181 aa, Zea mays
  misc_feature: Ceres CLONE 1398700-F
  misc_feature (77)..(77): Xaa is any aa, unknown, or other
  misc_feature (79)..(79): Xaa is any aa, unknown, or other
MAAPSAATRRKLQRKFRLRGFTLKVDALEEAAAFLDRFPDAEDDALDLLLDELDKEPLQSSILDRDAVRRVVALLVXAXRALDGASPAAPAQVCACGWWTVLPGRVPLRSNQESFFRPHGKITCPWENWEKKLPFKGKGKKGLPKKTAPRKNNSLNPVFTPGGPKPWVGGKIFGRAHNGGG

SEQ ID NO: 26321 - DNA, 609 bp, Zea mays
  misc_feature: Ceres CLONE 1398702-F
  misc_feature: Encodes the peptide sequence at SEQ ID NO. 26322
  misc_feature (405)..(405): n is a, c, t, g, unknown, or other
  misc_feature (420)..(420): n is a, c, t, g, unknown, or other
  misc_feature (489)..(489): n is a, c, t, g, unknown, or other
  misc_feature (560)..(560): n is a, c, t, g, unknown, or other
  misc_feature (609)..(609): n is a, c, t, g, unknown, or other
ggcggccgctctagaactagtggatcccccgggctgcaggaattcgcacgagaccattacctagaacatcctaatcgaaaaattgcaaatgtttctcttcctctctcccacctctcctctcctctccattgcaaaccttcgggatgaaggttgagagcctgctctgaaacgacgtacgtaaagggaacaaggaaccggagagcgtgcggcgggcttctggattttagagtaggcacctgtcgcttggacgtgcttcggaggagtacgtgtccaaaagttgcctacagtgcgtccagaggtcatgatatagactgtcatggacgcagctgcagatgaggagaggccactgattcagtacctgcctccagaggatgatgatgcttcctcacgatacactagcgacgnaacgctcgatatcancaagcagcgtgctctgaagaacagcaccgacaactggagagcatgcttcatgattcttgggtaccgagntcggccgaaatgcctggcattttacgccgacgcaaagaacctgtccactaccttccggggtgagcctgggngaaaacaacatcaaggccgcgacgaaagggccccccctgaaatggcacn

SEQ ID NO: 26322 - protein, 97 aa, Zea mays
  misc_feature: Ceres CLONE 1398702-F
  misc_feature (30)..(30): Xaa is any aa, unknown, or other
  misc_feature (35)..(35): Xaa is any aa, unknown, or other
  misc_feature (58)..(58): Xaa is any aa, unknown, or other
  misc_feature (82)..(82): Xaa is any aa, unknown, or other
MDAAADEERPLIQYLPPEDDDASSRYTSDXTLDIXKQRALKNSTDNWRACFMILGYRXRPKCLAFYADAKNLSTTFRGEPGXKQHQGRDERAPPEMA

SEQ ID NO: 26323 - DNA, 841 bp, Zea mays
  misc_feature: Ceres CLONE 1398704-F
  misc_feature (841)..(841): n is a, c, t, g, unknown, or other
taaaaaaggggggagagggggtaatgaattgttgggtcggcttcccttccacaatgtaactccaccgcggtggcggccgctctagaactagtggatcccccgggctgcaggaattcgcacgagaccattacctagaacatcctaatcgaaaaatttcagtaaacggtcgattcaaaatggggcgagacggagtgcagcaaaaaccccaagccccgcaaaacccctaaaccctagctccccacccccagcctccccgcggcttccagcgattggaggcgaagcagcccgccatggcgatcctccttaggcgcgcgtcgctgcggcgcgtcatcgccttcggcgccgcctcctcctcctcctcttctttgcactctgagatttataaagcaaggggtttgtggatccatgtttcattggccgagagttcgcatcaaaagccaaaaaaaaaagaaggcaaggtggaaacagactcccgatgaaggagagtatgtcaaaaaaaagactttgtcttttaccaccaggcctatcggattcaaaataacgtcctgcattttggggaaggggggaaataaattggggggttttgggcggttccgcaaggccccttagaagaatgtacccctggttgtggccctaactgggggcccctttcgctttttgaatcatggcgatccaaagagaaactgtggtgtgtcttcccaaaaaggcgggggcgcgctctaacagccgtactcctcagtacacagaccaggtcctcaacacataccaaagaacaccccctggcccctcagcatctgcccaccttcgcacaaaacccacccctcacgaagctctgtggcgn

SEQ ID NO: 26324 - DNA, 675 bp, Zea mays
  misc_feature: Ceres CLONE 1398710-F
  misc_feature: Encodes the peptide sequence at SEQ ID NO. 26325
  misc_feature (654)..(654): n is a, c, t, g, unknown, or other
cgctctagaactagtggatcccccgggctgcaggaattcgcacgagaccattacctaaaacatcctaatcgaaaaatccaattcacaggctcaccacaccaaccaacaagcaaaaattccccaatcctctcgtctccgcggagaagatgtcggggtgcggcaagggaggaaagggcctgggcaaggacggagagaaccggcaccggaaggtgatgcacgacaacatccaggggatcaccaagccgtcgatccggaggctgtggccccgacggacagaagacggcgcgtgtgctactactacgacccggatagtggcaactactactacgggtagggccatccgatgaagccgaaccgcatccggatgacgcaatcgttgctggagcgctacggcctcctcaaccagatgcatgtgtaccgccccagcctggccaggcaaggcgacctctgtcggttccacgccgaagactacttcaaattcctggcgctccgtcacgcccgaaacggcaacaagaggcaaacccgtcctgcttcaggcggtttcaaggaggggagaggaagggcccccgtctttgaaaggggctgttatggggttgtgcgaagacccaactcggggcgcggttaaggcgggtgggtttattcttaattgttaanttacgagcatgagatcgtgcg

SEQ ID NO: 26325 - protein, 93 aa, Zea mays
  misc_feature: Ceres CLONE 1398710-F
MKPNRIRMTQSLLERYGLLNQMHVYRPSLARQGDLCRFHAEDYFKFLALRHARNGNKRQTRPASGGFKEGRGRAPVFERGCYGVVRRPNSGRG

SEQ ID NO: 26326 - DNA, 682 bp, Zea mays
  misc_feature: Ceres CLONE 1398712-F
  misc_feature: Encodes the peptide sequence at SEQ ID NO. 26327
  misc_feature (311)..(311): n is a, c, t, g, unknown, or other
gctctagaactagtggatcccccgggctgcaggaattcgcacgagaccattacctagaacatcctaatcaaaaatcttgctctgaacgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgntccggcagcggtgcccccgtctaccctcgcggcccgtcctggagtacctcggccggctgaggtccctgggagctccgccggcaacgctgccaaggacaaccaagaagacgcgcatcgtccccgcggccacgtgctggctggcggatccgcaacgacgaggaagctcgggaaagctgctgacccggggtgaacatcccccaccggggggggtgtttgcccaacaatcaccccggcccctgggttccaaaaaagaccgcgggaaagagggcaccaggtgcggggagtgtaggggggatagttcgccacagcacgggccggcgaggcccccccaaatcgggcgcagggattccgggcccccctaccctttctcg

SEQ ID NO: 26327 - protein, 119 aa, Zea mays
  misc_feature: Ceres CLONE 1398712-F
  misc_feature (57)..(57): Xaa is any aa, unknown, or other
MDATGTGAGGKAKKGAAGRKAGGPRKKSVTRSVKAGLQFPVGRIGRYLKKGRYAQRXPAAVPPSTLAARPGVPRPAEVPGSSAGNAAKDNQEDAHRPRGHVLAGGSATTRKLGKAADPG

SEQ ID NO: 26328 - DNA, 682 bp, Zea mays
  misc_feature: Ceres CLONE 1398713-F
  misc_feature: Encodes the peptide sequence at SEQ ID NO. 26329
  misc_feature (573)..(573): n is a, c, t, g, unknown, or other
agagctggagctccccgcggtggcggccgctctagaactagtggatcccccgggctgcaggaattcgcacgagaccattacctagaacatcctaatcgaaaacattgaatttggccgagtaacagaaccgtgtctgtttttaattcctgacggttagagatggcccacccctccgccgccgccgtatcctccacggcgctcgctgcaaaccctagctctggcgccagcgaggaaggaggcgcccgctctccgccgtcgccgtctcagagggggcgggccaaggtggtgatcgttatgggcgccacgggcgccggcaagtcgcggctggccgtcgacctcgcggcccacttcgccggcgtcgaggtggtcagcgccgactccatgcagctctaccgcggcctcgaagtcctcacccaacaggctcccctccacgagcagaacggtgttcctcatcatctacttagcgtgattgatccctctgtcggagtcacttggcgtgatttccgcgaccgtgccctgccgattatacaggaaatagtggaccgcggtggcgtccctgtgggtgtcggcggnacaaactcctacatccaggctctcggtagtccatccctccttggatgatatggcaaaagaatgcagggctgtactctgagagatcacatagatgaccgcccttaccgag

SEQ ID NO: 26329 - protein, 153 aa, Zea mays
  misc_feature: Ceres CLONE 1398713-F
  misc_feature: SWISSPROT Homolog: EC 2.5.1.8 tRNA isopentenyltransferase
MAHPSAAAVSSTALAANPSSGASEEGGARSPPSPSQRGRAKVVIVMGATGAGKSRLAVDLAAHFAGVEVVSADSMQLYRGLEVLTQQAPLHEQNGVPHHLLSVIDPSVGVTWRDFRDRALPIIQEIVDRGGVPVGVGGTNSYIQALGSPSLLG

SEQ ID NO: 26330 - DNA, 649 bp, Zea mays
  misc_feature: Ceres CLONE 1398715-F
  misc_feature: Encodes the peptide sequence at SEQ ID NO. 26331
  misc_feature (439)..(439): n is a, c, t, g, unknown, or other
  misc_feature (442)..(442): n is a, c, t, g, unknown, or other
  misc_feature (447)..(447): n is a, c, t, g, unknown, or other
  misc_feature (469)..(469): n is a, c, t, g, unknown, or other
  misc_feature (470)..(470): n is a, c, t, g, unknown, or other
  misc_feature (473)..(473): n is a, c, t, g, unknown, or other
  misc_feature (598)..(598): n is a, c, t, g, unknown, or other
gctctagaactagtggatcccccgggctgcaggaattcgcacgagaccattacctagaacatcctaatcgaaaaatccgacccagtatccccgacaaagtcaatgcgatgcgtctcctccttgctctatcgactatcgtagccgattccccgttgcaagtaactaaaactaagtctcaagtctgcagagtaaccggagtagcatagcactagcaagcaatggccgctctcacttccgctctcctcttcgccgccctcctcgtggccgcccagtacgtgctccgcttgctccactccttcctgtgggtcccgttccgcctggaacgccgcttccggcggcagggaatccggtggccaccacgaagcctggtctccggtaacgcagccgactaccgcgacctgctagccgccgccaggtccgcgcccctctcctcctccgncanaaaanggcgtcgtcgccgccccagcgnnaantacggggtcgggctggcgcgggaacggcccggccgtttgggaatttatggtccgggccccgggcgggggtgggggtgatcctcgaacccgaaacttcggggaagggcggtgaatgaccgaacttnacggggggggttttgggataaggggggccccccgggcggaaaacaaccccg

SEQ ID NO: 26331 - protein, 110 aa, Zea mays
  misc_feature: Ceres CLONE 1398715-F
  misc_feature (74)..(74): Xaa is any aa, unknown, or other
  misc_feature (75)..(75): Xaa is any aa, unknown, or other
  misc_feature (77)..(77): Xaa is any aa, unknown, or other
  misc_feature (84)..(84): Xaa is any aa, unknown, or other
  misc_feature (85)..(85): Xaa is any aa, unknown, or other
MAALTSALLFAALLVAAQYVLRLLHSFLWVPFRLERRFRRQGIRWPPRSLVSGNAADYRDLLAAARSAPLSSSXXKXRRRRPSXXYGVGLARERPGRLGIYGPGPGRGWG

SEQ ID NO: 26332 - DNA, 711 bp, Zea mays
  misc_feature: Ceres CLONE 1398716-F
  misc_feature (278)..(278): n is a, c, t, g, unknown, or other
  misc_feature (294)..(294): n is a, c, t, g, unknown, or other
  misc_feature (383)..(383): n is a, c, t, g, unknown, or other
aaaagctggagctccccgcggtggcggccgctctagaactagtggatcccccgggctgcaggaattcgcacgagaccattacctagaaacatcctaatcgaaaagcattgcattgcataaacctctcgtgggaagtgcaaacaccaaatccgcaatctatctatctatcagccattcaggcctgcaggctgcagctctctccactgcacactagagcgagctgccacagacaaggacacaatgccaccccataccaagagaggcgagcatctccctgntcctcctaattgtcgnatgcgcctgccacgcccgccaccgccgccgggaccgtcccctttctacccgtccgcggagtcccgccgccgcccgcgcattgagacggnaaccctggaacccggagctctgccctgtcaacactcggaggacatcccggacctacaaaaaaaaccgctcccgggacgtcatctgcccggcccgggaacccgaccccgaggacgggggtggtgccccacccgcccagcaacctggttgtaaatacccggaaggaaagggcccctgtttcggccgcggaacccccttgggccattaaacaaattgccttgggacttttcttttcacccccaacaagggaaaaaagttcccgcgggaagacacccgccagaacctggggcgtcccccccaccgaagaaaggggtgtccggggttctcgcc

SEQ ID NO: 26333 - DNA, 654 bp, Zea mays
  misc_feature: Ceres CLONE 1398717-F
  misc_feature: Translation starting site: 168
  misc_feature: SWISSPROT Homolog: EC 2.3.1.15 Glycerol-3-phosphate O-acyltransferase
  misc_feature (188)..(188): n is a, c, t, g, unknown, or other
  misc_feature (251)..(251): n is a, c, t, g, unknown, or other
  misc_feature (255)..(255): n is a, c, t, g, unknown, or other
  misc_feature (315)..(315): n is a, c, t, g, unknown, or other
tccccgcggtggcggccgctctagaactagtggatcccccgggctgcaggaattcgcacgagaccattacctagaacatcctaatcgaaaagccaactcgcacgcagcagtacgacgtctctcctctgggtctggggccgagacacctagcacgtactaccagcaagatggtggcgtctcccagattncagcccatcgaggagtgctgctccggaggggcggtcggagcaaacggtgggcgccgacctggnacgnacgctgctcatctccaggagcgcgttcccctactacctcctcgtggctctcgaggccggnagcgttctcggggccggttggtgctcctggtccgggcgttcgtttaagtcacctaagccttttttctcgaggtggttggcaataaacccctggattactttctccggggggggtcaaagggcccccccccaaaaggggggggcctccgggcttccccggtttttaccggggggaaggtccccccgggaagggtggggggggttcccccccctctgacaggaggctaacttttccccgggaaccccccgggtttttgttggaagctttcttctggggctctctttaggaggcgaacaagaggtggcgtggggcacaaatgtgtgcgcgggggggtcaacg

SEQ ID NO: 26334 - DNA, 669 bp, Zea mays
  misc_feature: Ceres CLONE 1398722-F
  misc_feature: Encodes the peptide sequence at SEQ ID NO. 26335
ggagctccccgcggtggcggccgctctagaactagtggatcccccgggctgcaggaattcgcacgagaccattaccctagaacatcctaatcaaaaagacaaaatttcccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgccgccgccatgatctgcgcgatctccggtgaggtgccggacgagccggtggtgtcgaagaagtcggggcttctcttcgagcgacgactcatcgagcgctacattgaggaccatgggaagcgccccatcaccaaggatgagcttactatggatgatatcgcgccggcaataccaacaaggtcgtgaagcccaggcctttgcaggctgcaagaattccaggacttccttgggatttgtcagaacgagtggaatgctctcatgctttctaattttgctttggagcagcagctacacacagcaagacaagaacttagtcatgcactctaccagatgacgcttggcctgccgtgtaataagccagttggaaaaaggaaagagaggaggctagagcacttttggctcaagg

SEQ ID NO: 26335 - protein, 58 aa, Zea mays
  misc_feature: Ceres CLONE 1398722-F
MICAISGEVPDEPVVSKKSGLLFERRLIERYIEDHGKRPITKDELTMDDIAPAIPTRS

SEQ ID NO: 26336 - DNA, 632 bp, Zea mays
  misc_feature: Ceres CLONE 1398726-F
  misc_feature (258)..(258): n is a, c, t, g, unknown, or other
  misc_feature (278)..(278): n is a, c, t, g, unknown, or other
  misc_feature (324)..(324): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (572)..(572): n is a, c, t, g, unknown, or other
  misc_feature (573)..(573): n is a, c, t, g, unknown, or other
tggagctccccgcggtggcggccgctctagaactagtggatcccccgggctgcaggaattcgcacgagaccattacctagaacatcctaatcgaaaaatcttttcctttcctatccctcgtctcgtctcgtcttcgttcccctttcctcctgcgcaccccgtcttctcctcaccgcgtcaaaccccagcacaaatcaaccgcccgccgcctccgctcccctcccgtcccgaatcagccgccgcggtggccaatccggncgatccccccctctatccgncgcagaagtcgcgcctctgggcctaccccgatgtatagcaacttcnaggaggcagcgatcgaatacgtcaagcaggcgggccaggaagaaaatggccggaataaggtcaagggggttccctctctaaatggaaaggggtccaggacttccagaccatctcaaggaccaaagaaacccagaatccaggaggcatcaccggcaggttcccgagtactccccgcgccgaggaaaaaaccggccgccctccacaggggggggggggggggccccnnnncaaaaaaagagaaaaaaaanntggaaaaaggcccaaaaaaaagagggaaaagggacgcaccggggcaaaagagaaagata

SEQ ID NO: 26337 - DNA, 616 bp, Zea mays
  misc_feature: Ceres CLONE 1398727-F
  misc_feature (177)..(177): n is a, c, t, g, unknown, or other
  misc_feature (183)..(183): n is a, c, t, g, unknown, or other
  misc_feature (184)..(184): n is a, c, t, g, unknown, or other
  misc_feature (263)..(263): n is a, c, t, g, unknown, or other
tccccgcggtggcggccgctctagaactagtggatcccccgggctgcaggaattcgcacgagaccattacctagaacatcctaatcgaaaaccgaatccgccgcgcgcgccccgtcctcgtcgccggcggaggcgtccgccaccgcccacagcagactatcgccggagaaggaacgnccgcgnngagcttttccactggcatctcccgtctgacccctccgagatcgcgaagcgcggccatggccatcccgctcggggtccgncgggtcccgttcgggctcttctttctcctgggcggggctcattgtcaaaccattcaggccttccaatttgggaaaaaagggccctttccaaagattggaatcgcgggataaaagggttttggccagaggggggggccccctttgtggggggggggcccctggggacaacctaaaagaaaccaaactgggggggggggaaacttctccgcccattggggaaaaaaggggccccccccttaaaaaaaaccccaaggaggttttttttgggttttttttgggggaaattgtgcccccccccctcccgggcgcttctgagaaaacccctcccccctttgtataaaaaacaccccccc

SEQ ID NO: 26338 - DNA, 686 bp, Zea mays
  misc_feature: Ceres CLONE 1398730-F
  misc_feature: Translation starting site: 170
agagctggagctccccgcggtggcggccgctctagaactagtggatcccccgggctgcaggaattcgcacgagaccattacctagaacatcctaatcaaaaatcttgctctgaacgcattcctcccatctcccaagacctcctcagacccgagaagcgcagctgcggccatggacgccaccggcactggagctggagggaaggcgaagaagggagcggccggtcgcaaggccggcgggccgaggaagaagtcgggacgaggtccgtgaagccgggctccagttccccgtcggccgcatcgggcgctacctcaagaaggccgctacgcgcagcgcgtcggcagcggtgcccccgtctacctcgcggccgtcctggagtacctcgccgctgaggtcctggagctcgccggcaacgctgccaaggacaaccagaagacgcgcatcgtcccgcgccacgtgctgctggcgatcccgcacgacgaggagctcgggaagctgctgaacggcgtgaccatcgcccacgggggggtgttgcccaaaatcacccgggtcctgctgcccaagaagacgggggaaaaggcgtccagcggcgggagccaggaggcccagcccccccagaaggccgccaagtcccccagaaaggatagggtttggaggggggatcccatgttgtcctggggaaagttga

SEQ ID NO: 26339 - DNA, 657 bp, Zea mays
  misc_feature: Ceres CLONE 1398733-F
  misc_feature (247)..(247): n is a, c, t, g, unknown, or other
  misc_feature (273)..(273): n is a, c, t, g, unknown, or other
  misc_feature (278)..(278): n is a, c, t, g, unknown, or other
tccccgcggtggcggccgctctagaactagtggatcccccgggctgcaggaattcgcacgagaccattacctagaacatcctaatcaaaaacatttcctctctctctttctctaactccgggtccctctctcctctctctattctctccatccttgcttctgggaagctcatcagccatggacgatgccactgcagaggaagaagcttccatgttcgagaccagccatgtcctcggcgcccggtggnctcctccggccgttgctggcgcgcgnctggnaccgctgcacagccgcctcgccgcaagcgcccgtggttcgttcacggcgaagaccgcggaaaggggtacgtggggttctccggggcggaaggttgcgcttaagcggaagggcggggggggccccgccccgagtcctatattttttgtgggataacccccccccccccgcgaagcggagcactcctccgcgcgctgtcatgagctgtgggcccagcgctacaccccactacaccttatcctggaaacaaattcaccgtaagatgctgtgaagcgacgtcgagatgccccctctctcacatcacaggagacgcaactaaagggaagggggagtgagacgatattcgtccctgtgccctcgcatctcttctcttcttttcta

SEQ ID NO: 26340 - DNA, 636 bp, Zea mays
  misc_feature: Ceres CLONE 1398735-F
  misc_feature: Encodes the peptide sequence at SEQ ID NO. 26341
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
aagctggagctccccgcggtggcggccgctctagaactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggcgtccacggagagggcagcgcccgccccgcgcgtgcaggggttcctgtgcctggagnnnagtggacggagggcgtgaagctaccgtgtggacggtggggccgccaaagggaggagcaggggcgggcccgtcccgctggggcccgcctcaggcccgtgcgctgaaatcgccgctcccgcctgccgagaaataatgcattcactagatcatatggggggcctggagggttccaagacagggttactcctccatat

SEQ ID NO: 26341 - protein, 67 aa, Zea mays
  misc_feature: Ceres CLONE 1398735-F
  misc_feature (62)..(62): Xaa is any aa, unknown, or other
MAPAVGLKRSATQTITLPPPDTRLAVRDVMRSTIPSQPAVAPASTERAAPAPRVQGFLCLEXSGRRA

SEQ ID NO: 26342 - DNA, 788 bp, Zea mays
  misc_feature: Ceres CLONE 1398736-F
  misc_feature: Encodes the peptide sequence at SEQ ID NO. 26343
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
  misc_feature (39)..(39): n is a, c, t, g, unknown, or other
  misc_feature (47)..(47): n is a, c, t, g, unknown, or other
  misc_feature (48)..(48): n is a, c, t, g, unknown, or other
ntgccccccccnncnnnnnnnnnncccccccgcnntntntttccaanncatcaaagctggagctccaccgcggtggcggccgctctagaactagtggatcccccgggctgcaggaattcgcacgagaccattacctagaacatcctaatcaaaaattttccaaatccgtctacgccctcacgcacgcggcccaactagcctaacaaaccctagctagatttagaaaaaaagtttgtccccaatccgaaccgacgaggagctcgccgccgtgagatgtccgagtacgacgagcgctaccagggcaacgccgacatgcccgcagccgaaggcggctatccgcaggccgagtacgccgccgccgccgcgcctgccgccgggggttcgccgcccgcaaacagcaagccctccgggttctcccgacccacgccgacggccgctcctcccagcaccagaatgagacacaatcacatgacagtggttcctccaaaatctcgagaaaaggaaccgagaacgcgataaggggcaaggatagggagcgggaccaggaaccgtggcccgagaaaaagggggagggacggaaacagggattaaggatccgggaaaaaaagtgacaaaaaacagaagatcccggatcccccaccaaaggggacccttcggagagcgcaacgaagaaaaagggaaacccccgggaaccgtttttgaaggaaccggggacccgccccccgggatgggttcgtggccccccccaccggggatggatccggggatttcccaaaagggaaaaaacg

SEQ ID NO: 26343 - protein, 81 aa, Zea mays
  misc_feature: Ceres CLONE 1398736-F
MSEYDERYQGNADMPAAEGGYPQAEYAAAAAPAAGGSPPANSKPSGFSRPTPTAAPPSTRMRHNHMTVVPPKSREKEPRTR

SEQ ID NO: 26344 - DNA, 685 bp, Zea mays
  misc_feature: Ceres CLONE 1398738-F
  misc_feature: Encodes the peptide sequence at SEQ ID NO. 26345
  misc_feature (454)..(454): n is a, c, t, g, unknown, or other
  misc_feature (599)..(599): n is a, c, t, g, unknown, or other
aagctggagctccccgcggtggcggccgctctagaactagtggatcccccgggctgcaggaattcgcacgagaccattacctagaacatcctaatcgaaaactcgtgttcttgttcgtctccgcctcaggcaactccacacggtcacacctcgctcgctctcgctcccgtatcgcggtttccttttcgaagccttgctaggtttagctggggcctctgtctatcctgtcaatggccccttaggcggctgtacttcagacttcagaggtgacgtgaggcgtggggacgcgcgtagctgattggttcgaggaggcggggatggacccggacttctcgccggcgagtgggggcccgagctttgagttcgccttcaactcggtcaacttctctgacccggtgttgcagatcgagatcgtcgctggggatgacgccctcggggccaagggcgccaccgncgaggggtgctcatctcttgccgactgggcgtgccaccgcaagcgacgacgggaggagctccgacgcgacaaagatctagaaaatacatgccagatccagcaaactgcaaagttgaagctgaaagatgtgatgcctacgaggaanggcatgagcctgtagctatgatagaaagatctcccgctgatattgaggcagatggtgaggatggaaaaacagcgactcatactgta

SEQ ID NO: 26345 - protein, 98 aa, Zea mays
  misc_feature: Ceres CLONE 1398738-F
  misc_feature (46)..(46): Xaa is any aa, unknown, or other
  misc_feature (94)..(94): Xaa is any aa, unknown, or other
MDPDFSPASGGPSFEFAFNSVNFSDPVLQIEIVAGDDALGAKGATXEGCSSLADWACHRKRRREELRRDKDLENTCQIQQTAKLKLKDVMPTRXGMSL

SEQ ID NO: 26346 - DNA, 652 bp, Zea mays
  misc_feature: Ceres CLONE 1398741-F
  misc_feature (99)..(99): n is a, c, t, g, unknown, or other
  misc_feature (202)..(202): n is a, c, t, g, unknown, or other
  misc_feature (210)..(210): n is a, c, t, g, unknown, or other
  misc_feature (245)..(245): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
aagctggagctccccgcggtggcggccgctctagaatagtggatcccccgggctgcaggaattcgcacgagaccattacctagaacatcctaatcgaanaagcagagggccatcttctactcttctctcccagccaacccccttgtccaacggttcagcctgctcaattttagtgaccagttacggcaaatgcagccctcgncgacagcnagaagaaaaccgggcggcggcggaaaaaaaagaancttgcnnnttgctattcatgagaactgtttggccgggccgttaaaggcaatgtgaaagggggctcccctatcccccggggggggggggggaaagcgcaaccctccggaaaaaaaaccccgggggtttctaaattgtttccaaaatcccccccctttttttgttggggccccggggggggggttttttttggtcccccaaaaaaatgaaggggttccttctgggggggggggggttcccccgcttcccccccccccccctttttgggaggaggagccccgtcgtggtttccccccccacagagggtgaaactcccccccccgcgggtagaatgacaaaaacacccccctcgccgcttttttaagaacaaaaagcggccccccactcactcgcggtgtgggggcggaag

SEQ ID NO: 26347 - DNA, 657 bp, Zea mays
  misc_feature: Ceres CLONE 1398742-F
  misc_feature: Encodes the peptide sequence at SEQ ID NO. 26348
  misc_feature (305)..(305): n is a, c, t, g, unknown, or other
  misc_feature (320)..(320): n is a, c, t, g, unknown, or other
  misc_feature (587)..(587): n is a, c, t, g, unknown, or other
ggagctccccgcggtggcggccgctctagaactagtggatcccccgggctgcaggaattcgcacgagaccattacctagaacatcctaatcaaaaaccgaaccaaacaacacacgtcaaagcggaaaacctcagaaaaccacaataaatcatcctcgtccaccactgcccccgctctgctgcaactccactcggcccggccgccctttccacccaccttgatcctctgatccgttggtgcttgaccgatccatggacacccatatcggatccgtgaacggggcggcgtcgaacccagacggttgnctgcccggcgtcggncgcccgggtggccagatggcgtccacgccggcgcagcccgcggcgaccctgtgcggcgggggaaagggcaccaagacgctccccatcatcgacagcgtcatgcagatggacaaaaacgaaccctcccaacaacctcgggaaccatcaccaggtccgggaacaaagaaattatggcaaaccctggctggcccctcctgaggtggcataaataggccaaccccgggtaccccccacaaatgtaaaccccgccccccccaagaattgganctggaccccaaacataaaaaagtgaaggggtttaagggggtcaaacaccaagcaggggggcaaaaaagga

SEQ ID NO: 26348 - protein, 88 aa, Zea mays
  misc_feature: Ceres CLONE 1398742-F
  misc_feature: SWISSPROT Homolog: EC 3.1.26.5 Ribonuclease P
  misc_feature (18)..(18): Xaa is any aa, unknown, or other
MDTHIGSVNGAASNPDGXLPGVGRPGGQMASTPAQPAATLCGGGKGTKTLPIIDSVMQMDKNEPSQQPREPSPGPGTKKLWQTLAGPS

SEQ ID NO: 26349 - DNA, 803 bp, Zea mays
  misc_feature: Ceres CLONE 1398743-F
  misc_feature: Encodes the peptide sequence at SEQ ID NO. 26350
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (37)..(37): n is a, c, t, g, unknown, or other
tggggggnnnnnncccccgcccccccccccccgcccnacggccattgtgaaaactggtgctccccgcggtggcggccgctctagaactagtggatcccccgggctgcaggaattcgcacgagaccattacctagaacatcctaatcgaaaaaaggaaaaaaaaggatggctctccggcgcaacgccggatccctcgcgctccgcgccgccgcctacctccgccgccaccgtccccatcctcctcccccactggccctcgccgcccccgctcccactcccatacgctccccgctggcccccgactttccgggacttcgctgctccgcctggtactcagaccaataggaaaggaggaaaggaggaggacgatgcccgcgcggggcccgcgcatggaaaaagcccttggccgcttccctttctcagagctcggtaatgggagaaaggcccaccaacatttcctccccccggaaatggaaagcctttgaagctttgccaatccagggaatggaaccttggaacctttgggtttggagggtcccaacagggaaaaaattaagaccccccaccctgggattcgaaaaaattcatgggatttttccccgcggagagggaagttttaaaaaaaaggaaacccccggggggaaaaagaaacgcttttgaaaaaccaaagtccctggcaatttcggccttaacgggggggggggggaaaaaaaaaaaaaaaaaggccgcaatttttaagggggaaaaaccctgaaactaaaaaaaatttttgtttgggggaaaagcccacaatggggaattaa

SEQ ID NO: 26350 - protein, 59 aa, Zea mays
  misc_feature: Ceres CLONE 1398743-F
MALRRNAGSLALRAAAYLRRHRPHPPPPLALAAPAPTPIRSPLAPDFPGLRCSAWYSDQ

SEQ ID NO: 26351 - DNA, 828 bp, Zea mays
  misc_feature: Ceres CLONE 1398744-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (828)..(828): n is a, c, t, g, unknown, or other
nnnnnnnnnnnnnnnnnnnaaattggtgggtttgtgcccttttgcttgggtggtttgtacaagctgcagctccccgcggtggcggccgctctagaactagtggatcccccgggctgcaggaattcgcacgagaccattacctagaacatcctaatcgaaaaacatgttacagcgactcggcctgccgcgatttttataatgcgccgcggtggccgtcgctagtggtacatatcagcaccgcccctgcctcgaggttgcgtgttttgttctctgtgagcgccgtgggtgttgatggcgtcaacgtcgtactcgcgtccatccaagccgccaggaacggcgaccgcagacaggagcggacccccgctgttcaaggagctcggcaggatccaaccccaaaaacctgggcattcgcacaactcggcgggagcctgcctcccccctgctcaccctaccacccatttttaacctaattatttttaaatcctcataccccatactatttcggaatggatacacaggatcccaagttcgagattaacaagaagagtgggaccatacacataataccctcctcccgcgcacacccaaagacgatcggcgtatacaacacacacatcggggcctctggaccgcccccatacaccactatcaaccccacccgcccctccctgaaccactccacaccccgatactaaccagcgaccccgccctcctctccccccctccccacctctcctcctttcctacctacatcctacgttgtggatcaacacgatgtgcgtgtgctctaaacaactctggtttttgtagaacatgatcatacaccgn

SEQ ID NO: 26352 - DNA, 626 bp, Zea mays
  misc_feature: Ceres CLONE 1398749-F
  misc_feature: Encodes the peptide sequence at SEQ ID NO. 26353
  misc_feature (251)..(251): n is a, c, t, g, unknown, or other
  misc_feature (296)..(296): n is a, c, t, g, unknown, or other
  misc_feature (305)..(305): n is a, c, t, g, unknown, or other
  misc_feature (487)..(487): n is a, c, t, g, unknown, or other
  misc_feature (488)..(488): n is a, c, t, g, unknown, or other
  misc_feature (598)..(598): n is a, c, t, g, unknown, or other
tccccgcggtggcggccgctctagaactagtggatcccccgggctgcaggaattcgcacgagaccattacctagaacatcctaatcaaaaaatctcccttcggttcccaattcgaaatcgaatcgggtcggtcttgccgtgcgtgcgtggctgcgcgagcgactcgactgcaccccccgctcctcccagtcccacacactgcgcgccgcccgcgggtcctcctaagggtttcgccgcgatgtcgctccggncgagcgagcggaagcagatgcggaagggcaactaccagcagacgntggacgcgnagaaaaaccgccgccgccgcgagggccaaatggtggacatccgcaaggcccaaggccgaggaaagcctccaaaaaaacccccccgaatggttttcccgcccccccccctgggggggccccccaagggccactcccccccgggtccaaaaaaaattcaatggtttccccccataggttaaagnntttccattccaaaaaacccctcccggggaatttggggccccccacaaaattttagagaagtttttttttataaaaaaaaaatcccccctcccaaaaagggggctcccccngggggggggcccccctatcttttgtttt

SEQ ID NO: 26353 - protein, 81 aa, Zea mays
  misc_feature: Ceres CLONE 1398749-F
  misc_feature (5)..(5): Xaa is any aa, unknown, or other
  misc_feature (20)..(20): Xaa is any aa, unknown, or other
  misc_feature (23)..(23): Xaa is any aa, unknown, or other
MSLRXSERKQMRKGNYQQTXDAXKNRRRREGQMVDIRKAQGRGKPPKKPPRMVFPPPPLGGPPKGHSPPGPKKIQWFPPIG

SEQ ID NO: 26354 - DNA, 609 bp, Zea mays
  misc_feature: Ceres CLONE 1398755-F
  misc_feature (190)..(190): n is a, c, t, g, unknown, or other
  misc_feature (272)..(272): n is a, c, t, g, unknown, or other
  misc_feature (297)..(297): n is a, c, t, g, unknown, or other
gctctagaactagtggatcccccgggctgcaggaattcgcacgagaccattacctagaacatcctaatcgaaaagtcgcacggattggcattggctgccctccggccctgttcctcgtcctcctcatcaaatcccgtctcctcagtcctcccaataatggtggcgtggtgagaaatccttcccgtccggncgtcgtcttagaagatgaactgttcctcttgctgcgccgctgccactccatcttctccggcgcttctcgccaggccgcgggngggggtttagctgctagctgctccncgacgaccgcaaatcagagggtgtttttcctgggctcaaaaaagtttccacggtcacggatagccgtgcgtcgtcaccgttgctcccgaaaaagtaataagtttttccgggtaaaaccttgccaccccccacaattttcagaacccttttttttttctagggctccaaacttctcaggttggggaattttcctcccgattttcttggtacctcttcatatgtgacccccaaaaaatggaaactccggagggggggtggcattagggacacccctgggttttcttttaatatactcctcacacccctataccg

SEQ ID NO: 26355 - DNA, 651 bp, Zea mays
  misc_feature: Ceres CLONE 1398756-F
  misc_feature (326)..(326): n is a, c, t, g, unknown, or other
  misc_feature (413)..(413): n is a, c, t, g, unknown, or other
  misc_feature (470)..(470): n is a, c, t, g, unknown, or other
tccccgcggtggcggccgctctagaactagtggatcccccgggctgcaggaattcgcacgagaccattacctagaacatcctaatcgaaaaaacgcatttcgctccccacagcggctcggccacaacccacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacagctccgccaggttgctgtgtgaagntccaaggttgtcacatggattcagcacaagatttccaacccaggacattctctataaagttgtggccaccaagtgaaagcacacggnatcatgcttgttgacaggatgacaaacaatctggtctacagagtccattttctctcngcaatatcgcctttttgggaaagcaagaggctcatgagaatgcaaaaacgattgaagaactttgctttgccttggctgatgagcatttcaagaggagcagatgggggaaggggaagtcctgctgtccagctatatgcaaaggaaacagcaaatggatggttggaaagtcctaaaaaaaggc

SEQ ID NO: 26356 - DNA, 673 bp, Zea mays
  misc_feature: Ceres CLONE 1398758-F
  misc_feature (255)..(255): n is a, c, t, g, unknown, or other
  misc_feature (256)..(256): n is a, c, t, g, unknown, or other
  misc_feature (278)..(278): n is a, c, t, g, unknown, or other
  misc_feature (298)..(298): n is a, c, t, g, unknown, or other
  misc_feature (299)..(299): n is a, c, t, g, unknown, or other
  misc_feature (397)..(397): n is a, c, t, g, unknown, or other
  misc_feature (402)..(402): n is a, c, t, g, unknown, or other
  misc_feature (405)..(405): n is a, c, t, g, unknown, or other
aaagctggagctccccgcggtggcggccgctctagaactagtggatcccccgggctgcaggaattcgcacgagaccattacctagaacatcctaatcgaaaaactagtcccaactcccaaccaccgccagccgtccgctctccgcaagcgcgaccttccggccagatccgccgcgtcgcgccgacgagcggtccttctgccctagttctccgcccagcgagcggcgggttccctcgagattcccgctggccgcgnngatccatttgtgactgctcgcngtgcgcctggatctggtttnngggacgagagtgaaacgcgacggtgatcgtgcgagggtggaccgcatcagtgctctgtctggggtttcgtctcttcttcgctgcagatctggaagggnttccntgnatccgtcgctacgatctgtccagtcagagcactgcatcatctcgggtcggggcatgaagacctgctcatcttcgaggaggggacccaccagtccaccacttttcgggtccccgaaaaaagggttaaaagggtcccctcaatccacctccaattaaccgggggggaaatgggcgggggttcccactctcggataccccggggggaatcctgcccccccccccccccgcgaaaagggtttaaatttaaccccttttcctccctggagccc

SEQ ID NO: 26357 - DNA, 690 bp, Zea mays
  misc_feature: Ceres CLONE 1398759-F
  misc_feature (663)..(663): n is a, c, t, g, unknown, or other
  misc_feature (675)..(675): n is a, c, t, g, unknown, or other
  misc_feature (682)..(682): n is a, c, t, g, unknown, or other
tggagctccccgcggtggcggccgctctagaactagtggatcccccgggctgcaggaattcgcacgagaccattacctagaacatcctaatcgaaaagattttcttcacccgtccacctcgtattgcgctcctctgtctcggcgacgactgtgctaccgccgccgccgccgcaagacttcgtcgggaactttgccgccgacgatttcccaccagcccaacaggatcagaggaggtgatggagaggagtgacagctgcctggcgcgcgtggttgtcagaattgctatcggcggcggggacgtcggagccgacggtaaccttcgcccctacacctctaaagactagggttgcagcatcaatccggccgtgcgagccgcttcaaccggtcgtcgttttttcttttgaagggcacctccgtcaccgagtccacagctgtaatcctcgccagccagctaccaggtacctgacctggggttgaggtccacaccctaggggaggagggagaaactaggttcgtttcttagggaggagtaaccaaggggttaacctacaccccttcagggaggggggaaaataatccgacgcccccacagggcactttaaatgccacccccacgggcttcgctccccaaggggccctatgggagaaacccctctcgcccanacaccgcctccnacacccnctctcgcc

SEQ ID NO: 26358 - DNA, 698 bp, Zea mays
  misc_feature: Ceres CLONE 1398761-F
  misc_feature: Encodes the peptide sequence at SEQ ID NO. 26359
  misc_feature (470)..(470): n is a, c, t, g, unknown, or other
  misc_feature (541)..(541): n is a, c, t, g, unknown, or other
  misc_feature (601)..(601): n is a, c, t, g, unknown, or other
  misc_feature (604)..(604): n is a, c, t, g, unknown, or other
  misc_feature (605)..(605): n is a, c, t, g, unknown, or other
  misc_feature (689)..(689): n is a, c, t, g, unknown, or other
aagctggagctccccgcggtggcggccgctctagaactagtggatcccccgggctgcaggaattcgcacgagaccattacctagaacatcctaatcgaaaagacgatatttcggatcacacttccgtctggccaccgcaaagcaccccctctccccccgtcgccatggcgagcgataaccgcgcgtcgctcctccccttcgccgccgccgtccttgtggtgctcctcgctggcggcgccgcggcggacgacgcttccagcgacgacgacgctgggacttcacggacacccggctgctccaacaagttccagctggtcaaggtgaagaattgggtgaatgggactgaaagtacaacttttgttggcctaagtgcaaaatttggagctcccttgccaagagatattcatgaagcaaaaaagtcatttgctgtcctatcaaatccaattgactgttgctccaacttgacatcnaaagtaacaagttcagttgctatagcaacacgtggggaatgtgctttcacggaaaaagcaaatattgctcnaggcagtggttcgaccgggtttactagtatcaatgataatgaagagctttacaagatggnttnngtgtgagaatgacacctccattaatgtgacaataccctggtgtcatgataccacagtcagcaggaaagaagctgaagaacttcntgcatcatg

SEQ ID NO: 26359 - protein, 148 aa, Zea mays
  misc_feature: Ceres CLONE 1398761-F
  misc_feature (126)..(126): Xaa is any aa, unknown, or other
  misc_feature (146)..(146): Xaa is any aa, unknown, or other
  misc_feature (147)..(147): Xaa is any aa, unknown, or other
MASDNRASLLPFAAAVLVVLLAGGAAADDASSDDDAGTSRTPGCSNKFQLVKVKNWVNGTESTTFVGLSAKFGAPLPRDIHEAKKSFAVLSNPIDCCSNLTSKVTSSVAIATRGECAFTEKANIAXGSGSTGFTSINDNEELYKMXXV

SEQ ID NO: 26360 - DNA, 685 bp, Zea mays
  misc_feature: Ceres CLONE 1398763-F
  misc_feature: Translation starting site: 172
  misc_feature (290)..(290): n is a, c, t, g, unknown, or other
  misc_feature (336)..(336): n is a, c, t, g, unknown, or other
  misc_feature (367)..(367): n is a, c, t, g, unknown, or other
  misc_feature (370)..(370): n is a, c, t, g, unknown, or other
  misc_feature (400)..(400): n is a, c, t, g, unknown, or other
  misc_feature (403)..(403): n is a, c, t, g, unknown, or other
  misc_feature (474)..(474): n is a, c, t, g, unknown, or other
  misc_feature (477)..(477): n is a, c, t, g, unknown, or other
  misc_feature (489)..(489): n is a, c, t, g, unknown, or other
  misc_feature (491)..(491): n is a, c, t, g, unknown, or other
  misc_feature (493)..(493): n is a, c, t, g, unknown, or other
  misc_feature (587)..(587): n is a, c, t, g, unknown, or other
  misc_feature (652)..(652): n is a, c, t, g, unknown, or other
aaagctggagctccccgcggtggcggccgctctagaactagtggatcccccgggctgcaggaattcgcacgagaccattacctagaacatcctaatcgaaaaatcactcactccgccaccgccctctacacctcgcgctcccaccgcccggtgtcagatctcgccgccgcgatgggctccgcccactcgtccgtctccaccgccggcggcgaagacgaagagacgacgaggatccgtccgcggcagccgtctcctcccgcggcgcacaggcgccaccgcccgctctgtcngcgtcgccggtccgcgtgccccccggctccgcgtccaaagtgctgnagcaggagcccgaggtgctgccgtgcctcgncgnggactcgcccgttctcgcgaagccctcggnggngggcaccccgcgcctcctcgcgggttccggcatcaaggtctgggacccctgccacgtttctctgcccccgncgncggcgtttccgnangnagggaggcaggttgacgcccccggccattgaaggtcgttgggggccaccccccggggagagggggcgccccccccccctggaggtgggcccccncacaatattttttttttttttttaataagggcgcacggggcggggggggagggaggccgcccccncccaccctacaccacaactctgtgtggaggggg

SEQ ID NO: 26361 - DNA, 692 bp, Zea mays
  misc_feature: Ceres CLONE 1398770-F
  misc_feature: Encodes the peptide sequence at SEQ ID NO. 26362
  misc_feature (660)..(660): n is a, c, t, g, unknown, or other
caaagctggagctccccgcggtggcggccgctctagaactagtggatcccccgggctgcaggaattcgcacgagaccattacctagaacatcctaatcgaaaatggagaaatctggacagaatgctcatatattgttgtctatgttagtcaagcatcttgaacacaagaatgtattgaaacaaccagatatgaatctagatatcattgaagttacttcacgccttgctgaacactccaaagctcagtcttctatagcactaatgtcttcaataagtgatatggtcaggcatatgggtaaaagcatgcaatccttggccagtgatgcaggtcctggagacaacatggtcaaatggaatagcagatatgggaaagctgtagatgaatgtcttgttcagttgtctagaaaggtcggtgatgctggacctatccttgatacgttagctgtagtactggaaaatatttcgagttctatgattgttgcacggtctactatctctgcagcatatcgcactgctcaaatagttgcatcattgccaaacttgtcacatcagagcaaagcatttccctgaggcgttgtttcatcaacttcttttagcaatgctctatccagattgtgagacacattttagagcacatcggattttctctggtggtcttgntcccctcttccgttgctccggtttcatttgca

SEQ ID NO: 26362 - protein, 155 aa, Zea mays; identical to SEQ ID NO: 23834
  misc_feature: Ceres CLONE 1398770-F

SEQ ID NO: 26363 - DNA, 606 bp, Zea mays
  misc_feature: Ceres CLONE 1398777-F
tccccgcggtggcggccgctctagaactagtggatcccccgggctgcaggaattcgcacgagaccattacctagaacatcctaattaaaaaattaacctctctccttcctcgccccttcccctccacgactccactaccaccaccttcaccttgtctcccacaaccgccgcgcgcaagccctagcccgatctcgccggcgacagacaccagatctcgccgcccgttgcgcgccgatacgcgccccgccggattcaccgctcctcgcgctgcagcacgcccgggcctgggttactgcgtgacatgtagtattgtataaattggaggttgtcaccatcaccacaaagcatatgttgtgatttgtcgatggcgaggagatgaaacaggtgtagggggcgcagcagcaaggacatgacagccatgccgcatcggcgccaccgaggcgctgctaagaagcccatgtggatcatagggctattggcctttgggttggggtgcaccttatgggggcctatgtctacccaacacggggctactccgcatggtactttttttgttccagggcctgactccgtttaaaggatgggctaccctgctggtgctcgggg

SEQ ID NO: 26364 - DNA, 831 bp, Zea mays
  misc_feature: Ceres CLONE 1398781-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (30)..(30): n is a, c, t, g, unknown, or other
  misc_feature (45)..(45): n is a, c, t, g, unknown, or other
  misc_feature (46)..(46): n is a, c, t, g, unknown, or other
nnnnnaattttnnnnnnnnnnttcacgtancccaggcgggggttnntcaagctggagctccccgcggtggcggccgctctagaactagtggatcccccgggctgcaggaattcgcacgagaccattacctagaacatcctaatcgaaaagtcatagagagccacaggccacaggcaagacaggcaggaggatcggacgagtcggcgaggaagctgcctgcttttcagatagagttattaagatggcgttgcttcggcttgcttgccctgatctccctgctcttccgcagtggccactcctgtcagggacatcgcccacgatgcctgctcgtcagaagtgaaggatttccagcacctgatcaacagctcgggggctcccacctgacgctggcaccaccccgcagagcccctgctcccccgggggccgctggcccgccgaccttcccccttctccggggggctccgcccaacggacggggggcggcatcgcgtttcgttcgccggcgcgccttcccccaagaacgccgtccctcctcgggccccacctgtgcctttgaaccaagagaccgcggcggggggccgattcggcggtcgggcccccccgaatggacgaggccccctcggcgtcccgtggcccgcttcggccccaatgacacgggcccgggcgggggggggggccaacataccctcccccccgcatgggggccctcgggaacccacgggacaaagtccggaacgtgcatagggcgcgggaggaacgcgggggtcctctcgtgtcacgcgggagcccctagggctccccccctgcgcttctggtccgggcaacccgccg

SEQ ID NO: 26365 - DNA, 629 bp, Zea mays
  misc_feature: Ceres CLONE 1398783-F
  misc_feature (629)..(629): n is a, c, t, g, unknown, or other
ggagctccccgcggtggcggccgctctagaactagtggatcccccgggctgcaggaattcgcacgagaccattacctagaacatcctaatcaaaagatctgcgcggacgagaccagagagtccgtcatcccatggcaacccgaagagaacagtgcatatccgacgacgagcgcgcagccacaggtgatgtcctctctcaacgcggccgccgaggctcacggataagatcccccctcttctgtccgctcaagtgcaccaatccctgccgagtactggcccgagcgcccattgcatacgacgtgacgcctcctccttctagcggggcatactcatccatcgctgcatctcctggtccggtagaaggagacaccacgaactctgattgtgcagcagcaggaaatagggcggaacgctaagagcagtggagctaagagctctgctaatcagtcactgcacaaacggaaacatccttttggatccacggagctgcacttgcagtcgaagaaattacagtacaaagttgaagcattgactgataacaaaagcgcaacaagtgggttcaaaattcattttttttcagaacagaacacccgctttgatgggcacattttcccaaggttggaaatcan

SEQ ID NO: 26366 - DNA, 664 bp, Zea mays
  misc_feature: Ceres CLONE 1398784-F
  misc_feature: Translation starting site: 434
  misc_feature (664)..(664): n is a, c, t, g, unknown, or other
aagctggagctccccgcggtggcggccgctctagaactagtggatcccccgggctgcaggaattcgcacgagaccattacctagaacatcctaatcaaaaatcggatccatggtctcttttctcagccctctcagtctcacacaccacaccagagcagcgcagccgagcatgcactcatcacatcagctcctcgtctcctagctttcctattcctgccttgataattggccaattgttcgatctccttctttactaccccctttgctttcgttgctgctactactactgttccatctcctaggtttcgttgttgtccctgcaggccgccactgagtgatttgttagcagataagatttagatctcccagataaaaaaaagaggttgagaggagagctagcactaggcactagcaatcctgctgtgaggtgaatatggatccagtcgcagcatccatacacggtcatcatctttctccaccgttcaccacccgggacttccatcaccatctccagcaacagcagcagcagctcaagaccgaggacgaccacggcagcggcgcgcgaaagccgtgatgctctcggagatgtcgcagccgttgggcacctccatgacgtgcgtccggagcgtgttggcgctgtccctcgtgatgatgatgggcggtn

SEQ ID NO: 26367 - DNA, 670 bp, Zea mays
  misc_feature: Ceres CLONE 1398785-F
  misc_feature (329)..(329): n is a, c, t, g, unknown, or other
  misc_feature (364)..(364): n is a, c, t, g, unknown, or other
  misc_feature (382)..(382): n is a, c, t, g, unknown, or other
  misc_feature (393)..(393): n is a, c, t, g, unknown, or other
  misc_feature (404)..(404): n is a, c, t, g, unknown, or other
tggagctccccgcggtggcggccgctctagaactagtggatcccccgggctgcaggaattcgcacgagaccattacctagaacatcctaatcgaaaaaccgcatcgcctcgccgctgttccccgcaacctatcgacccaatctcgtccgacccggcgcgtcgtcccctccagatctccgtcgccctctccaggtagcagaaactgttctgctgcattctgacaaagtggagggcttaggagcttctgcttcttttatgtctgaacaatctttgctttatttgggattgttgggagagtactctcgtgcaactaggaaaaggcacaaggntccgtcccactgcatgcgtcaagagactgtctggntttcttgttctgatttgncatttgctggngctcaaagccngcttggtttcctcgaaggatcagcatctactcttgattgtggactttgtcgcatctgatatcaacttcataaatctttatccaagaatggcgctgcaaaacattgggtggcttcaaacaggaatgatgcctttctaacgggacaagaggcccggaatgattacccaaaatgaaaggccggggtaattggaatcaagaaaaatggtgggaaactggtggcataaaaaaaagactttgccagggcagttttccaaaaaaaccaaggat

SEQ ID NO: 26368 - DNA, 678 bp, Zea mays
  misc_feature: Ceres CLONE 1398788-F
  misc_feature (269)..(269): n is a, c, t, g, unknown, or other
aagctggagctccccgcggtggcggccgctctagaactagtggatcccccgggctgcaggaattcgcacgagaccattacctagaacatcctaatcgaaaagcttcgtggccgccttttttcacagaaaacagagggaggaaagaaaagctcacccccctctctcttcccacacctctctcacgtgtgtgaggtggcgagcccaacgagtgacgccaggccacaagtccgatccgtccgtatctaatccgctcgagcgcagttgctcgntcctcggggagacgaccggtggtatttcgagggctgagacatcggcctccatgaatcccaaggaccggtgagaccatgataggttcccttggtgcctcaaacttattacctgggcccaggggggctcccccaaaatccccgaaaaaactggggtggggaaaaaccggaaactttgggcgcccccggaattgtgccaaaacctcatggccctttttggagaaatgggagttgaggagtctaggccaaaaccctccccaggggtttggggacccaggggtaaccccccgaaattgccggttcaaaaccccgggaggggttaaccctaaactgggccccagaaaattttacaaaccaaagggccaatatggggattgggtttttggcgctgggacaaaaaccatgttcgggg

SEQ ID NO: 26369 - DNA, 747 bp, Zea mays
  misc_feature: Ceres CLONE 1398792-F
  misc_feature: Encodes the peptide sequence at SEQ ID NO. 26370
  misc_feature (175)..(175): n is a, c, t, g, unknown, or other
aaagctggagctccccgcggtggcggccgctctagaactagtggatcccccgggctgcaggaattcgcacgagaccattacctagaacatcctaatcgaaaaactctccaatctcgccgccaagcctcaccgcaccatggcgaccttcaccgcggcctcctccctctccctcctncttctcccacccgcactcccactcccgccaaccatccgcccaggggcccaccgccagctcccacctccacctgcatccgcgcgccagccgcgcgcgctgcgcctcttccgacacgacggccacgaagcaccgccgcccagcggaggagaacatccgcgaggaggcggcgcgcctccgaggcccggcccagggtttctctgcggggtacaggcccttcccgccggggcccgggggggaacccgaaacgagcgctactccctggaagaggccgtctaccgcttcaagttgggggggccccccccgacgtggcccaacaaaatgggaggggttgggcccctaccccgggggcccaaaggggggggaaccttttcaaaacccccgggggggcccccccccccggaccccaaagtgctgggggggttggggcaacaaaagaagattcgggcctcccccaaaaaaaaattctcaacacaattgtgtccccccttttgagggggaaaaccccccccctttctgaggggggagaaccctcccgcgggaaaacccctcgggggaaaaaaaacacccctccg

SEQ ID NO: 26370 - protein, 57 aa, Zea mays
  misc_feature: Ceres CLONE 1398792-F
MGGVGPLPRGPKGGGTFSKPPGGPPPPDPKVLGGLGQQKKIRASPKKKFSTQLCPPF

SEQ ID NO: 26371 - DNA, 771 bp, Zea mays
  misc_feature: Ceres CLONE 1398798-F
  misc_feature: Encodes the peptide sequence at SEQ ID NO. 26372
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (771)..(771): n is a, c, t, g, unknown, or other
nnnnnnnnnnnnnnnnnngggggggggggggggggnannnttaatacaaaatataaaaactggagctccccgcggtggcggccgctctagaatagtggatcccccgggctgcaggaattcgcacgagaccattacctagaacatcctaatcgaaaaatggagaagcttccttcagtgagtcctccctttccgtttaaggcagcaagcaggagcagacaggaggcgccgagagcccagcgtcggagatctccgccgccatggagacgctggccagcgccatgcggcgcgagaaccgccggtccaaggccccgcccctcctcctctgcttcctccgccctcgcctcgggcagggtccctctcgtcatggccttcctctcctgcctcgcctggctctacgtcgccggccgtttgtggcaggacgcgcagacccgggcgatcctgtccggcctcctcgagaagagctctaccagcgtccccgaaggtgctctccggggagggaacagcttaagaaccttggggtgcagggtgattggaaaggaaaattgttgaggggggaaagggacctgaccaaggcccaagagcgagggggtacctgggggaggaaaaaggaactgccagcttgtggacccccaaacaagaaagcccccacctttcttggcccgccatttgggagttctaaaaatggggggttgggccccccggatcaaaacacaaaacgcccctcccgcggctcacccgggaatagaacaacaaggccgatcgcacactaan

SEQ ID NO: 26372 - protein, 130 aa, Zea mays
  misc_feature: Ceres CLONE 1398798-F
MEKLPSVSPPFPFKAASRSRQEAPRAQRRRSPPPWRRWPAPCGARTAGPRPRPSSSASSALASGRVPLVMAFLSCLAWLYVAGRLWQDAQTRAILSGLLEKSSTSVPEGALRGGNSLRTLGCRVIGKENC

SEQ ID NO: 26373 - DNA, 662 bp, Zea mays
  misc_feature: Ceres CLONE 1398799-F
  misc_feature (371)..(371): n is a, c, t, g, unknown, or other
  misc_feature (399)..(399): n is a, c, t, g, unknown, or other
  misc_feature (436)..(436): n is a, c, t, g, unknown, or other
  misc_feature (439)..(439): n is a, c, t, g, unknown, or other
  misc_feature (458)..(458): n is a, c, t, g, unknown, or other
  misc_feature (467)..(467): n is a, c, t, g, unknown, or other
  misc_feature (468)..(468): n is a, c, t, g, unknown, or other
  misc_feature (472)..(472): n is a, c, t, g, unknown, or other
  misc_feature (476)..(476): n is a, c, t, g, unknown, or other
  misc_feature (477)..(477): n is a, c, t, g, unknown, or other
aaagctggagctccccgcggtggcggccgctctagaactagtggatcccccgggctgcaggaattcgcacgagaccattacctagaacatctaatcgaaaatttttagtcccatcggctcggatccgcccgcccgccgtgcgcgcgtgcacgcacgcacgcctcgcgagcagatggggctggcagtggcggtgggcaggcggccgacgcagcggtccggtgtctcccgttctcgctgcgctggcaagagacccactgcccgcgagccccgacaccaccggcaccgcacggagggaagaaaagaaagaaatcccgggggatcacgtcgttatcagcgaccagattcagacgcgagccgagcgggggaggcgnaccacactagaactagaaccctctctancggtctactacgctacgccccatcccgcccggacggnacnggacccaccttcctccacntctctgccnngcgncggnncgaccgaatgggggcgggaaccaatatagcctgagcaacgggccgcccaaggcagcgcgcggacaacggaaccacgtgttcccgggcacgggtactccccctaccgaccacgggggcggtcgggtggggtttgggccatccatttaaggctttcctggcccggcttgtttttctttttccggggg

SEQ ID NO: 26374 - DNA, 831 bp, Zea mays
  misc_feature: Ceres CLONE 1398800-F
  misc_feature: Encodes the peptide sequence at SEQ ID NO. 26375
  misc_feature (1)..(1): n is a, c, t, g, unknown, or other
  misc_feature (6)..(6): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (45)..(45): n is a, c, t, g, unknown, or other
  misc_feature (47)..(47): n is a, c, t, g, unknown, or other
  misc_feature (48)..(48): n is a, c, t, g, unknown, or other
  misc_feature (59)..(59): n is a, c, t, g, unknown, or other
nccccnccccccnnnnnnncccccctnnngggggnntntgccatntnntcccagctggngctccaccgcggtggcggccgctctagaactagtggatcccccgggctgcaggaattcgcacgagaccattacctagaacatcctaatcgaaaaacgccgctgctccaagaaaccaccgccgagcccaaccgcacaagcgcgcgaggcaggagagagagagagagaggcggggagcaaaacaatggaggggaaagaggaggacgtgcgcctgggcgccaacaagttctcggagcgccagcccatcgggacggcggcgcagggcgccgctgacgacaaggactacaaggagcccccgccggcgccgctgttccaagccgggggagctcaaggcctgggccttctaccgcgcggggatcgccgagtttcgtcgccacctttcctccttcctctacattcaccatcctcaaccgtcatgggcggtctccaaggcccaccctccaaggggcgcccacccgtcggcaatccaggggcatctccccctggcccctttccggagggaaatgatcctttcgcgggcttcgtgctaatggcacccgccccggcatcctcccgagagggacaccttcaaaccccgaggttggggaaactttccggggcgtggttctttagcgcagggaaaaccttttcccctggacataaggcccccctctttcaacaatttaatcctggcaaaggcccggggttggccatccttgggggaaacttgggaggtgggtggaagggcctccccagccagggggacttttaggtggggggaaacggggggggtgg

SEQ ID NO: 26375 - protein, 188 aa, Zea mays
  misc_feature: Ceres CLONE 1398800-F
MEGKEEDVRLGANKFSERQPIGTAAQGAADDKDYKEPPPAPLFQAGGAQGLGLLPRGDRRVSSPPFLLPLHSPSSTVMGGLQGPPSKGRPPVGNPGASPPGPFPEGNDPFAGFVLMAPAPASSREGHLQTPRLGKLSGAWFFSAGKTFSPGHKAPLFQQFNPGKGPGLAILGGNLGGGWKGLPSQGDF

SEQ ID NO: 26376 - DNA, 697 bp, Zea mays
  misc_feature: Ceres CLONE 1398805-F
  misc_feature: Encodes the peptide sequence at SEQ ID NO. 26377
aagctggagctccccgcggtggcggccgctctagaactagtggatcccccgggctgcaggaattcgcacgagaccattacctagaacatcctaatcgaaaaagacaaccaaacgaaccctcccggagcagcaaagcataggcgctcgagcgctccctcccgagctcctccgcctcacggtcacgcctcgtgtccccccaccccctcctcctcctcctcggccggccgcctcacgccgtcacctccgctcggcgagtctcggctccgaccgctgccgccacgtgcgacctcccctactcctgagagatctgcggggctcggcatggggtgaccagatcgggccgctgctcggtgctttccagctgaattttgccccgcagctcgtgtcggaggcagcgaagatggcggaggccggcgtggcacgcggctcagggagcgctggcaatgctttgttcagggaactctggcatgcttgtgctgggccggtggtcacagtggcctcgcaagggcgagctggtttattacttcccccagggtcatatgggaacagcttgaagcgtctaacaatcaacaactttgatcaacacttgcctttggttaatccaaccgaacagaatcctctgcaaggggggccaaggaacaacttaaaagtggaactgattctggatgaatttaatgccaaattatgctgcaaaccc

SEQ ID NO: 26377 - protein, 99 aa, Zea mays
  misc_feature: Ceres CLONE 1398805-F
MAEAGVARGSGSAGNALFRELWHACAGPVVTVASQGRAGLLLPPGSYGNSLKRLTINNFDQHLPLVNPTEQNPLQGGPRNNLKVELILDEFNAKLCCKP

SEQ ID NO: 26378 - DNA, 743 bp, Zea mays
  misc_feature: Ceres CLONE 1398807-F
aagctggagctccccgcggtggcggccgctctagaactagtggatcccccgggctgcaggaattcgcacgagaccattacctagaacatcctaatcgaaaaagggccggacgacggggacagacagcggtgtcgggggggcacctgcttccccacgccggcccgcacctgctgccctgtcgtccggccttctttccttcctctcccctcccactgttttctcaactcccgaccaaccacggccggtgccgccaaggcgcaaaccgcacagtatcggtgtctctgggacattggaacaacaggtgggggtggtgaacggctgggggggggttctgttggcaatggccgagaaaaatcaccatggtgccctatttacccaaaggggggttggcgggggataactgggacctggcgaaaaccccatgggttcgggggtgcataactttgccacagggtggaaaatttgggagggcccccctggggggggccttgggttttccaaagggggaaacaagggagtcccttttttcaaaaaaaaaaaaaaggggttcactttccccggcaaaaaaggaaaaataattttggcgggggggggggggttttagaagaaacgagctgggggtcttttccgcgacaaattcgacaaaaaaaggttttttatcctcggggaggtctttcacatcgggaaaaaaaaaaaatgttttctcccccgggggggagaaaaatgtcgccgcacaaaaaatt

SEQ ID NO: 26379 - DNA, 717 bp, Zea mays
  misc_feature: Ceres CLONE 1398808-F
  misc_feature: Encodes the peptide sequence at SEQ ID NO. 26380
aagctggagctccccgcggtggcggccgctctagaactagtggatcccccgggctgcaggaattcgcacgagaccattacctagaacatcctaatcgaaaatctctctcgctttctctagccatgacgctggtgaggatgccttgccgcctctgctgcttcctgctcgtcgtcgccgcctccgccgtctccgggcggggggcggtggtcaccaccctcccgggctacgagggccgcctccccttccacctcgaaacagggtatgtggaggtggacgaggacgccggcgcggagctcttctactacttcgtccgggcccgagtcgggcgccgacgacagcgacaccccgttcgtcctcccggatccccgggcggcaacgctgctcctccttcagcggcctacgctacaagataggtcccatcatggttgccgtggacccctacaacggcagcttgccgcgcctgccttacacccaaaatcggggacaaagggggcgcatattctttttgggggattccccaggtgggggccggggttttcccttccccaagagatgccaaagggtaacaacgctgggaacgggattccacccacaaatgccacttggccaaagtcccccccccaggggggttccaaggacccttccccgagtaacccttgcgaaatccttttcctacctccggtgggaaaaaccctacacctgtggaaaaatttcgtc

SEQ ID NO: 26380 - protein, 96 aa, Zea mays
  misc_feature: Ceres CLONE 1398808-F
  misc_feature (31)..(62): SWISSPROT Homolog: EC 2.3.1.91 Sinapoylglucose--choline O-sinapoyltransferase
  misc_feature (32)..(62): SWISSPROT Homolog: EC 2.3.1.92 Sinapoylglucose--malate O-sinapoyltransferase
  misc_feature (30)..(61): SWISSPROT Homolog: EC 3.4.16.5 Carboxypeptidase C
MTLVRMPCRLCCFLLVVAASAVSGRGAVVTTLPGYEGRLPFHLETGYVEVDEDAGAELFYYFVRARVGRRRQRHPVRPPGSPGGNAAPPSAAYATR

SEQ ID NO: 26381 - DNA, 696 bp, Zea mays
  misc_feature: Ceres CLONE 1398817-F
  misc_feature: Encodes the peptide sequence at SEQ ID NO. 26382
  misc_feature (472)..(472): n is a, c, t, g, unknown, or other
  misc_feature (597)..(597): n is a, c, t, g, unknown, or other
  misc_feature (672)..(672): n is a, c, t, g, unknown, or other
aagctggagctccccgcggtggcggccgctctagaactagtggatcccccgggctgcaggaattcgcacgagaccattacctagaacatcctaatcgaaaaaagttaacctctcgtgctcgggcactttctttttccttcccccctgtgcgctcggccgcctccgccgctgcctcgctccctccgcgcccaccacggaggcgcacgcgcgggcgcagcgtccctcgcgtgcctcgccttccgcactgctctgtccgcccgcctggctcctgcctcctcctcctcctcctcctctagggttagggcacgcgtcgcgggggcccgtggcgcccggcgcaatgcggaggccgtcgggggccggcgtgccgagccgccgccgccgcgcgatccaggtgctcgtggcggtctccctcgcctacgcggtcgccgtgctgctcctcgagtcgcccctcgtgtccacgtcgctgcccggngcgggggcgtccgccgcggcgtcgcggaagctccacctcgacggcgcgtgagagggcgcgggacgagcagcgccggcgcgccccgcgaagcacccgcacagggagaccctctcggtggacgcggngcggggacgggcgcgccggatggcgcggatcgtctctggtctcgaggtccgcacctcaactccacccgctccggntcgctccgaaaggccgccgcggag

SEQ ID NO: 26382 - protein, 61 aa, Zea mays
  misc_feature: Ceres CLONE 1398817-F
MRRPSGAGVPSRRRRAIQVLVAVSLAYAVAVLLLESPLVSTSLPGAGASAAASRKLHLDGA

SEQ ID NO: 26383 - DNA, 618 bp, Zea mays
  misc_feature: Ceres CLONE 1398819-F
tcaccgcggtggcggccgctctagaactagtggatcccccgggctgcaggaattcgcacgagaccattacctagaacatcctaatcgaaaaatccaatccccgggccaccactacctgcctgcccgtgcccacgcttcttctcttctcctccccaagccccagccccagccccagctaccgcgcccccctctgtctggttcaccagcgtcggcctagctacctgcccgtccccctctcgagtaacggtcgaaagcctcagctgaaagatctgggcctggccggcctccggacaagggaaaaggttcggtttggccttcctaaaggaaagccttagttaaaaaaatttttccccggttcaccttaaaaattgaaagttaaaaatggcccccaaagggggaaaaggtttgttaaaaaaaaaaaaataaaatttggagatttaaacccccccggaaattgtgtggaaaacaaaaggggggaaaactccaatttccgcggggggggccccttttgggggccccccaggggaaacccccaaaaatttctggttatttggaaaacccaaaaacccttttgtatccaaaaaaaaaatccccgaaagccacatgtggcggcaaaac

SEQ ID NO: 26384 - DNA, 743 bp, Zea mays
  misc_feature: Ceres CLONE 1398832-F
  misc_feature: Encodes the peptide sequence at SEQ ID NO. 26385
  misc_feature (479)..(479): n is a, c, t, g, unknown, or other
  misc_feature (480)..(480): n is a, c, t, g, unknown, or other
  misc_feature (535)..(535): n is a, c, t, g, unknown, or other
  misc_feature (536)..(536): n is a, c, t, g, unknown, or other
  misc_feature (568)..(568): n is a, c, t, g, unknown, or other
  misc_feature (621)..(621): n is a, c, t, g, unknown, or other
  misc_feature (645)..(645): n is a, c, t, g, unknown, or other
caaagctggagctccccgcggtggcggccgctctagaactagtggatcccccgggctgcaggaattcgcacgagaccattacctagaacatcctaatcgaaaataccctctggcattggttgtcgatttcttcgttcgtgcttgcttgcgtaaaatatttaaataaatgaaggcaaatatgggcacaaaagctcgtccaccatctgctgatgcagaaaaaggggagattggcgaaatagatacaagggctccaattcaatctgttaaagctgcagtgagtttatttggtgaggtccgcttttcatctgacaaatcagctgaaagaaagcccaaggctcctcaaacagagagggttttagccaaggagacagagttgcacatggcccagaaagagttgaataaatacaaggaacagctcagtaatgctgagacaacgagagtacaggctctctctgagctagagaagctaaaaaaactgnntgagagcttacagccaagctggatctgattaacagtccaaaacagtggccatccnngcaacagaggatgcaaagacttcaatcagcanctttgaagtggcaagaccagtggaaggctaggaaacgatggtgcttctaaacngaaactggaaagtgcagggaacantattcttgttgctttggcaaaccttgattcaccaaaaaagagcttaaaaagctccaaaaagattttgaaacctttttggaataaggggtgcctgtgcc

SEQ ID NO: 26385 - protein, 113 aa, Zea mays
  misc_feature: Ceres CLONE 1398832-F
  misc_feature (105)..(105): Xaa is any aa, unknown, or other
MKANMGTKARPPSADAEKGEIGEIDTRAPIQSVKAAVSLFGEVRFSSDKSAERKPKAPQTERVLAKETELHMAQKELNKYKEQLSNAETTRVQALSELEKLKKLXESLQPSWI

SEQ ID NO: 26386 - DNA, 655 bp, Zea mays
  misc_feature: Ceres CLONE 1398834-F
  misc_feature: Encodes the peptide sequence at SEQ ID NO. 26387
  misc_feature (582)..(582): n is a, c, t, g, unknown, or other
  misc_feature (605)..(605): n is a, c, t, g, unknown, or other
  misc_feature (625)..(625): n is a, c, t, g, unknown, or other
  misc_feature (632)..(632): n is a, c, t, g, unknown, or other
aaaagctggagctccccgcggtggcggccgctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggccgggacagctgactagctgagaggcatggggatggacgccggcggcggcaagctgccgtacagctacgccggccagcaggacggcgggaagctggtgaagagcgtcagccgcgtggagccgcgcaggttcggcctgggcctcgtggcgggcttcctcgtcgtcacctgcgcctacttctccaccgccaagttcgacgccatccagatcgccatgaccagccgacccgtctccagcaatgcggctggcgtcggagtncgctcgctgggagtgggcgccgncgccgccgacacctccacgnctccagnagggattagattgggcgcatgtc

SEQ ID NO: 26387 - protein, 101 aa, Zea mays
  misc_feature: Ceres CLONE 1398834-F
  misc_feature (85)..(85): Xaa is any aa, unknown, or other
  misc_feature (92)..(92): Xaa is any aa, unknown, or other
  misc_feature (94)..(94): Xaa is any aa, unknown, or other
MGMDAGGGKLPYSYAGQQDGGKLVKSVSRVEPRRFGLGLVAGFLVVTCAYFSTAKFDAIQIAMTSRPVSSNAAGVGVRSLGVGAXAADTSTXPXGIRLGAC

SEQ ID NO: 26388 - DNA, 699 bp, Zea mays
  misc_feature: Ceres CLONE 1398835-F
  misc_feature: Encodes the peptide sequence at SEQ ID NO. 26389
caaagctggagctccccgcggtggcggccgctctagaactagtggatcccccgggctgcaggaattcgcacgagaccattacctagaacatcctaatcgaaaaacacatacacccacaccccgcgcttcacgttctcaataatggcgccgttcccacgtcgtcttccggccgccgtgccacttcttctcctcctcggcgccgcagtggcccacgccggcgcggaggacaccgatggcggcaactcccgccggcggcacttcccgcttgctgttcgcgttcggcaactcgctcaccgacacgggaaacggggccatcttcccggtgactgcaggcgggccattcacccagccgccgtacggggagaccttcttcggtcgtcccagcggccgggcttgcaacggcaggctcgtcctcgacttcctcgtggagtagctgaaggtgccagagccgacgccgtacctggccggcaggacggccgccgactttgcgaagaacgagccactttgcgcttggtggtgcaacgcgctcgacccagcgttctagcaacagggggataaaagtcgtcgtgcccatctctctcatcacgagaccagctggtttcagaaccgtttcgagcttactggaccgttcccctatcaccaggtagaaacttttgcagaatcattttttaacccggggagaaaatgggtccaaaactt

SEQ ID NO: 26389 - protein, 66 aa, Zea mays
  misc_feature: Ceres CLONE 1398835-F
  misc_feature: SWISSPROT Homolog: EC 3.2.1.51 Alpha-L-fucosidase
MAATPAGGTSRLLFAFGNSLTDTGNGAIFPVTAGGPFTQPPYGETFFGRPSGRACNGRLVLDFLVE

SEQ ID NO: 26390 - DNA, 663 bp, Zea mays
  misc_feature: Ceres CLONE 1398842-F
  misc_feature: Encodes the peptide sequence at SEQ ID NO. 26391
  misc_feature (421)..(421): n is a, c, t, g, unknown, or other
  misc_feature (551)..(551): n is a, c, t, g, unknown, or other
  misc_feature (552)..(552): n is a, c, t, g, unknown, or other
  misc_feature (557)..(557): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
aagctggagctccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacgggcttcgtgtggctccggcagcgccgcaaggtggaccactacttcgccaaggccggccgccacgtgtcctacggcgccgaggtgtncgcggtggccgacaagggccggctcaagaagatcacgggcgtcaaggccagggagatgctgctgtgcgtcaccctccacgagatctgcgtcgacgacccgcccactggtaagctccactgcaagggcatnncgcgnctgtcccgcagcttccccgtcgaggcctttcgagccgaggagccgcgccgccggagcggcggcttccccgggaacgagagggagaannnnnnggggggggnnnnnn

SEQ ID NO: 26391 - protein, 161 aa, Zea mays
  misc_feature: Ceres CLONE 1398842-F
  misc_feature (2)..(152): Pfam Name: DUF538 Pfam Description: Protein of unknown function, DUF538
  misc_feature (83)..(83): Xaa is any aa, unknown, or other
  misc_feature (126)..(126): Xaa is any aa, unknown, or other
  misc_feature (127)..(127): Xaa is any aa, unknown, or other
  misc_feature (157)..(157): Xaa is any aa, unknown, or other
  misc_feature (158)..(158): Xaa is any aa, unknown, or other
  misc_feature (159)..(159): Xaa is any aa, unknown, or other
MTLTIPDEVRAKAEVYVGDAAGQEKTRLLLQETGLPSGLLPLRDIIECGYVEETGFVWLRQRRKVDHYFAKAGRHVSYGAEVXAVADKGRLKKITGVKAREMLLCVTLHEICVDDPPTGKLHCKGXXRLSRSFPVEAFRAEEPRRRSGGFPGNEREXXXGG

SEQ ID NO: 26392 - DNA, 626 bp, Zea mays
  misc_feature: Ceres CLONE 1398844-F
  misc_feature: Encodes the peptide sequence at SEQ ID NO. 26393
  misc_feature (112)..(112): n is a, c, t, g, unknown, or other
  misc_feature (174)..(174): n is a, c, t, g, unknown, or other
gctctagaactagtggatcccccgggctgcaggaattcgcacgagaccattacctagaacatcctaatcaaaaaaccctcatggaagcgtggccacctctcgcccccgcggnggccactccggcctgtgccttggcgtggggagcagcaccaacggcgcagcggaaggccgtgnagcaggagtcagcggcgcaggcggtgagccgcatcgtggcgagctgcgcaactccagcggcgtggcagtcgccgtggtggaacgcaacgccgtcatctcgggggggtccgttctctccacttcgcggggggccttgtcaccgtgcccgaggtgcttcaagggagggccgggaacccaaccggcggggggggcccccggttcctccccgtttcccgtttaaaaccgttgacctgggccccggaatcttttaaaaaaagttcccaagttttgccgggggaaaaggaaaatcccaagcgtttcccaaggtggaataaaaaatatttggtgttgggttaaaggggaaaagagggaaaacccgtggatatacccttttgggaaggaccccccccccccctggggggggggagggggaaaaaaggggttaaaaatccaaaggcggggggggggggccc

SEQ ID NO: 26393 - protein, 114 aa, Zea mays
  misc_feature: Ceres CLONE 1398844-F
  misc_feature (11)..(11): Xaa is any aa, unknown, or other
  misc_feature (32)..(32): Xaa is any aa, unknown, or other
MEAWPPLAPAXATPACALAWGAAPTAQRKAVXQESAAQAVSRIVASCATPAAWQSPWWNATPSSRGGPFSPLRGGPCHRARGASREGREPNRRGGPPVPPRFPFKTVDLGPGIF

SEQ ID NO: 26394 - DNA, 700 bp, Zea mays
  misc_feature: Ceres CLONE 1398846-F
  misc_feature: Encodes the peptide sequence at SEQ ID NO. 26395
  misc_feature (391)..(391): n is a, c, t, g, unknown, or other
  misc_feature (420)..(420): n is a, c, t, g, unknown, or other
  misc_feature (602)..(602): n is a, c, t, g, unknown, or other
caaagctggagctccccgcggtggcggccgctctagaactagtggatcccccgggctgcaggaattcgcacgagaccattacctagaacatcctaattgaaaaacatcgatcagtcgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggncggaacctcgcgtccggcgagagcgtggncatcaaggtcatcgacaaggagaaggtgatgcgcgtcggcatgatcgaccagatcaagcgcgagatctccgtcatgcgcctcgtccgccacccccacgtcgtgcagctgcacgaggtgatgggcagcaggagcaagatatacttcgccatggagtacgtccgggggggggagtcttcgcccnggtcccccggggcggtttcaggaggaccccccaaaaaggacttcccccagtttgtgggggccgtgattttgcaaaagcggggggttaaccccgggacc

SEQ ID NO: 26395 - protein, 132 aa, Zea mays
  misc_feature: Ceres CLONE 1398846-F
  misc_feature: SWISSPROT Homolog: EC 2.7.11.1 Non-specific serine/threonine protein kinase
  misc_feature (39)..(39): Xaa is any aa, unknown, or other
  misc_feature (100)..(100): Xaa is any aa, unknown, or other
MEKKPTILMNRYELGRTLGQGTFAKVYHGRNLASGESVXIKVIDKEKVMRVGMIDQIKREISVMRLVRHPHVVQLHEVMGSRSKIYFAMEYVRGGESSPXSPGAVSGGPPKKDFPQFVGAVILQKRGVNPGT

SEQ ID NO: 26396 - DNA, 623 bp, Zea mays
  misc_feature: Ceres CLONE 1398847-F
  misc_feature (154)..(154): n is a, c, t, g, unknown, or other
  misc_feature (155)..(155): n is a, c, t, g, unknown, or other
  misc_feature (192)..(192): n is a, c, t, g, unknown, or other
  misc_feature (193)..(193): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (427)..(427): n is a, c, t, g, unknown, or other
  misc_feature (438)..(438): n is a, c, t, g, unknown, or other
  misc_feature (440)..(440): n is a, c, t, g, unknown, or other
  misc_feature (445)..(445): n is a, c, t, g, unknown, or other
ccgctctagaactagtggatcccccgggctgcaggaattcgcacgagaccattacctagaacatcctaatcgaaaagagactctgagtctcgctcgcaccccgtcccccgcagcctgtgctctgggttggagggaggtgagcttgcgagggagnncgcggagggggggccgaggaaataatggggaaggggnnccaaaaaaaaaaatttttttttttttcccccccccccnnngcgcgggggggggggggggggggggcaaaaaaaaaaaagaaagaagagcctttttttttttttttgtttgggacacaaatttttttttttttgtggcgttggggggggggggcccacccccccccccgccgcggcggggggtgttttttttttttttccccccccccccccccggagggggggggggggggggnagggggggaananagganaccccccccccccgcccccgttgttttcttttttgttttttcccccccccacccccccccccgcgcgtgcggcggggaggtgcgcccgacctctctttcttcttttgtttggggggaggaaagggagcggggggggggaggacgatcctcaaacgtctccgctttctctcccacgccg

SEQ ID NO: 26397 - DNA, 681 bp, Zea mays
  misc_feature: Ceres CLONE 1398849-F
  misc_feature: Encodes the peptide sequence at SEQ ID NO. 26398
  misc_feature (511)..(511): n is a, c, t, g, unknown, or other
  misc_feature (628)..(628): n is a, c, t, g, unknown, or other
  misc_feature (636)..(636): n is a, c, t, g, unknown, or other
ccccgcggtggcggccgctctagaactagtggatcccccgggctgcaggaattcgcacgagaccattacctagaacatcctaatcgaaaaaggtctaggtggtctccaagctttccgcctttccacgccaccattctccccacccgcgcgcctcagcaatccccatccagcatcgccgtttcgccgcggcaccgacacctcgccggccatgggcgcgtcctcctcgactggcaacccgtccccagaggcgcacgagcagcgggagcaggagactctcgcctccgccgccctctccctcccgctcctccgcgccgccttctcccgctccgccgccaacgcgctgccggatgccctcgcgccgccgcccgcctcctttcgtctgcccggatccccggcgccgccgccgccgcacttccacggaatttccccgggggggggctcggccccgccatcgcctcccaattcttcggccacgaagcctgccgcggtgacggacggggcccccccgggnggggtccagtccccccttcaggggggtcaacccgctgctggcgcggcgcgttgacgggcctcccggctcgctcgcactgggttccctccgggggtggtacgcctggccgctgggggncccggggngcggggggaaaacccttggcgggcgtccagctccaaggccggagg

SEQ ID NO: 26398 - protein, 118 aa, Zea mays
  misc_feature: Ceres CLONE 1398849-F
MGASSSTGNPSPEAHEQREQETLASAALSLPLLRAAFSRSAANALPDALAPPPASFRLPGSPAPPPPHFHGISPGGGSAPPSPPNSSATKPAAVTDGAPPGGVQSPLQGGQPAAGAAR

SEQ ID NO: 26399 - DNA, 713 bp, Zea mays
  misc_feature: Ceres CLONE 1398851-F
  misc_feature: Encodes the peptide sequence at SEQ ID NO. 26400
  misc_feature (452)..(452): n is a, c, t, g, unknown, or other
  misc_feature (519)..(519): n is a, c, t, g, unknown, or other
aaagctggagctccccgcggtggcggccgctctagaactagtggatcccccgggctgcaggaattcgcacgagaccattacctagacatcctaatcaaaaaacctcagtagtagcaggacgtatctagagccatttctacacgagatagagattaataaaaataggagcggagagagaggggcaggaaataaacgaggatctcaaccacacgcaacacaagaagctgacgaagggctaatcccccggaacccgttaacgctgtgggagtgtgagcccacccggccacccgtttcggctaatctaccgctcgccttctcccatcgccatgcctgccgcttcctggtccgcgcccaccacctccttcgcgccggcgccggcgccgccatgggggccgtggaggaccaaggcggcgcctttacccatcaggacgcttccccgccgagtgcttctncacgcagttggcgaatccgccatggttgctgctggtgacacattgcttggtttgtatgagaaagagncggtaggcctgatgcagtatgccgacgacgagtctaaagagagaggtactggggaaaccctggatgctgatttgcggtactggaccagatccttgcgcccaggggcagggaatcctggtcatattgcaaaaacggagaaagatttgaagaaccattgaggttcaggaatggcctccaaaaaacccgggatgtct

SEQ ID NO: 26400 - protein, 67 aa, Zea mays
  misc_feature: Ceres CLONE 1398851-F
  misc_feature (16)..(16): Xaa is any aa, unknown, or other
MVAAGDTLLGLYEKEXVGLMQYADDESKERGTGETLDADLRYWTRSLRPGAGNPGHIAKTEKDLKNH

SEQ ID NO: 26401 - DNA, 683 bp, Zea mays
  misc_feature: Ceres CLONE 1398857-F
  misc_feature (572)..(572): n is a, c, t, g, unknown, or other
caaagctggagctccccgcggtggcggccgctctagaactagtggatcccccgggctgcaggaattcgcacgagaccattacctagaacatcctaatcgaaaaaccgcatcgcctcgccgctgttccccgcaacctatcgacccaatctcgtccgacccggcgcgtcgtcccctccagatctccgtcgccctctccaggtagcagaaactgttctgctgcattctgacaaagtggagggcttaggagcttctgcttcttttatgtctgaacaatctttgctttatttgggattgttgggagagtactctcgtgcaactaggaaaaggcacaaggttccgtcccactgcatgcgtcaagagactgtctggttttcttgttctgatttgtcatttgctggtgctcaaagccggcttggtttcctcgaaggatcagcatctactcttttgatgtgactttgtcgcatctgatatcaacttcataaatctttatccaagatggcgctgcaaaacatgggtgctcaaacagggatgatgctttctacggtacagatgccccggatgattaccagatngaaggcggggaaatggtataaaacaatgttggaacttgttaataaaaaaagattggcaggcattttctaacaaacaagtttttgaggggacttggggcaaccccattttga

SEQ ID NO: 26402 - DNA, 703 bp, Zea mays
  misc_feature: Ceres CLONE 1398860-R
cgattgggtaccgggccccccctcgaggtcgacggtatcgataagcttttttttttttttttttatgaggcagcaggcagcagcactgcaagacgcgttagtatttctcatagacagaactgtacatacaccaagatttttggattttttaactcccccgtatcaaaaaaaaagctcgctctctaactgactcatccgggccaccggccacaccgatcaccggaccgcccgctagctgtccgccgtttcccatgaaccacccaccgttgtcgagtccccgctgatctgggcaccactctctccacttccaccgttggccctggcggcgctcatgcgtgcctcgtacgcgtggccgaggttccttaaccggttgagctccggcagtatgactgtggcgaggtccggccggtccctcccccccatctccgtgcacttgagcgcgagcttggcgtagccgagcgcctcctcgacgggccagtccttgacggtgatgtcgagcatctgctcaaaggtgcccgcgtcgatggccttctcgacgtgatgcgtgagccccatgggtggccgcgcggtgaccacctgcagcaggagcacgcccagggagtagatgtccgaacttgacgcccaccttgcccgtctgctggtactccgggtacgatgtaaccaaaaggtgcccgccgtcgccgtcaggccgaacctgcgtcag

SEQ ID NO: 26403 - DNA, 754 bp, Zea mays
  misc_feature: Ceres CLONE 1398862-F
  misc_feature: Encodes the peptide sequence at SEQ ID NO. 26404
  misc_feature (1)..(1): n is a, c, t, g, unknown, or other
  misc_feature (11)..(11): n is a, c, t, g, unknown, or other
  misc_feature (19)..(19): n is a, c, t, g, unknown, or other
  misc_feature (50)..(50): n is a, c, t, g, unknown, or other
  misc_feature (213)..(213): n is a, c, t, g, unknown, or other
  misc_feature (216)..(216): n is a, c, t, g, unknown, or other
nggtttttttnttggggangtttttttttctttcttttaaaaaaaaaaanacaaagtgggactccccgcggtggcggccgctctagaactagtggatcccccgggctgcaggaattcgcacgagaccattacctagaaattctaattcaaaaaacaatgaagccctggagattgtcccatatgccgtgctcgtgatgaccacccacatctctnttnaccccggtgtcgtgttcttgccccgtggctactctcccgctcgacgttccaaagtaaagatgcctccccatattgaagaataccctcgcatgccccccaagagagagctaaagtttgccttggagtctttctgccaatggaagagcagcgacgatgattaagagaatgttgccctctgaccctaaggataggatgtgaaaagcaaatgtgacagcctgcgatcacgtacattccccagcaacaccttctcgccccacgaccagatccttgctaccacggccatggttggtgcttgtccccacagcgctattcttggaactggagaccatattgcctttaagcaccaatttctctatcgccagggaaaaagccactgtcccctgttatgaaggatggacctatgggtttgggatacagactacccctttttattggccccttgaatcttggcccccacgcacccaaggttttccattcgccttaccccccgcaggggtttgttttctgggagtaaccaagggacggccacaaaaagccg

SEQ ID NO: 26404 - protein, 33 aa, Zea mays
  misc_feature: Ceres CLONE 1398862-F
  misc_feature: SWISSPROT Homolog: EC 2.1.1.14 5-methyltetrahydropteroyltriglutamate--homocysteine S-methyltransferase
MPPHIEEYPRMPPKRELKFALESFCQWKSSDDD

SEQ ID NO: 26405 - DNA, 681 bp, Zea mays
  misc_feature: Ceres CLONE 1398863-F
  misc_feature: Translation starting site: 232
  misc_feature (268)..(268): n is a, c, t, g, unknown, or other
  misc_feature (452)..(452): n is a, c, t, g, unknown, or other
caaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgcttgccngcgcgcttgctggcatgtggtggcggtcgtggctcaagaacggcggtgttcgaccggctcccggccggggcttcggggtgggcggtgggggggaaactggttcaagtgattctgtaacgacaggcctttatgtacctggggcgcgaacatcccggagaagaacggggccatctttaccatgtgnatggggcagcgcagccctcatcgtggggacctcggcgggacatctcctcgaagggcttgtgaaacaggggcccctggtgtccaagccggcccaggaaaaccccaaccccttctcttcaaggggggaagagggaccgcaaattgtgggcctatagccccctggggggggtctcggcgcaaattcttcgccaaaatatgtcccccaacaccgcaagggttcttctgggacc

SEQ ID NO: 26406 - DNA, 637 bp, Zea mays
  misc_feature: Ceres CLONE 1398864-F
  misc_feature: Translation starting site: 329
  misc_feature (458)..(458): n is a, c, t, g, unknown, or other
  misc_feature (507)..(507): n is a, c, t, g, unknown, or other
  misc_feature (532)..(532): n is a, c, t, g, unknown, or other
cgctctagaactagtggatcccccgggctgcaggaattcgcacgagaccattacctagaacatcctaatcaaaaaaagccgggaaccagaccccaccagcagcactccatatactgcatgcatagagatagatagatatatgtcgagcttaattactatagtcgtcgacgtcgatcgtaactgcgatagctttagtttttgcggtcatcagatagatatcgggtgcataaatatatccctcagctagctgtaactgcaactgcagtcgcaatagctataggtttcagttgattagctagctactaactacgacaagctaggcgaatcgatgaaactaaggctcggtagcggcagaggtatgcacgcgatcaggactctgttgctgcagcagggatgtaggaaggccccctggacggcgctggaggacaggctgctcaccgagtacgtgcatcagcacngccagggctgctggaactccgtcgccaagctcacaggactgcgtcggancgggaagactgccggctgcggtggntgaactacctccggccggacctcaagcggggcaagacacccccgacgaggagaccggtcatcctcacctgcacgcatgctcggcaacaggtggtcggcgatcgcg

SEQ ID NO: 26407 - DNA, 677 bp, Zea mays
  misc_feature: Ceres CLONE 1398867-F
  misc_feature: Encodes the peptide sequence at SEQ ID NO. 26408
  misc_feature (285)..(285): n is a, c, t, g, unknown, or other
  misc_feature (288)..(288): n is a, c, t, g, unknown, or other
  misc_feature (342)..(342): n is a, c, t, g, unknown, or other
caaagctggagctccccgcggtggcggccgctctagaactagtggatcccccgggctgcaggaattcgcacgagaccattacctagaacatcctaatcgaaaactcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctgggcggcgcgctggcttgcatgtgntgncgtcggtgctccaagaccggcggtgtcgacggcctcccgccggggcctccgggnttggccggtggtgggaaacttgttccaagggatcttggaggaacggcccttaatgtgactggggggcggaccctccggaaaaaaatacgggcccatttttccctttgggatgggggaagggccccccttttggggggaccctcgggggggttttcccccaaagggttttggaaaaagggccccatttttttaaagaccgccccaaggaaaacccccccccctcctttttttaaggttggggagaggacccggaaaatttgggccctaaaagcccccttggggggggtgtttttgccccaattttttttcccgaaaaaatgtgcccccccaccccg

SEQ ID NO: 26408 - protein, 149 aa, Zea mays
  misc_feature: Ceres CLONE 1398867-F
  misc_feature (19)..(19): Xaa is any aa, unknown, or other
  misc_feature (20)..(20): Xaa is any aa, unknown, or other
MDVNDVLLVVLGGALACMXXRRCSKTGGVDGLPPGPPGLAGGGKLVPRDLGGTALNVTGGRTLRKKIRAHFSLWDGGRAPLLGGPSGGFSPKGFWKKGPIFLKTAPRKTPPPPFFKVGERTRKIWALKAPLGGVFLPQFFFPKKCAPPP

SEQ ID NO: 26409 - DNA, 623 bp, Zea mays
  misc_feature: Ceres CLONE 1398870-F
  misc_feature: Encodes the peptide sequence at SEQ ID NO. 26410
tcccccgggctgcaggaattcgcacgagaccattacctagaacatcctaatcgaaaagatccgatggcccgcgccgccgctcgcctcctccccatcttcctcccatggcggcgtcctcccccgccctgcctcctccgccggggcttcctaaaccctagcagccccagaacctccgcgcgcgtcgacaccctcgttctccctggagacgagcgcttgcccttcccctcgcccccacgcctcccgaaccagctgcgtcctgactacgggagtggcggcggaggcggcgctccctcgaccatcgcggccatcgtcacctcactcggcggaggccctgcagcggtggcggatcgtgcggatctccggccccatggccgtcgccgtcgccgaccgcgttttccgcccagccgggaccaggagggcgtcaacgccggggcaaccgcgcagacacttttgttgaagtacggactcgggctcgacggggacggcagcgtttttggacgaatggttttgggggaggccaatgctgcccccccgagggtcctaacccccaaaaaggatggttgggggaggctttcaagggcccgggggggggaatcccatgcatggcggggggggggactcag

SEQ ID NO: 26410 - protein, 186 aa, Zea mays
  misc_feature: Ceres CLONE 1398870-F
MARAAARLLPIFLPWRRPPPPCLLRRGFLNPSSPRTSARVDTLVLPGDERLPFPSPPRLPNQLRPDYGSGGGGGAPSTIAAIVTSLGGGPAAVADRADLRPHGRRRRRPRFPPSRDQEGVNAGATAQTLLLKYGLGLDGDGSVFGRMVLGEANAAPPRVLTPKKDGWGRLSRARGGESHAWRGGGL

SEQ ID NO: 26411 - DNA, 651 bp, Zea mays
  misc_feature: Ceres CLONE 1398872-F
  misc_feature (460)..(460): n is a, c, t, g, unknown, or other
  misc_feature (558)..(558): n is a, c, t, g, unknown, or other
  misc_feature (563)..(563): n is a, c, t, g, unknown, or other
  misc_feature (611)..(611): n is a, c, t, g, unknown, or other
ggagctccccgcggtggcggccgctctagaactagtggatcccccgggctgcaggaattcgcacgagaccattacctagaacatcctaatcgaaaacatccatcaaattgcccgagctaggcacacaatctcacacgtcaactagctcaacttgctacccttcacgcagaactacacgctagagaagatgccatacaaagacctcttcgtcaccaacttagatgcccctctgattgtcgccgatttcttccccaagtttcgtacccatcagcgcaactactccatatacacgagacacggcttcaccgtttcactaggcaacgcagcgaccgacaggattttgaggatcgccaccgcttgatggatcctgacgtctctcccgtcgtctctgtcgagaagatgaacaacatgggcctcagcgagcgctgctagcgactgccgtccatctgctaccaccgantgcgtcgtcagcaagtgcctctgcttcccaccctttagcaaagagaacaccattgtgcatgaatagctgttgcaacaagtgccttcaccacggcccgnagtgncctgttccctggcccggaagccgatgccgcccaatgcctggtcctccnaaagccgccctgcccccgaaacccgaaagcccgagggccg

SEQ ID NO: 26412 - DNA, 703 bp, Zea mays
  misc_feature: Ceres CLONE 1398875-F
  misc_feature: Encodes the peptide sequence at SEQ ID NO. 26413
  misc_feature (634)..(634): n is a, c, t, g, unknown, or other
aaaagctggagctccccgcggtggcggccgctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggccgggacagctgactagctgagaggcatggggatggacgccggcggcggcaagctgccgtacagctacgccggccagcaggacggcgggaagctggtgaagagcgtcagccgcgtggagccgcgcaggttcggcctgggcctcgtggcgggcttcctcgtcgtcacctgcgcctacttctccaccgccaagttcgacgccatccagatcgccatgaccagccgacccgtctccagcaatgcggctggcgtcggagtcggctcgctgggaagtggcagcgccgccgccgacaccatcaacgcctccaggnagggattagatttgggcgcgaggtccattggccgaggaggggagcgaggccgaagcgctctagaaagag

SEQ ID NO: 26413 - protein, 117 aa, Zea mays
  misc_feature: Ceres CLONE 1398875-F
  misc_feature (95)..(95): Xaa is any aa, unknown, or other
MGMDAGGGKLPYSYAGQQDGGKLVKSVSRVEPRRFGLGLVAGFLVVTCAYFSTAKFDAIQIAMTSRPVSSNAAGVGVGSLGSGSAAADTINASRXGLDLGARSIGRGGERGRSALER

SEQ ID NO: 26414 - DNA, 630 bp, Zea mays
  misc_feature: Ceres CLONE 1398877-F
  misc_feature (176)..(176): n is a, c, t, g, unknown, or other
  misc_feature (182)..(182): n is a, c, t, g, unknown, or other
  misc_feature (183)..(183): n is a, c, t, g, unknown, or other
  misc_feature (190)..(190): n is a, c, t, g, unknown, or other
  misc_feature (191)..(191): n is a, c, t, g, unknown, or other
  misc_feature (259)..(259): n is a, c, t, g, unknown, or other
  misc_feature (264)..(264): n is a, c, t, g, unknown, or other
  misc_feature (292)..(292): n is a, c, t, g, unknown, or other
ggagctccccgcggtggcggccgctctagaatagtggatcccccgggctgcaggaattcgcacgagaccattacctagaacatcctaatcgaaaactctattagaatagccaggggcctcgctcctctccaccacgtactccactccatccatccatcatcgtctatccatgaagnagcttnngcagagnnagaggcggcgttggtgccgtcgccgtggccccagcaacagagaaaggacggcgccgagcatgatccgnagcanctgatggatgaggatgacggtgaccatnaagaggatctgcaggatgagcagcacacaagaccattaggacgtcgacccagacggcgaagcatcgtcatccacgaacggcggtgcccccccttggggaaaccccccccgggcgcaaaagctgtgccccccaaaaggggggggcggggcaatcccgggtccccccgggggggtttgtcccccccccccgggggggggggaaaaccaaggggggggggggggacccaccccaaataaaatcccgggttttcggaaaaagggggggggggggggtttttataaaaaaaaatgggggccccccaccaaggtcctttacccggaggggggcccctgggccca

SEQ ID NO: 26415 - DNA, 800 bp, Zea mays
  misc_feature: Ceres CLONE 1398878-F
  misc_feature: Translation starting site: 192
  misc_feature: SWISSPROT Homolog: EC 3.4.22.34 Legumain
  misc_feature (31)..(31): n is a, c, t, g, unknown, or other
  misc_feature (32)..(32): n is a, c, t, g, unknown, or other
  misc_feature (35)..(35): n is a, c, t, g, unknown, or other
  misc_feature (36)..(36): n is a, c, t, g, unknown, or other
aaaatttgaatagaagtggtttgagggttcnnttnncccccccctccccccctcaaaactggagctccccgcggtggcggccgctctagaactagtggatccaccgggctgcaggaattcgcacgagaccattacctagaacatcctaatggaaaaactctcgcttccttccctccctccctcccacgcaaatggtggccgctcgcctccgcctcgcgctgctactctccgtctgcctctgctccgcgtgggcgcgaccacgcctcgagacggccatccgcctgccgtcatgcgcgcggcggcgatcgatgaaacggacgacggcgccgtcgggacccgctgcgctgtgctcatcgaaggttagagaggctactaccactaccgccaccaagcggacatctgccatgggtaccagatcatgcacaagggtggaactccggggatgacaacctaatgtcttcttcatggacccacggactcccggccataagaccggaaaaaagcccgaggggctggtggaactccatcaaaccatcccccgggggtggacccacccttaatagctggggcggggcccaaaagaatctctccctgggtcgaagaaaggcccaagggtccaaaaatctttctttcccctactccgggcttgggcaaaaaaaaacttggttcccccgcggggggcgaagcgcaccaaggtttgccgccccgcggcgccccacaaagaaccaaaaatcctttcagacctccccccaggtgaccaaagggggcggcccgggccggtcccctggcaaagggcccca

SEQ ID NO: 26416 - DNA, 695 bp, Zea mays
  misc_feature: Ceres CLONE 1398893-F
  misc_feature: Encodes the peptide sequence at SEQ ID NO. 26417
  misc_feature (387)..(387): n is a, c, t, g, unknown, or other
  misc_feature (411)..(411): n is a, c, t, g, unknown, or other
aaagctggagctccccgcggtggcggccgctctagaactagtggatcccccgggctgcaggaattcgcacgagaccattacctagaacatcctaatcgaaaaacactttattctttcttcagcctagtccgactaccgactaagaccgactcagctccggcgaccctcaaaccgcaccagccatggacgggccgcgttggacggaagaggtggacgacctggtcgacgccggcgacgtcgacggcgccatcgccctccttgagtccgtcgtctccgatttgtcaacctccgctgctccccctgccactgaccttcgcctcgccacggcgctcggcgacctcgcgggcctgcacgcctcccggggagacaccctccgagccgacgagntccgcgcccgcgcattcgcctttncggtccgcgcacggtccctgggactgggaccctaggggatcaggagctgtcagagaaatgtccatcacagagtgtgcaacgggttcaaaggactcaaaagctcagctaaaactaataaaaccatgaaaatgggggggttgattggaaggtatggcaaataaggggggcttggaagaaccaagggggtttctggacaaggggtaaagttttttctggggcccccccgaaaaagggccccccttttctgggccccaaagggggggggggggggttcttttttttaa

SEQ ID NO: 26417 - protein, 87 aa, Zea mays
  misc_feature: Ceres CLONE 1398893-F
  misc_feature (69)..(69): Xaa is any aa, unknown, or other
  misc_feature (77)..(77): Xaa is any aa, unknown, or other
MDGPRWTEEVDDLVDAGDVDGAIALLESVVSDLSTSAAPPATDLRLATALGDLAGLHASRGDTLRADEXRARAFAFXVRARSLGLGP

SEQ ID NO: 26418 - DNA, 703 bp, Zea mays
  misc_feature: Ceres CLONE 1398895-F
  misc_feature: Encodes the peptide sequence at SEQ ID NO. 26419
  misc_feature (269)..(269): n is a, c, t, g, unknown, or other
  misc_feature (332)..(332): n is a, c, t, g, unknown, or other
  misc_feature (333)..(333): n is a, c, t, g, unknown, or other
  misc_feature (408)..(408): n is a, c, t, g, unknown, or other
  misc_feature (590)..(590): n is a, c, t, g, unknown, or other
  misc_feature (622)..(622): n is a, c, t, g, unknown, or other
  misc_feature (623)..(623): n is a, c, t, g, unknown, or other
  misc_feature (659)..(659): n is a, c, t, g, unknown, or other
  misc_feature (662)..(662): n is a, c, t, g, unknown, or other
caaagctggagctccccgcggtggcggccgctctagaactagtggatcccccgggctgcaggaattcgcacgagaccattacctagaacatcctaatcgaaaaacctctcggctccattctgcccctcctccttctcagtcggcagccaccatgccaccgcacgcaaccaaggatcccgtcgccgcgcctgcagcagccacggcggcggcgctgtcgcgggccctggcggcggcgcgccctttcctgcgcgggagggaggcggaggtgnacccggcgctgcctggcctcgccgccgtgctgcgcggcgcgggcgccggcgagggctggcacnngcacgggacgttcctggcgcacctgctggacgtgcaccggatcctccgcctgtggggcgcgcccgaggccgtggngggctgggggctctaccactccgtctaagtccaactcctaacgcaacctggccattttcccgccgggaaccgggcgcgccccatgtcgttggccggtggtcggaggacccgggaaggccttggggacctctcttgttccgtccccagggaagaggttcgtcacaaaggctgggtgtttcccntaacccgaaccggacctctcgcgagaaaacannactttttccagagattcggacagggaagccctggtnccnctggttccaaaaaactaagccgggggaccgaaagaaaaaaa

SEQ ID NO: 26419 - protein, 94 aa, Zea mays
  misc_feature: Ceres CLONE 1398895-F
  misc_feature (40)..(40): Xaa is any aa, unknown, or other
  misc_feature (61)..(61): Xaa is any aa, unknown, or other
  misc_feature (86)..(86): Xaa is any aa, unknown, or other
MPPHATKDPVAAPAAATAAALSRALAAARPFLRGREAEVXPALPGLAAVLRGAGAGEGWHXHGTFLAHLLDVHRILRLWGAPEAVXGWGLYHSV

SEQ ID NO: 26420 - DNA, 749 bp, Zea mays
  misc_feature: Ceres CLONE 1398896-F
  misc_feature: Encodes the peptide sequence at SEQ ID NO. 26421
  misc_feature (365)..(365): n is a, c, t, g, unknown, or other
  misc_feature (366)..(366): n is a, c, t, g, unknown, or other
  misc_feature (479)..(479): n is a, c, t, g, unknown, or other
  misc_feature (491)..(491): n is a, c, t, g, unknown, or other
  misc_feature (518)..(518): n is a, c, t, g, unknown, or other
  misc_feature (519)..(519): n is a, c, t, g, unknown, or other
  misc_feature (533)..(533): n is a, c, t, g, unknown, or other
  misc_feature (534)..(534): n is a, c, t, g, unknown, or other
  misc_feature (551)..(551): n is a, c, t, g, unknown, or other
  misc_feature (573)..(573): n is a, c, t, g, unknown, or other
  misc_feature (607)..(607): n is a, c, t, g, unknown, or other
  misc_feature (629)..(629): n is a, c, t, g, unknown, or other
  misc_feature (656)..(656): n is a, c, t, g, unknown, or other
  misc_feature (658)..(658): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
aaagctggagctccccgcggtggcggccgctctagaactagtggatcccccgggctgcaggaattcgcacgagaccattacctagaacatcctaatcgaaaaacatccgtcttcctcctgtaaccagatctgaacccgcggcgacagaaacaaacgctcgctcgctcgttcgttgtccgttcatttgtcttcgccggcgccgagggaccctgagagggcaggcgggcgagatggcgggcggcggcgttgaggacgtgtacggcgaggaccgcgctaccgaggagcagctgatcacgccgtgggccttctccgtcgcaagcggctacaccctgctgcgcgacccgcggcacaacaagggcctggcnncttctcggaggcggagcgcgacgcgcacttacctccggggcctgctgcccgcgggcgctgtggcgtcgcaaggagctggcaggaagaagaagctcatgcagaacctggcgccnggtacgagcagnccgctgcaccgctacattcgccatganntggacctgcagganngcgcaacgagaggctcnttctacaagctcctcatcgacnaaacgtcgaggagctgccctccccgtcgtctacnacggccacccgtcggcgaggcnatgcccagaagtacggcagcatctacngncgcccccccaagggggctgtacatcagcctcagggacaagggcagaaaaatcctcgaggtgccgggggnnnnnnnnnnnnnnnnnnnnnnn

SEQ ID NO: 26421 - protein, 165 aa, Zea mays
  misc_feature: Ceres CLONE 1398896-F
  misc_feature: SWISSPROT Homolog: EC 1.1.1.40 Malate dehydrogenase (oxaloacetate-decarboxylating) (NADP(+))
  misc_feature (46)..(46): Xaa is any aa, unknown, or other
  misc_feature (87)..(87): Xaa is any aa, unknown, or other
  misc_feature (96)..(96): Xaa is any aa, unknown, or other
  misc_feature (97)..(97): Xaa is any aa, unknown, or other
  misc_feature (101)..(101): Xaa is any aa, unknown, or other
  misc_feature (102)..(102): Xaa is any aa, unknown, or other
  misc_feature (115)..(115): Xaa is any aa, unknown, or other
  misc_feature (126)..(126): Xaa is any aa, unknown, or other
  misc_feature (143)..(143): Xaa is any aa, unknown, or other
MAGGGVEDVYGEDRATEEQLITPWAFSVASGYTLLRDPRHNKGLAXSRRRSATRTYLRGLLPAGAVASQGAGRKKKLMQNLAPGTSXPLHRYIRHXXDLQXXATRGSFYKLLIDXTSRSCPPRRLXRPPVGEAMPRSTAASTXAPPRGLYISLRDKGRKILEVPG

SEQ ID NO: 26422 - DNA, 711 bp, Zea mays
  misc_feature: Ceres CLONE 1398897-F
  misc_feature: Encodes the peptide sequence at SEQ ID NO. 26423
  misc_feature (661)..(661): n is a, c, t, g, unknown, or other
  misc_feature (662)..(662): n is a, c, t, g, unknown, or other
  misc_feature (678)..(678): n is a, c, t, g, unknown, or other
  misc_feature (704)..(704): n is a, c, t, g, unknown, or other
aaagctggagctccccgcggtggcggccgctctagaactagtggatcccccgggctgcaggaattcgcacgagaccattacctagaacatcctaatcgaaaaagatttggatgtggactagatgcttaaggtgtgaacgtgaaagtggggtccccagatcatcacgaagggtgataatgtcagctgaagcacactacctttcatttgggaagttccttgaacttagtttttcaagccactcaaccgctagaaggctgccaatatgcgggcattcactcaatacggattgtctgcgctttttttgggttgggctccaaagttgcaatgttccagtattcctcagtcgaaatttacaatgcctgcaaaccacagcctactcttgagattcacaaccccgatatgcacaaagatgccccaaggttgctgccctcgtgtttcgtgctctgattgttgagtcttcaatgagagctgattccagttatatagaggtgaacaagcttttgattatttcttttgttaatttggtgcaacatatagaggtgaacaagcttattaaaggaagatccttgtacaatcaagagttcatacaatagatgaaacgatattgtgattctctcaatggtggcttcatgagcaagcaatcattcaccttgttcactannatttcagactgtagcntcagataggctttgagcattccttgntagtatt

SEQ ID NO: 26423 - protein, 90 aa, Zea mays; identical to SEQ ID NO: 11994
  misc_feature: Ceres CLONE 1398897-F

SEQ ID NO: 26424 - DNA, 693 bp, Zea mays
  misc_feature: Ceres CLONE 1398903-F
  misc_feature: Encodes the peptide sequence at SEQ ID NO. 26425
  misc_feature (410)..(410): n is a, c, t, g, unknown, or other
  misc_feature (428)..(428): n is a, c, t, g, unknown, or other
  misc_feature (438)..(438): n is a, c, t, g, unknown, or other
  misc_feature (442)..(442): n is a, c, t, g, unknown, or other
  misc_feature (448)..(448): n is a, c, t, g, unknown, or other
  misc_feature (684)..(684): n is a, c, t, g, unknown, or other
caaagctggagctccccgcggtggcggccgctctagaactagtggatcccccgggctgcaggaattcgcacgagaccattacctagaacatccctaatcaaaaaagcaaccacttctgctctgcatcccgtctgggcctctgcatttgcttggctgctgctcccttctcccaccgaccaactcgatcccgcgccatggatcgcgccgaccccgcgcggggccgccttgccgtgctctcctcccacctccgtggtgcaggggccgaggaggcggcggggctggagaggtcgccggtatccgcgccggcgcccgggccccgcgccggcgcgcttgccgtggtggacgggaggaccgggaagcggcacgaggtcaaggtctccgaagacggcaccgtgcgcgccaccgacttncagaagattaccactggnaaggacgacnaggntcttangatttatgatcctggttaccttaacactgcccctggtcgctcgtccatctgctacatcgatggagatgagggaatcttcgctataggggttatccaatcgaagaaatggctgaaagcagctcgttttgttgaggtggcctacccttttatgtatgggaacttgcctactcagagtcattggcagggctgggaatttgctatttctcagcattctgctgttccccagggactgttgnatatcatac

SEQ ID NO: 26425 - protein, 166 aa, Zea mays
  misc_feature: Ceres CLONE 1398903-F
  misc_feature: SWISSPROT Homolog: EC 2.3.3.1 Citrate (Si)-synthase
  misc_feature (72)..(72): Xaa is any aa, unknown, or other
  misc_feature (82)..(82): Xaa is any aa, unknown, or other
  misc_feature (83)..(83): Xaa is any aa, unknown, or other
  misc_feature (85)..(85): Xaa is any aa, unknown, or other
  misc_feature (164)..(164): Xaa is any aa, unknown, or other
MDRADPARGRLAVLSSHLRGAGAEEAAGLERSPVSAPAPGPRAGALAVVDGRTGKRHEVKVSEDGTVRATDXQKITTGKDDXXLXIYDPGYLNTAPGRSSICYIDGDEGIFAIGVIQSKKWLKAARFVEVAYPFMYGNLPTQSHWQGWEFAISQHSAVPQGLLXII

SEQ ID NO: 26426 - DNA, 702 bp, Zea mays
  misc_feature: Ceres CLONE 1398907-F
  misc_feature: Translation starting site: 230
  misc_feature (427)..(427): n is a, c, t, g, unknown, or other
  misc_feature (466)..(466): n is a, c, t, g, unknown, or other
  misc_feature (514)..(514): n is a, c, t, g, unknown, or other
aaagctggagctccccgcggtggcggccgctctagaactagtggatcccccgggctgcaggaattcgcacgagaccattacctagaacatcctaatcgaaaaactctgcaaagcgcgcgaccggacggcccggttcgttctcgacctctcgtctcgctcatccgcccgcccccgaggaagtaaccctagcctagccttgctccgaccggtcgccgcggcgactgcgacgatgatggactgcgctggaggccgagaccccgtggaggacttcctcctcggcggcgccggcgccggcgacgacggagatctcgtcgccgtcttctgcgacgacggaggacttgggattgagggtatccatggagatgcttgtggatttgagcaatctaatttggggaaaaggggtagagatgaaccatggtcatctggnccaacatcccaagcttgccgtgaaaaatgaggagggacnagctgaatgacaggttcctgggaattagtttcattatgaatccctgtnagggagcaaagttagataaagcaaattattgggtgatgcagcccggatggtggccacacttaaaggggggggaaaaaagtttagggatcaatggggaaggtggggggaatttcggggtttggagggggggaaaaaccggcttcggagaaaaaaggggacttaaggggaaaaggggtaggggggaaaaa

SEQ ID NO: 26427 - DNA, 734 bp, Zea mays
  misc_feature: Ceres CLONE 1398908-F
  misc_feature: Encodes the peptide sequence at SEQ ID NO. 26428
  misc_feature (473)..(473): n is a, c, t, g, unknown, or other
  misc_feature (475)..(475): n is a, c, t, g, unknown, or other
  misc_feature (476)..(476): n is a, c, t, g, unknown, or other
  misc_feature (531)..(531): n is a, c, t, g, unknown, or other
  misc_feature (532)..(532): n is a, c, t, g, unknown, or other
  misc_feature (541)..(541): n is a, c, t, g, unknown, or other
aaagctggagctccccgcggtggcggccgctctagaactagtggatcccccgggctgcaggaattcgcacgagaccattacctagaacatcctaatcgaaaaaaggtgttttgccctcttcttcgcgagcccccccgccgcaaccagcagccgcatcgggagacccgcagccgccgatggcgaagaagcacagggacccagcctctgaggccgcgagcggcgactccccggccgcgtccatccgctccctcttctccgcggacaacccgttccgccggaaggcctctacggaggagccccccgcgactcctgcacccgccacgacgcccctccccatgcaacccagccgtgacgccagggatgccgagccgtcctcgaagaagaaaagaagagcaaggaggagggcccgcggcgcaagcggaagcgggacgagttggaggccggccgggagcggcggcgaggcgcggagaccntnncccagagttggggaggaagaggaaggctcccgacgacgcggcacagggggcccgnnggaggacgnaggaggaggcgttcgacgacgagagcaagctgctcagggaccgtggttcgtggggaacctgccgctgcggaccaagcgcaaggtgctcatcaaggagttcgcggaattcggcgagatcgagttcgtcaggatccgcttccgtgccgctggtcgacaccaaactttcgagggcgagagccgttttaacagggga

SEQ ID NO: 26428 - protein, 186 aa, Zea mays
  misc_feature: Ceres CLONE 1398908-F
  misc_feature (100)..(100): Xaa is any aa, unknown, or other
  misc_feature (119)..(119): Xaa is any aa, unknown, or other
  misc_feature (122)..(122): Xaa is any aa, unknown, or other
MAKKHRDPASEAASGDSPAASIRSLFSADNPFRRKASTEEPPATPAPATTPLPMQPSRDARDAEPSSKKKRRARRRARGASGSGTSWRPAGSGGEARRPXPRVGEEEEGSRRRGTGGPXEDXGGGVRRREQAAQGPWFVGNLPLRTKRKVLIKEFAEFGEIEFVRIRFRAAGRHQTFEGESRFNRG

SEQ ID NO: 26429 - DNA, 695 bp, Zea mays
  misc_feature: Ceres CLONE 1398909-F
  misc_feature: Encodes the peptide sequence at SEQ ID NO. 26430
  misc_feature (449)..(449): n is a, c, t, g, unknown, or other
  misc_feature (661)..(661): n is a, c, t, g, unknown, or other
aaaagctggagctccccgcggtggcggccgctctagaactagtggatcccccgggctgcaggaattcgcacgagaccattacctagaacatcctaatcgaaaaaaaaagccttgcccttccctgctcctcctcgttctctgtgatgctgaggctaaaagctctcacctccctgctcctgctcctcctcctcgctctctgctccggtgttcatctgtgcgacgcgaggagtcggacgacgcgaggcggcagcggggcggcaccgtccgcctccgctgctgcgatcgggaggaaagggaaagcgaggagcagcggctcctcccacaggcaaagcggcgaagggagtcggagcccgaccgaaggcgaccccgtgcagggcgatggaagccaggctccagcacaggatacggtcttcagcggtggttggagttcggagccaaggggtgacggncgttacagacgacactcaggcctttgaagcagcgtgggcagcagcgtgcaaggtggaggcgtctacggttcttgtaccattgggctcgaggtttgtcgtgggcccgatctcgttctctgggccttactgtaaccgaacatcctgttccagctagatggaactattttggcccaaacagcgcaagagcgtggggctctgctggtctgctgcantggctggagttcacgagctaccgggaatcgcggc

SEQ ID NO: 26430 - protein, 74 aa, Zea mays
  misc_feature: Ceres CLONE 1398909-F
  misc_feature (24)..(24): Xaa is any aa, unknown, or other
MEARLQHRIRSSAVVGVRSQGVTXVTDDTQAFEAAWAAACKVEASTVLVPLGSRFVVGPISFSGPYCNRTSCSS

SEQ ID NO: 26431 - DNA, 718 bp, Zea mays
  misc_feature: Ceres CLONE 1398911-F
  misc_feature: Encodes the peptide sequence at SEQ ID NO. 26432
aaagctggagctccccgcggtggcggccgctctagaactagtggatcccccgggctgcaggaattcgcacgagaccattacctagaacatcctaatcgaaaaccgcacacctctgagctccctccgtccatctaatcatcatctttgtccctctcgtgcaattcgccgaacacaccgcgcgcgcctcgcctcccagcgacggtcgcctcgacggccaatgttggggccgtcatgagcgtggaggaggaggagcagcgctgggaatcaggacttgttctacgagtcgctcgacacgctatcctctcctcgccggactcctccacctctgactcggacgacgatggcgtcgactgctcgcgccaccaccgcaactgggatgcgccggacgcagcgctcctccacctgtggacctcccaggcggtgcccgtccatgagcgtgagaggcggctgctccatctcatgtagctcaccgctgatactgccctcgacagatgtgagattgcccggtatggctccggacaagacgcagtacctgcgctggtatctcacgtctcgtgattgcacattggagaccgacgggatgggctccacctggaggatgacgctagactacggtttgaagtaattacacttgtctctaaaggagcgatttgaactatgcatgaccacattctggctgataaggaacatgaagcccaattggctgtaccagttctgg

SEQ ID NO: 26432 - protein, 77 aa, Zea mays
  misc_feature: Ceres CLONE 1398911-F
MSVEEEEQRWESGLVLRVARHAILSSPDSSTSDSDDDGVDCSRHHRNWDAPDAALLHLWTSQAVPVHERERRLLHLM

SEQ ID NO: 26433 - DNA, 689 bp, Zea mays
  misc_feature: Ceres CLONE 1398913-F
  misc_feature: Translation starting site: 352
  misc_feature (561)..(561): n is a, c, t, g, unknown, or other
  misc_feature (562)..(562): n is a, c, t, g, unknown, or other
  misc_feature (574)..(574): n is a, c, t, g, unknown, or other
ccaagctggagctccccgcggtggcggccgctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggccgggacagctgactagctgagaggcatggggatggacgccggcggcggcaagctgccgtacagctacgccggccagcaggacggcgggaagctggtgaagagcgtcagccgcgtggagccgcgcaggttcggcctgggccctcgtggcgggcttcctcgtcgtcacctgcgcctacttctccaccgccaagttcgacgccatccagatcgccatgaccagccgacccgtctccgnnaatgcggctggncgtcggagtcggttcgctgggaagtgggcgccgccgccgccgacaccctccacgcctccgggcaggaattaaatttgggcgcgatggtcctggccgaagaagggtaaacgagccc

SEQ ID NO: 26434 - DNA, 686 bp, Zea mays
  misc_feature: Ceres CLONE 1398915-F
  misc_feature: Encodes the peptide sequence at SEQ ID NO. 26435
  misc_feature (454)..(454): n is a, c, t, g, unknown, or other
  misc_feature (529)..(529): n is a, c, t, g, unknown, or other
  misc_feature (656)..(656): n is a, c, t, g, unknown, or other
caaagctggagctccccgcggtggcggccgctctagaactagtggatcccccgggctgcaggaattcgcacgagaccattacctagaacatcctaatcgaaaaccctaccgtcgcggaggaagacaagacgcgcgcgcagaagcacacctgctcgggctacattaggaggacagcttcttcggccggcgacatggcggagaagggcgcgttgcagtcggcgagggagtgggtggtcgaccacaagctccgggccgtcgggacgctgtggctcagcggcatcgtcggctccatcgcctacaactggtccaggccgggcatgaagaccagcgtcaagatcatccacgccaggctgcatgctcaggctctcacgctggctgccttggctgggtccgcgctggtggagtactacgaccaccagcaagggtcagggatcgaaagttcaccaatatgcanagcagttcctttcatctgatagcaatagcggccaacaaaaggagtagctagccagtgtcccttgcgaaggcaagnagcgggagtgggcgttatttcctgatcaaataattttgctatggcacattctgtgaaacttttgacggatctttgcctgcttttctatgcgatgaagctgctgaaactgcctcatcaaatggtgggnatgcagagggaccatgcatttggttccctg

SEQ ID NO: 26435 - protein, 93 aa, Zea mays
  misc_feature: Ceres CLONE 1398915-F
  misc_feature (3)..(70): Pfam Name: HIG_1_N Pfam Description: Hypoxia induced protein conserved region
  misc_feature (88)..(88): Xaa is any aa, unknown, or other
MAEKGALQSAREWVVDHKLRAVGTLWLSGIVGSIAYNWSRPGMKTSVKIIHARLHAQALTLAALAGSALVEYYDHQQGSGIESSPICXAVPFI

SEQ ID NO: 26436 - DNA, 717 bp, Zea mays
  misc_feature: Ceres CLONE 1398919-F
  misc_feature: Pfam Name: GlutR_N Pfam Description: Glutamyl-tRNAGlu reductase, N-terminal domain
  misc_feature: SWISSPROT Homolog: EC 1.2.1.70 Glutamyl-tRNA reductase
  misc_feature (414)..(414): n is a, c, t, g, unknown, or other
  misc_feature (415)..(415): n is a, c, t, g, unknown, or other
  misc_feature (476)..(476): n is a, c, t, g, unknown, or other
  misc_feature (487)..(487): n is a, c, t, g, unknown, or other
  misc_feature (493)..(493): n is a, c, t, g, unknown, or other
  misc_feature (497)..(497): n is a, c, t, g, unknown, or other
  misc_feature (510)..(510): n is a, c, t, g, unknown, or other
  misc_feature (529)..(529): n is a, c, t, g, unknown, or other
  misc_feature (530)..(530): n is a, c, t, g, unknown, or other
  misc_feature (560)..(560): n is a, c, t, g, unknown, or other
  misc_feature (561)..(561): n is a, c, t, g, unknown, or other
  misc_feature (581)..(581): n is a, c, t, g, unknown, or other
cagagctggagctccccgcggtggcggccgctctagaactagtggatcccccgggctgcaggaattcgcacgagaccattacctagaacatcctaatcgaaaaattttgccaatgcgacggtgaaatcccgcacctacctccttcctctctcaccgaggaccctcgcaccaagaactgagcgggaagagaggtagagaggcaagcgcacgagagtttctgctcctagtctcgtctcgccccgcctccgtctcctttccctctctggttctctctctgcgattctcgtcgcattggttccgttccctcacgaaaggcggtagctttctgtcttccctgatctatctagataatggcgaccacgacgtcagcgaccaccgccgcagcagcagccgccaccaccgccaagccgcggnnggtcgtcgtcggccctctgcccagaagggtgggccggcggcggcaggcggcgctccggggntgggtggcggngcgacncccnccgggggggaggnccaggcgcaggccggggcnnaggcggccagcgccgccgccctcgagcagnncaagatatccgccgaccggnacatgaaggaaggagtaccatagctgtgataggcctcagtgtacacacagcaccagtggagatgcgggaaaaacttgctgttgcaaaggacctggggccccgtgctattcagagtcgcctagcctgaacatattgt

SEQ ID NO: 26437 - DNA, 707 bp, Zea mays
  misc_feature: Ceres CLONE 1398922-F
aagctggagctccccgcggtggcggccgctctagaactagtggatcccccgggctgcaggaattcgcacgagaccattacctagaacatcctaatcaaaaaacgtgctactctccggatctcgcacgacttttttcttccctggctgcgacaagaccacgaatggacgtaaaccgatgacgccctacgccagctcttagtcggccccttcgacgagcatgcacgagattcccccgggaatggtgaatgcatcgtgcaatgacagcgcacaaagatggtctcaaacgagatcagcaccctcgacgtactatgtgagcttgatggcaacgatgaaagtagagacgcccagggtaacggaccagatgggattgaaatggagacttagcgatactatctccaaccaaaaggcatccatattgctagtggatatcaatcccacgagatctggagtgagcctgaatcttaaagaggggtgagtaggaagatctggacctcgagaatgatgacgtagaggctggaaacgatcagcatattacatggtttcattcagtccgacatcagtggtgcagatgcgcacagtgtgattagttctcgagggcaagatgcacactggggacgacaatgaacatgaaatatttactgagctttccgcatctctattgaacgaagcccttcaggagcagctaagagagccctgtgagaaatcaa

SEQ ID NO: 26438 - DNA, 728 bp, Zea mays
  misc_feature: Ceres CLONE 1398924-F
  misc_feature: Encodes the peptide sequence at SEQ ID NO. 26439
  misc_feature (265)..(265): n is a, c, t, g, unknown, or other
  misc_feature (266)..(266): n is a, c, t, g, unknown, or other
  misc_feature (357)..(357): n is a, c, t, g, unknown, or other
  misc_feature (475)..(475): n is a, c, t, g, unknown, or other
  misc_feature (477)..(477): n is a, c, t, g, unknown, or other
  misc_feature (483)..(483): n is a, c, t, g, unknown, or other
  misc_feature (492)..(492): n is a, c, t, g, unknown, or other
  misc_feature (493)..(493): n is a, c, t, g, unknown, or other
  misc_feature (532)..(532): n is a, c, t, g, unknown, or other
  misc_feature (537)..(537): n is a, c, t, g, unknown, or other
  misc_feature (558)..(558): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (590)..(590): n is a, c, t, g, unknown, or other
  misc_feature (591)..(591): n is a, c, t, g, unknown, or other
  misc_feature (594)..(594): n is a, c, t, g, unknown, or other
  misc_feature (595)..(595): n is a, c, t, g, unknown, or other
  misc_feature (603)..(603): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
aagagctggagctccccgcggtggcggccgctctagaactagtggatcccccgggctgcaggaattcgcacgagaccattacctagaacatcctaatcgaaaaaaagcaaagccaacgggatctccctctcattccagaggactccgcgtcgtcaggcccgcttcgcgtgcgacgccggcatatagggtttcgccggcgccggcgatggacccaccccccgtgagccccgatcgctgggggcccagtcagggcgctggcgtcggnncctccggcctccgccgatatggcctcaatttctccgcctccagcctcctccaggcccccatcgcggcccctccttgagtactccggcgtantccagtccggccctgccctgggggggcacacccgtccgcgggggcctcctccccgtggcgggggtcggagggcgatgggctttcctcccctcccgccctgggggaggggagggttcgngngggttnggggggggnngggggccgggggcccccggcccccccagaagggggggcntgggnggggttcccccggagggaagnggggcttgtagaagnnntcggtcctaatatgnnggnngggggggnggggggcccccccggnnnggaggaggttcccgaggaatcccccctcctccccccccccccaaaaaccccnnnnnttctcccccccaccgccacccaccaagaannnnnnnnntttttcccctcac

SEQ ID NO: 26439 - protein, 45 aa, Zea mays
  misc_feature: Ceres CLONE 1398924-F
  misc_feature (21)..(21): Xaa is any aa, unknown, or other
MDPPPVSPDRWGPSQGAGVGXSGLRRYGLNFSASSLLQAPIAAPP

SEQ ID NO: 26440 - DNA, 737 bp, Zea mays
  misc_feature: Ceres CLONE 1398926-F
  misc_feature (380)..(380): n is a, c, t, g, unknown, or other
  misc_feature (381)..(381): n is a, c, t, g, unknown, or other
  misc_feature (401)..(401): n is a, c, t, g, unknown, or other
  misc_feature (402)..(402): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (426)..(426): n is a, c, t, g, unknown, or other
  misc_feature (429)..(429): n is a, c, t, g, unknown, or other
  misc_feature (430)..(430): n is a, c, t, g, unknown, or other
  misc_feature (437)..(437): n is a, c, t, g, unknown, or other
  misc_feature (438)..(438): n is a, c, t, g, unknown, or other
  misc_feature (477)..(477): n is a, c, t, g, unknown, or other
  misc_feature (479)..(479): n is a, c, t, g, unknown, or other
  misc_feature (481)..(481): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (500)..(500): n is a, c, t, g, unknown, or other
  misc_feature (517)..(517): n is a, c, t, g, unknown, or other
  misc_feature (518)..(518): n is a, c, t, g, unknown, or other
caaagctggagcttccccgcggtggcggccgctctagaactaagtggatcccccgggctgcaggaattcgcacgagaccatttacctagaacatcctaatcgaaaagaaaaagagcgtatttcttcttcctcaccctcctcgaggaagagagagggcagctccggagccgcacgggcgcgagcgaggcaggcagtggctcctcccccctcctttcgatatcagctcatcgattcgtcctatcacacacatatcattaccgctcctcttcctcacctatgcttgtcctctaactcattggcagaagagaaaaaaaaagtccttgttgagttgttgtatcgggttctggtggtgactgttactggggtttccttgccccggnntctgattttgcgcaggacanngattgcgtcctctcggggtnnncnccnnccccggnngggcgggggctgatcctccttccctggtcccttcccctnangnttgggatcggatnnnnggnatggaagtggacaaaanngaagaatttgcagattgggatccagggggaagggaggttcagaagcagaatcccaagcggggaggaacccctggcaccgccggagggggaactgggatgaaccaaaaccttctggaaagggggaactgggtttggtggtgggaaaaatgggggcttccgagggaagcccttggggccccggggtttccaaaaattcgggggggtggggggggcaaaaaa

SEQ ID NO: 26441 - DNA, 714 bp, Zea mays
  misc_feature: Ceres CLONE 1398927-F
  misc_feature: Encodes the peptide sequence at SEQ ID NO. 26442
  misc_feature (1)..(1): n is a, c, t, g, unknown, or other
  misc_feature (668)..(668): n is a, c, t, g, unknown, or other
  misc_feature (686)..(686): n is a, c, t, g, unknown, or other
nagagctggagctccccgcggtggcggccgctctagaactagtggatcccccgggctgcaggaattcgcacgagaccattacctagaacatcctaatcgaaaaagcctgcgctccccttctttcccgttcggctcacagcgaagaaggaagccggttagggtttccacctcctttcccctcctctccttcagcgacgaccgcgggccacaccctcgatatccttcccctcggacccggaggcgagcagcagcctccagcgcctgccacgcctgcccgtctcgttattgggaggattcgccatgtctgacatggagtccgtcacagctcttatgaactcgacaagctccaagatacagcagcttcaggaggcatttgctgagcttgagagccagagcacggtttccatgaacctcaagtggaagcagcttgaagaccactttcgtggtcttgaacagtccctcaagaaaaagtttgacgagctaaaagagcaggagaaggagttccaggagactgtcgcaaaatcagagcagattctggagcagcgggaggcagctgttgtggcaaaggaactgacctcttttggagaaagtgcaggagaagagggaagctgcattagctatgatctttagcaagtccaggcttttccttacctgttcctaccatcaancccatggaacaagcgctngaataaatcttggtggtcagtggccaaa

SEQ ID NO: 26442 - protein, 109 aa, Zea mays
  misc_feature: Ceres CLONE 1398927-F
  misc_feature: SWISSPROT Homolog: EC 5.99.1.3 DNA topoisomerase (ATP-hydrolyzing)
MSDMESVTALMNSTSSKIQQLQEAFAELESQSTVSMNLKWKQLEDHFRGLEQSLKKKFDELKEQEKEFQETVAKSEQILEQREAAVVAKELTSFGESAGEEGSCISYDL

SEQ ID NO: 26443 - DNA, 695 bp, Zea mays
  misc_feature: Ceres CLONE 1398928-F
  misc_feature (1)..(1): n is a, c, t, g, unknown, or other
  misc_feature (509)..(509): n is a, c, t, g, unknown, or other
  misc_feature (605)..(605): n is a, c, t, g, unknown, or other
  misc_feature (606)..(606): n is a, c, t, g, unknown, or other
  misc_feature (613)..(613): n is a, c, t, g, unknown, or other
  misc_feature (630)..(630): n is a, c, t, g, unknown, or other
  misc_feature (659)..(659): n is a, c, t, g, unknown, or other
  misc_feature (663)..(663): n is a, c, t, g, unknown, or other
  misc_feature (664)..(664): n is a, c, t, g, unknown, or other
  misc_feature (672)..(672): n is a, c, t, g, unknown, or other
naaagctggagctcaccgcggtggcggccgctctaaaactagtggatcccccgggctgcaggaattcgcacgagaccatttaccttgaacatcctaatcgaaaaataaaaaaaactgagcctgcccgcccgcccgcccgcgcgctccgctccgtgaacaatatctatctatcaccttgctgctccaaggaggcggacagaggcaggcaggaaggcacttcacttctccaggagcttcggagtcggcagcaagaaaaaatggccgccgacgccgccgccgccgccaccccttcgtacttgctctctcccaaggtctggtgctgtggcatgtttagtgcaatcttcattgcttgctgtcttgctgcatttaacacagcacgagcttcagagaatagtccaagcctatctgtgttgccaagagatctcatccaaagtttacggcaatgaaccattttctaagcacaaagacgtgatgtctttatcaattcatcaggagagcaaatggcgtcnacaggaggtcaccgacgaagcggttcgtcaactaccccgagagggttcatcgacgtgtacaagctctggcgcccgacgcccctgatcagggccagnnaggctgnagaagctgctcggacgnccggcgagatctactacaagtacgagganccannccccgggngggtcgacagcccaaacgggccc

SEQ ID NO: 26444 - DNA, 721 bp, Zea mays
  misc_feature: Ceres CLONE 1398934-F
  misc_feature: Encodes the peptide sequence at SEQ ID NO. 26445
  misc_feature (520)..(520): n is a, c, t, g, unknown, or other
  misc_feature (521)..(521): n is a, c, t, g, unknown, or other
  misc_feature (543)..(543): n is a, c, t, g, unknown, or other
  misc_feature (683)..(683): n is a, c, t, g, unknown, or other
cagagctggagctccccgcggtggcggccgctctagaactagtggatcccccgggctgcaggaattcgcacgagaccattacctagaacatcctaatcaaaaagcacaagccaaacgtgcagctgaggaatcgcaacggcagtgacgtgtgcgcgttgccaaataaagctactatactagtcaccgctcgattgccgtcgcagccgcccgccggccggagatgggtgcgccggcgctgtcgtccgtcgtcgtggtggccacggcggcagtggtttgcctgtgcggggcctttgcgcaggcgcaggacatggacagcgagtgggcgcggccggcctaccgcgggttcttcggcgccccggccgggtcgctgctgccgcagtcggacgtggacctgctggagttcccgctgaacctggagtacctgggagacggagttcttctgctgggtccgctctggggtacggcctcgacgccatcgacgccacctcaacccggcggcgggccgccctccatcggcggnncagtccgcgtccctcacccgtncaattccgcgacgtggcaaccccagttctgtttaccaaagaagtcgggcaccctcagggcgatcaagcaagacgggtgaggggctttcccgagggccgttggctggacatcagcgcgggccactttcggcaagatcatcngagcaagcgctgaaacgcgacgcttggaccccgccctt

SEQ ID NO: 26445 - protein, 133 aa, Zea mays
  misc_feature: Ceres CLONE 1398934-F
  misc_feature (101)..(101): Xaa is any aa, unknown, or other
  misc_feature (108)..(108): Xaa is any aa, unknown, or other
MGAPALSSVVVVATAAVVCLCGAFAQAQDMDSEWARPAYRGFFGAPAGSLLPQSDVDLLEFPLNLEYLGDGVLLLGPLWGTASTPSTPPQPGGGPPSIGGXVRVPHPXNSATWQPQFCLPKKSGTLRAIKQDG

SEQ ID NO: 26446 - DNA, 725 bp, Zea mays
  misc_feature: Ceres CLONE 1398936-F
  misc_feature: Encodes the peptide sequence at SEQ ID NO. 26447
  misc_feature (312)..(312): n is a, c, t, g, unknown, or other
  misc_feature (344)..(344): n is a, c, t, g, unknown, or other
  misc_feature (355)..(355): n is a, c, t, g, unknown, or other
  misc_feature (359)..(359): n is a, c, t, g, unknown, or other
  misc_feature (364)..(364): n is a, c, t, g, unknown, or other
  misc_feature (375)..(375): n is a, c, t, g, unknown, or other
  misc_feature (424)..(424): n is a, c, t, g, unknown, or other
  misc_feature (461)..(461): n is a, c, t, g, unknown, or other
aaagctggagctccccgcggtggcggccgctctagaactagtggatcccccgggctgcaggaattcgcacgagaccattacctagaacatcctaatcgaaaaatcatttcctctcgagtagtcgatcggagtcaggagatgggcgcgtctggtggtgaaaagcttggtactcttgtgtgtgttcttgcacatgtatcgttattattggtgctcgtgctagcaccgtgtgtgtgcaaggcgactggtggtgactacggcggcctctccaacgaccactacaccgagtcctgcccggagctggagaccatcgtncagaagtccctggcgccgatctttcgccgtgnacatcactcgncggncgccntccctcgctgntcttcacgactggcagttccacggatggtgacgctccatattgctcacnctcgacgagcggcgggacataccctcgggaactgggntcagcagaaacctcgggatcgggacgtcggcacccgtcggcttccggaagggggccggggaaccgcctggccctgccgggttttctgggccaaaattttttttttgggggaaaaggaagccctggggaaaccccgggggcccgggggtccccgggggtcttttttggcggaaaggggccccggaataaaaaagcgggggggcggaggggggaatttccccggggttttcccggggaaaggggggggggttaatttttttaacgc

SEQ ID NO: 26447 - protein, 195 aa, Zea mays
  misc_feature: Ceres CLONE 1398936-F
  misc_feature (69)..(69): Xaa is any aa, unknown, or other
  misc_feature (73)..(73): Xaa is any aa, unknown, or other
  misc_feature (74)..(74): Xaa is any aa, unknown, or other
  misc_feature (76)..(76): Xaa is any aa, unknown, or other
  misc_feature (79)..(79): Xaa is any aa, unknown, or other
  misc_feature (96)..(96): Xaa is any aa, unknown, or other
  misc_feature (108)..(108): Xaa is any aa, unknown, or other
MGASGGEKLGTLVCVLAHVSLLLVLVLAPCVCKATGGDYGGLSNDHYTESCPELETIVQKSLAPIFRRXHHSXXAXPRXSSRLAVPRMVTLHIAHXRRAAGHTLGNWXQQKPRDRDVGTRRLPEGGRGTAWPCRVFWAKIFFLGEKEALGKPRGPGGPRGSFLAERGPGIKKRGGGGGNFPGVFPGKGGGVNFFN

SEQ ID NO: 26448 - DNA, 696 bp, Zea mays
  misc_feature: Ceres CLONE 1398937-F
  misc_feature: Encodes the peptide sequence at SEQ ID NO. 26449
  misc_feature (344)..(344): n is a, c, t, g, unknown, or other
  misc_feature (392)..(392): n is a, c, t, g, unknown, or other
  misc_feature (586)..(586): n is a, c, t, g, unknown, or other
  misc_feature (606)..(606): n is a, c, t, g, unknown, or other
caaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaaccggcgggtgtcgacggcctcccgccggggcctccngggttggcgggtggtggggaacctgttccaggtgatcctgcagcgacnggccttcatgtacgtggtgcgcgactcccgggagaagtacgggcccatcttcaccatggcggatggggcagcgcaccctcatcgtggtcaccctcggcggagctcatccacgaggcgctgggttgaagcagggcccccatgttcgcgagcccggcccgaggacagcccccaccgcctccttcttcagcgtcggnaagtggaccgtcaactcggngccctagggcccccctggggggggtctgggcgaaactttgttggccaaaatcgggtcccgcacccggtaaggcttccccgtgatccggga

SEQ ID NO: 26449 - protein, 155 aa, Zea mays
  misc_feature: Ceres CLONE 1398937-F
  misc_feature (38)..(38): Xaa is any aa, unknown, or other
  misc_feature (54)..(54): Xaa is any aa, unknown, or other
  misc_feature (119)..(119): Xaa is any aa, unknown, or other
MDVNDVLLVVLAAALAAMWWRRCSKNRRVSTASRRGLXGWRVVGNLFQVILQRXAFMYVVRDSREKYGPIFTMADGAAHPHRGHPRRSSSTRRWVEAGPPCSRARPEDSPHRLLLQRRXVDRQLGALGPPWGGSGRNFVGQNRVPHPVRLPRDPG

SEQ ID NO: 26450 - DNA, 705 bp, Zea mays
  misc_feature: Ceres CLONE 1398942-F
  misc_feature: Encodes the peptide sequence at SEQ ID NO. 26451
  misc_feature (1)..(1): n is a, c, t, g, unknown, or other
  misc_feature (399)..(399): n is a, c, t, g, unknown, or other
  misc_feature (404)..(404): n is a, c, t, g, unknown, or other
  misc_feature (405)..(405): n is a, c, t, g, unknown, or other
naaagctggagctccccgcggtggcggccgctctagaactagtggatcccccgggctgcaggaattcgcacgagaccattacctagaacatcctaatcgaaaattctcttgatcgctttgtcacttgaatccgtgcctgctctaacagagagcggatcagcggagacacgacgacgacgacgaagccaggctcaggctctgcaatggagcaggagccgcaccggcccatggagctgcccccgggcttccgcttccacccgaccgacgaggagctcatcacgcactacctggcccgcaaggccgccgacgcccgcttcgccgcgctcgccgtcgccgaggccgacctcaacaagtgcgagccctgggactgcatcgtggggccgaggatgggggaaaaanggagnngtacttcttctgcctcaaggacgcaagtacccgacggggctgaggaccaaccgggccacgaaggccggtactggaaggccacggccagggaagggacgtcttcggggcaaggggttcgcggttccaaaaaaagctcgcctcaaacggggagggccccaagggcgagaaaccggaagggtcaggccaaaccccccccccgccagttcttggccaggcccaggcagggggaaccctttttttttccccaggaaggccggggccaaaaaaggggggggtgtgcggggttaaaaaaacctcccc

SEQ ID NO: 26451 - protein, 167 aa, Zea mays
  misc_feature: Ceres CLONE 1398942-F
  misc_feature (11)..(120): Pfam Name: NAM Pfam Description: No apical meristem (NAM) protein
  misc_feature (66)..(66): Xaa is any aa, unknown, or other
  misc_feature (67)..(67): Xaa is any aa, unknown, or other
  misc_feature (68)..(68): Xaa is any aa, unknown, or other
MEQEPHRPMELPPGFRFHPTDEELITHYLARKAADARFAALAVAEADLNKCEPWDCIVGPRMGEKXXXTSSASRTQVPDGAEDQPGHEGRYWKATAREGTSSGQGVRGSKKSSPQTGRAPRARNRKGQAKPPPRQFLARPRQGEPFFFPQEGRGQKRGGCAGLKKPP

SEQ ID NO: 26452 - DNA, 713 bp, Zea mays
  misc_feature: Ceres CLONE 1398943-F
  misc_feature: Translation starting site: 182
  misc_feature (585)..(585): n is a, c, t, g, unknown, or other
  misc_feature (655)..(655): n is a, c, t, g, unknown, or other
  misc_feature (684)..(684): n is a, c, t, g, unknown, or other
aaaagctggagctccccgcggtggcggccgctctagaactagtggatcccccgggctgcaggaattcgcacgagaccattacctagaacatcctaatcgaaaaacggatcaaaatcgaatccaacgctactgcctagggtttcctctgcatttcccctaccacaccccgcgccgcccacccatggccgccgcagacgcgtccgccgagaccgccgccatcgcgcggcgcctggcctcctgcaacaccggcacccgggagcgcgcgctccgctacctcctctccgaatttctgccggcctccgcgccgcgcctctccgccaccgacctcctcaaagctctggaagggcatcttcttctgcttctggcacgccgacaagccgctctaccagagctccgtcgcctcgcctccgccgtctcccgtcccgcgtccccccgcccgatggtgccgccttcctcgccgcctacctcaccacgcttccgccgcgagtggccccaacatcgacgtccacctgcctcgacaagttctacctcctcaaaccgccggttcctccaccacgccttcctgcttctccatgctaactcctnccgcccccgacgtcacctcccagggtcgtgtcccgtcctgtcagacaaggccctggctcccggaagccgnacacgtcgccgctgcccacctcccggggncctcgggtaccacgttcgccgaggcgttc

SEQ ID NO: 26453 - DNA, 605 bp, Zea mays
  misc_feature: Ceres CLONE 1398947-F
  misc_feature (322)..(322): n is a, c, t, g, unknown, or other
  misc_feature (323)..(323): n is a, c, t, g, unknown, or other
aagctggagctccccgcggtggcggccgctctagaactagtggatcccccgggctgcaggaattcgcacgagaccattacctagaacatcctaatcgaaaagtttcctctctccaattcccacccgcgtcaaggagcttctcgtctgagcccgagctaacaagctcaccggcgggcaggatgctggcggcgtccaccaagtcggctctaggctggcctctcgcacgcctcttttgtcgcgtgctgcagcggcgcgctgcgagctccccgtgctggctctggatgctccccagcgcgggttcgcagacgggagtcacacgcgnngacgcgccgcgccgctgcttgcagtcctcggcgattcagggaatatatcagtggagagactgtgatcaaagcagccaccgtaaatggagcaagggctgcttgatgggcccccatgtttttggggggggtttttcctcggaaaccacaatacaaaggaaattttccttcttccctcaggggaaaaatggcccgggagaaagttttaactgacctgccggggtttgaaaaatttgggaaacaggcccccaaagggctcaaaaagggaaaagatctgggcccccc

SEQ ID NO: 26454 - DNA, 686 bp, Zea mays
  misc_feature: Ceres CLONE 1398948-F
  misc_feature: Encodes the peptide sequence at SEQ ID NO. 26455
  misc_feature (517)..(517): n is a, c, t, g, unknown, or other
  misc_feature (560)..(560): n is a, c, t, g, unknown, or other
tggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgccccgggagatggcagcggaggttgccgccgctgcggcgctcggtgccgacgtggcgnagctccaggtcggctgcctcgacagcttcgagccatgcagggnacctgcccgtgcttctcgcccagccccgctcgctccccgtcatcgtcactacaggccggaattggggagggaggccagtacgcaagcgaagatggagccacggtttgaggcgcttctactgccaat

SEQ ID NO: 26455 - protein, 100 aa, Zea mays
  misc_feature: Ceres CLONE 1398948-F
  misc_feature (45)..(45): Xaa is any aa, unknown, or other
  misc_feature (59)..(59): Xaa is any aa, unknown, or other
MATAASSTPAARQPTLVCASLTARVPREMAAEVAAAAALGADVAXLQVGCLDSFEPCRXPARASRPAPLAPRHRHYRPELGREASTQAKMEPRFEALLLP

SEQ ID NO: 26456 - DNA, 704 bp, Zea mays
  misc_feature: Ceres CLONE 1398954-F
  misc_feature: Encodes the peptide sequence at SEQ ID NO. 26457
  misc_feature (364)..(364): n is a, c, t, g, unknown, or other
  misc_feature (425)..(425): n is a, c, t, g, unknown, or other
  misc_feature (476)..(476): n is a, c, t, g, unknown, or other
  misc_feature (477)..(477): n is a, c, t, g, unknown, or other
  misc_feature (520)..(520): n is a, c, t, g, unknown, or other
  misc_feature (546)..(546): n is a, c, t, g, unknown, or other
tggagctccccgcggtggcggccgctctagaactagtggatcccccgggctgcaggaattcgcacgagaccattacctagaacatcctaatcgaaaataccgcctgatccaccgcggtttgcttgccgcgagcatggaaattattagtcattcgacaagtcagagagattttatttcctctcgtcgtctcgtggccgctggtgcccgcgcgtcagatttggcctgctccgctccgcctccgcagtgtgaatttctgagagataggtttctgtgctgcagacagcccggcggcgacgcggtggcagtttgcggcgaggtccggcgtcgcgccggcgttcatgtcgttcaggacggaggcgacggncgagggctctgaggcgttctcggtctccgagctccggccggccggagacgccttcgacggncatcagaagcagagctccatgctttcgatctaccagcagagggcagttggnncacacagcagccaggccacggcacagcagcagtaccctgcagncgcgcacagcagcgctcgcaggtggncggattacggcgcggcggcacgcatctctcctggggggggggggggggggggaatgcagttaagggaacccggtggcggtggcccaaccctggggcgtttcatcagcccccctgggaggtcagggccttcgggggccaaaaagtttcccaacgggaga

SEQ ID NO: 26457 - protein, 122 aa, Zea mays
  misc_feature: Ceres CLONE 1398954-F
  misc_feature (9)..(9): Xaa is any aa, unknown, or other
  misc_feature (47)..(47): Xaa is any aa, unknown, or other
  misc_feature (61)..(61): Xaa is any aa, unknown, or other
  misc_feature (70)..(70): Xaa is any aa, unknown, or other
MSFRTEATXEGSEAFSVSELRPAGDAFDGHQKQSSMLSIYQQRAVGXHSSQATAQQQYPAXAHSSARRWXDYGAAARISPGGGGGGGMQLREPGGGGPTLGRFISPPGRSGPSGAKKFPNGR

SEQ ID NO: 26458 - DNA, 692 bp, Zea mays
  misc_feature: Ceres CLONE 1398955-F
  misc_feature: Encodes the peptide sequence at SEQ ID NO. 26459
  misc_feature (460)..(460): n is a, c, t, g, unknown, or other
aaagctggagctcaccgcggtggcggccgctctagaactagtggatcccccgggctgcaggaattcgcacgagaccattacctagaacatccatcgaaaactaactacttccctgtacgtggacgaggaccaaggagacagagagaaagcctggccgcgccgcccaccgtcgcctcgtcagtcgcctcctccatcctccctccccatcgacttcccaaatcccagccagatctcctcgtcctctggcccattctcttcatctccatgcatggatgaacaagagacggagggagacagatgcaaacatcgagactggggttgttatctgtctttgtagcagaagaaacagtcctaaaaaagaatggagagctcctcagataggagcaacgtttctcaggggaaccacctggggtatgcgagaagcacatccatggattccactggtccctcagtagctggntagtctagctcaatggtgagtaggagaagtagcagacagggctcaaggggatccatcagcctctccagggagatgggggactccatactgagctcaatgaggcattctcttcaggtcgcggatcatttgctaggagacatcgatagctcagttctggctcaactcatcgaaaggggtcgagtctatcacccaaggcgattgtgatgaggtaccgaaagattctctgaacatt

SEQ ID NO: 26459 - protein, 63 aa, Zea mays
  misc_feature: Ceres CLONE 1398955-F
MVSRRSSRQGSRGSISLSREMGDSILSSMRHSLQVADHLLGDIDSSVLAQLIERGRVYHPRRL

SEQ ID NO: 26460 - DNA, 711 bp, Zea mays
  misc_feature: Ceres CLONE 1398956-F
  misc_feature: Encodes the peptide sequence at SEQ ID NO. 26461
atagctggagctccccgcggtggcggtcgctcatacataataggatcccccgggctgcaggattccgcacgagaccattacctagaacatcctaatcgaaaactgggaggcagagacgaaagcctactagcttccctttgggtcggtctcgcgctcccgctgcgcgtctgtctgtctgtctgtcttggagcctcatcaatggctaccatcagagaggagtccgactacgacagcagccggtcctcgctgacggcgccgggcggctcccgccggagctggatcagcgacattggcagcgccagctcggtctcggcgcgctccgtggcggggcgaggctgggacgcgccggcgtgccgccaccgccacaagcctcacaaggcgaaccaggccgagtgggaggccatcgggcgcgtccgcgccgccgcgggccgcgtcgggctggagcacttccgcctggtgcggcgcctgggcagcggtgacctcgggaacgtctacatctgccagctgcgcgaggcctggaccaccacgcggcgcctgtaccccatgaaggtggtgcaataggactcgctggcgttccgcatgaagctgcggcgcgcggagggggagcaggaaatcctccgtgggttcgaccaccccttcctcccccattgtacgccgaagtcgaggagtgggactaagcctggcctctcctggaagtattgccccggccgg

SEQ ID NO: 26461 - protein, 120 aa, Zea mays
  misc_feature: Ceres CLONE 1398956-F
  misc_feature: SWISSPROT Homolog: EC 2.7.11.1 Non-specific serine/threonine protein kinase
MATIREESDYDSSRSSLTAPGGSRRSWISDIGSASSVSARSVAGRGWDAPACRHRHKPHKANQAEWEAIGRVRAAAGRVGLEHFRLVRRLGSGDLGNVYICQLREAWTTTRRLYPMKVVQ

SEQ ID NO: 26462 - DNA, 709 bp, Zea mays
  misc_feature: Ceres CLONE 1398957-F
  misc_feature: Translation starting site: 222
  misc_feature (301)..(301): n is a, c, t, g, unknown, or other
  misc_feature (311)..(311): n is a, c, t, g, unknown, or other
  misc_feature (336)..(336): n is a, c, t, g, unknown, or other
  misc_feature (342)..(342): n is a, c, t, g, unknown, or other
  misc_feature (354)..(354): n is a, c, t, g, unknown, or other
  misc_feature (436)..(436): n is a, c, t, g, unknown, or other
  misc_feature (472)..(472): n is a, c, t, g, unknown, or other
  misc_feature (497)..(497): n is a, c, t, g, unknown, or other
  misc_feature (564)..(564): n is a, c, t, g, unknown, or other
  misc_feature (630)..(630): n is a, c, t, g, unknown, or other
  misc_feature (671)..(671): n is a, c, t, g, unknown, or other
ggagctccccgcggtggcggccgctctagaactagtggatcccccgggctgcaggaattcgcacgagaccattacctagaacatcctaatcgaaaactcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccgntgtcgacggnctcccgcccgggcctccggggtggncggtgntggggaacctgntcccagtgatcctgcagcgactgcccttcatgtacgtggtgcgcgacctccgggagaagtacgggcccatcttcaccatgcnggatggggcagcgcaccctcatcgtggtcacctcgncggagctcatcaacgaggcgctggntgaagcaaggccccatggtcgcgagccgggccgaggacagccccaccccgctctcttcagggtcggnaagtgcaccgtcaactcggcgcctacggccccccttggggggtgcttctgcgcacaacttcgtggncggagatcgtgtccccgcaccgcgtcaaggctctctggganccccggggagggggcccggggacgcccacttgccccgc

SEQ ID NO: 26463 - DNA, 705 bp, Zea mays
  misc_feature: Ceres CLONE 1398958-F
  misc_feature: Encodes the peptide sequence at SEQ ID NO. 26464
  misc_feature (498)..(498): n is a, c, t, g, unknown, or other
  misc_feature (516)..(516): n is a, c, t, g, unknown, or other
  misc_feature (525)..(525): n is a, c, t, g, unknown, or other
aaagctggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaaccctcagtacgtgcgcctcgggtaccactacctcatcagccacggcgtgtacctggccaccatcccccgtcatcgtgctggtgtgcggcgccgagctgggcagcctcagccgcgacgagctgtggcgcaaggtgtggggggaggccacctacgnactcgccaccgtgctcgncttcctcgncggtctcgccttcaccatctccgtctacatcatgtccaggcccagccccgtgtacctcatcgacttcgcatgctacaagccggccgacgagctcaaggtgtccaaggcggagttcatcgacctggcgcgcaagtccgcaaagttccacgagacagcctggcgttccagtcgcgtcggctg

SEQ ID NO: 26464 - protein, 49 aa, Zea mays
  misc_feature: Ceres CLONE 1398958-F
  misc_feature: SWISSPROT Homolog: EC 2.3.1.119 Icosanoyl-CoA synthase
MSRPSPVYLIDFACYKPADELKVSKAEFIDLARKSAKFHETAWRSSRVG

SEQ ID NO: 26465 - DNA, 707 bp, Zea mays
  misc_feature: Ceres CLONE 1398961-F
  misc_feature: Encodes the peptide sequence at SEQ ID NO. 26466
  misc_feature (405)..(405): n is a, c, t, g, unknown, or other
  misc_feature (622)..(622): n is a, c, t, g, unknown, or other
tggagctccccgcggtggcggccgctctagaactagtggatcccccgggctgcaggaattcgcacgagaccattacctagaacatcctaatcgaaaaaatgaccattgcgtgatagatcgcaccggtctcggtctccgtgtctcactctcaagttgcagcagccagtcatttcgttggcaaccagggcagaaataaatatccgtggataagagctgcgctgtgtgctgctgagatatcaagaacggtagggtggaagacaaggccccgttctcgattacccaagccaaagagtcagagggagagagagagagagagtcgtattggtcgtcacctgtcgaaggttttcggtgtctcctgagccacagctgctgctgctgctggaaccatggagatggaggccgtgnagtcgcacggcggcgccggtcgccggacgcccaagagggatcgcggcatctcctggggctgcgtcttcatcctggcgagtaactgcttccagttcatcgcctacttcgccgtgtcgacgaacctggtgaactacctcaaggaccgcctggcacagggcagcaaagccgcggcgaacgggtcccccaaatgggatgggcacgagcgccatcaacgcgnttcgtcggcgtcttcctcggcgacgtcttccttcggaagatacgggacatcgcggtcttctgggtcatctccgccggggcctagt

SEQ ID NO: 26466 - protein, 107 aa, Zea mays
  misc_feature: Ceres CLONE 1398961-F
  misc_feature (7)..(7): Xaa is any aa, unknown, or other
  misc_feature (79)..(79): Xaa is any aa, unknown, or other
MEMEAVXSHGGAGRRTPKRDRGISWGCVFILASNCFQFIAYFAVSTNLVNYLKDRLAQGSKAAANGSPKWDGHERHQRXSSASSSATSSFGRYGTSRSSGSSPPGPS

SEQ ID NO: 26467 - DNA, 719 bp, Zea mays
  misc_feature: Ceres CLONE 1398962-F
  misc_feature: Encodes the peptide sequence at SEQ ID NO. 26468
  misc_feature (595)..(595): n is a, c, t, g, unknown, or other
  misc_feature (598)..(598): n is a, c, t, g, unknown, or other
  misc_feature (599)..(599): n is a, c, t, g, unknown, or other
  misc_feature (602)..(602): n is a, c, t, g, unknown, or other
  misc_feature (626)..(626): n is a, c, t, g, unknown, or other
  misc_feature (646)..(646): n is a, c, t, g, unknown, or other
  misc_feature (656)..(656): n is a, c, t, g, unknown, or other
  misc_feature (715)..(715): n is a, c, t, g, unknown, or other
ggagctccccgcggtggcggccgctctagaactagtggatcccccgggctgcaggaattcgcacgagaccattacctagaacatcctaatcgaaaaccgcacacctctgacctccctccgtccatctcatcatcatctttgtccctctcgcgcaattcgccgaacacaccgcgcgcgcctcgcctcccagcgacggccgcctcgacggccaatgctggcggcgggatgagcgtggaggaggaggtggagcgcggggaggaggacctgttctacgagtcgctcgaccgcatcctctcctcgtcgggctcctccacctctgcctcggacgacgatggcgccgaccgcccgcgccaccgccgcagctgcgatgcgccagccgcagcggccctcgacctgtggacctcccagccggcgcccgtccatgagcggcggcgccggctgctccatctcatggggctcaccggcgatccttccctcgccggatttgagattgcccggtccgcctccgaagaagccgcgggaccgcccccggctctcccccggtctcgtgatccagggtcagggcggggccgccctgggcttcccgccgaagagncgnncgnctcggggggggcggcccgtctgcngcttctcctttgtcccgaancgggtccgantgcccggccgacgaagggacccccaggtggccctgatcagggaaccctcgacgaacggnagaa

SEQ ID NO: 26468 - protein, 163 aa, Zea mays
  misc_feature: Ceres CLONE 1398962-F
  misc_feature (124)..(124): Xaa is any aa, unknown, or other
  misc_feature (125)..(125): Xaa is any aa, unknown, or other
  misc_feature (126)..(126): Xaa is any aa, unknown, or other
  misc_feature (134)..(134): Xaa is any aa, unknown, or other
  misc_feature (141)..(141): Xaa is any aa, unknown, or other
  misc_feature (144)..(144): Xaa is any aa, unknown, or other
MSVEEEVERGEEDLFYESLDRILSSSGSSTSASDDDGADRPRHRRSCDAPAAAALDLWTSQPAPVHERRRRLLHLMGLTGDPSLAGFEIARSASEEAAGPPPALPRSRDPGSGRGRPGLPAEEXXXSGGAARLXLLLCPEXGPXARPTKGPPGGPDQGTLDER

SEQ ID NO: 26469 - DNA, 716 bp, Zea mays
  misc_feature: Ceres CLONE 1398964-F
  misc_feature: Encodes the peptide sequence at SEQ ID NO. 26470
aaagctggagctccccgcggtggcggccgctctagaactagtggatcccccgggctgcaggaattcgcacgagaccattacctagaacatcctaatcgaaaaaacagccagccaaccacctctcgttggaacctgcgactgcgagttccacctccgcccgcccgctcgcccacgctcacgcccggaataggcagttgcagcagccagccagccccgcgcgccccgtcatcgtgggaggaggcccatgccgcggaggcagcagggggaagggtagaatgggcaacgtcacgtcgtcggtggcggcgcggttggtcttcttcccgccggagccggccacgtacggcgtcgagcccgcggacgagaacggcgccctgctgcggatgacgggggatgtactcactcacatgcgggcaagatcacctctctaacatcattgacgtcacaagtcacattcccatgtgtcaatcgtgagaggaccctgtagcgagatgctgagtaccttcgagaatcgcgtcacgcgggagatcatggcctgcatcaggacggtggaacacgactccattgcagtcgttagcagctgaccaagaagtagaagttactgtttcaacctcaacttccgctgcaggaagtatcgacactcatgatccaccggaaactttacagagggaagggagaatatctcaataacctcttgaggacccaagatccttttaggg

SEQ ID NO: 26470 - protein, 50 aa, Zea mays
  misc_feature: Ceres CLONE 1398964-F
MGNVTSSVAARLVFFPPEPATYGVEPADENGALLRMTGDVLTHMRARSPL

SEQ ID NO: 26471 - DNA, 702 bp, Zea mays
  misc_feature: Ceres CLONE 1398966-F
  misc_feature: Encodes the peptide sequence at SEQ ID NO. 26472
  misc_feature (504)..(504): n is a, c, t, g, unknown, or other
  misc_feature (550)..(550): n is a, c, t, g, unknown, or other
  misc_feature (562)..(562): n is a, c, t, g, unknown, or other
  misc_feature (563)..(563): n is a, c, t, g, unknown, or other
tggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgccccgggagatggaagcggaggttgccgccgctgcggcgtcgggntgcccgacgtggcggagcttccaggtcggctgcctcgacagcttcnagccatgcaggnnacctgcccgtgcttctcgcccagccccgctcgctccccgtctcgtcactacaggccggaatttgggagggaggccagtacgcaggcgagatggagcacggtttgaggcgcttctatggcaatggagctggagtgaaaaa

SEQ ID NO: 26472 - protein, 106 aa, Zea mays
  misc_feature: Ceres CLONE 1398966-F
  misc_feature (56)..(56): Xaa is any aa, unknown, or other
  misc_feature (60)..(60): Xaa is any aa, unknown, or other
MATAASSTPAARQPTLVCASLTARVPREMEAEVAAAAASGCPTWRSFQVGCLDSFXPCRXPARASRPAPLAPRLVTTGRNLGGRPVRRRDGARFEALLWQWSWSEK

SEQ ID NO: 26473 - DNA, 716 bp, Zea mays
  misc_feature: Ceres CLONE 1398967-F
  misc_feature: Encodes the peptide sequence at SEQ ID NO. 26474
  misc_feature (585)..(585): n is a, c, t, g, unknown, or other
  misc_feature (586)..(586): n is a, c, t, g, unknown, or other
  misc_feature (595)..(595): n is a, c, t, g, unknown, or other
  misc_feature (653)..(653): n is a, c, t, g, unknown, or other
  misc_feature (658)..(658): n is a, c, t, g, unknown, or other
  misc_feature (716)..(716): n is a, c, t, g, unknown, or other
ggagctccccgcggtggcggccgctctagaactagtggatcccccgggctgcaggaattcgcacgagaccattacctagaacatcctaatcgaaaataccgcctgatccaccgcggtttgcttgccgcgagcatggaaattattagtcattcgacaagtcagagagattttatttcctctcgtcgtctcgtggccgctggtgcccgcgcgtcagatttggcctgctccgctccgcctccgcagtgtgaatttctgagagataggtttctgtgctgcagacagcccggcggcgacgcggtggcagtttgcggcgaggtccggcgtcgcgccggcgttcatgtcgttcaggacggaggcgacgggcgagggctctgaggcgttctcggtctccgagctccggccggccggagacgccttcgacggcatcaagaagcagagctccatgctttcgatctaccagcagaggcagtttggccacaacagcagccaggccacggcacagcagcagtaccctgcagcggcgcacaggcagcgctcgcaggtggcggattacggcgcggcggcaccgcatcgctcctggtggtnnggtggtggntggatgcaggctagtgcagccgggtgtcggtgcgccaccctgtgccgttccatcaggncaccntgatggtcaggtcatcagtgtcgcagagcttcccacaccagcagcagcctttcacatn

SEQ ID NO: 26474 - protein, 107 aa, Zea mays
  misc_feature: Ceres CLONE 1398967-F
  misc_feature (83)..(83): Xaa is any aa, unknown, or other
  misc_feature (106)..(106): Xaa is any aa, unknown, or other
MSFRTEATGEGSEAFSVSELRPAGDAFDGIKKQSSMLSIYQQRQFGHNSSQATAQQQYPAAAHRQRSQVADYGAAAPHRSWWXGGGWMQASAAGCRCATLCRSIRXP

SEQ ID NO: 26475 - DNA, 709 bp, Zea mays
  misc_feature: Ceres CLONE 1398968-F
  misc_feature: Encodes the peptide sequence at SEQ ID NO. 26476
  misc_feature (468)..(468): n is a, c, t, g, unknown, or other
  misc_feature (504)..(504): n is a, c, t, g, unknown, or other
  misc_feature (505)..(505): n is a, c, t, g, unknown, or other
  misc_feature (525)..(525): n is a, c, t, g, unknown, or other
  misc_feature (527)..(527): n is a, c, t, g, unknown, or other
  misc_feature (528)..(528): n is a, c, t, g, unknown, or other
  misc_feature (566)..(566): n is a, c, t, g, unknown, or other
  misc_feature (668)..(668): n is a, c, t, g, unknown, or other
  misc_feature (669)..(669): n is a, c, t, g, unknown, or other
aaagctggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtgnccgcaggtggtggggggaggccacctacgacctcgnncacgtgctcgccttcctcgncnngtctcgcttcaccatctccgtctacatcatgtccaggncccaggcccgtgtacctcatccgacttcgcatggctacagccggcgacaaagctcaggtgtcccaagggcggagttcatcgacttggcgcgcaaagtccggnnaggttcgacgaggacagccgtggcgtttcaagtcgcgttg

SEQ ID NO: 26476 - protein, 167 aa, Zea mays
  misc_feature: Ceres CLONE 1398968-F
  misc_feature: SWISSPROT Homolog: EC 2.3.1.119 Icosanoyl-CoA synthase
  misc_feature (87)..(87): Xaa is any aa, unknown, or other
  misc_feature (100)..(100): Xaa is any aa, unknown, or other
  misc_feature (107)..(107): Xaa is any aa, unknown, or other
  misc_feature (120)..(120): Xaa is any aa, unknown, or other
  misc_feature (154)..(154): Xaa is any aa, unknown, or other
MAREEQALLSTEIVNRGVEPSGPDAGSPAFSVRVRRRLPDFLQSVNLKYVRLGYHYLISHGVYLATIPVIVLVCGAELGSLSRDELXPQVVGGGHLRPRXRARLPRXVSLHHLRLHHVQXPGPCTSSDFAWLQPATKLRCPKGGVHRLGAQSPXRFDEDSRGVSSRV

SEQ ID NO: 26477 - DNA, 720 bp, Zea mays
  misc_feature: Ceres CLONE 1398970-F
  misc_feature (471)..(471): n is a, c, t, g, unknown, or other
  misc_feature (524)..(524): n is a, c, t, g, unknown, or other
  misc_feature (581)..(581): n is a, c, t, g, unknown, or other
  misc_feature (660)..(660): n is a, c, t, g, unknown, or other
  misc_feature (661)..(661): n is a, c, t, g, unknown, or other
  misc_feature (666)..(666): n is a, c, t, g, unknown, or other
  misc_feature (667)..(667): n is a, c, t, g, unknown, or other
  misc_feature (701)..(701): n is a, c, t, g, unknown, or other
tggagctccccgcggtggcggccgctctagaactagtggatcccccgggctgcaggaattcgcacgagaccattacctagaacatcctaatcgaaaaagtgtttcgcactttgctattcagcttcgttcttcaccggttcaccctagccgccaccccaacccccagcgacagggaccttcgccgccaggccgcccccaatccctagcgactgcgagcaccgtcgccaggcgccgtgcagcgagcgtcgccgcctggcgaagtcgcgcgactcgtgccctgcagcgagcgccgctgtcccgcacccaccgtcgaacggctgccgatgcccaacgccctgcagcgagttgcgccgtcgtccgcttcctctcgctggtaacctcgtgtttcgatttggacagattgctcgtgacttggtgttgcgccgccgaccgagcctccttcccctaagtccctaaccgtaagtcctaaantcttggtgagttctgttcatgtgcatttgagcttacgcatctatgatacgcgncttaagggattgtgactgtgaatttaaggggttgtgaaattgagatgccattttagnaaaatggtgggaagtgtgaactgtgccttactgaaatcgagatgccattttgagcaagttttcaactatttttggtggnnatggnncgaggttatgagaccttttccagatactttatantccgagttggtggaaaatt

SEQ ID NO: 26478 - DNA, 706 bp, Zea mays
  misc_feature: Ceres CLONE 1398971-F
  misc_feature (385)..(385): n is a, c, t, g, unknown, or other
  misc_feature (701)..(701): n is a, c, t, g, unknown, or other
tccccgcggtggcggccgctctagaactagtggatcccccgggctgcaggaattcgcacgagaccattacctagaacatcctaatcaaaaatgattacaagaaaaatagtttcaatgccagattttctttgcttgctcatttgatcgcgcagagtgctgctgatgataacattatggatttgattcagaggcacattatctttcactcacatgatcaggaggggtatgaactggcaatgcatgtgttgtatcagctgcagagtatcagtgttgctaattcaccagaaagctctacctccacctctaaacattacgagaagttctttatatcacttgcgaggtccttgattgattcactgcctgcttcagacaaatcttttagcanacttttatgcgatgcaccatatctacctgagtctttgtttagattactggaggatctttgcatgtcagaagacaacagccaacaattaaaggatggagatggggaccgtgttacccaaggcctgggaactgtatggagccttatctttgggtcgcctccgcttcgccatggttgcttggatattgctctgaagtgtgctgccccactctcagatgaagtcaggggaaaagcagttagattggttgcaaaagggctctatgatctaacatatgcacagaaaaaaatagagcagtttgcatagagagccctttgtggnaagtg

SEQ ID NO: 26479 - DNA, 754 bp, Zea mays
  misc_feature: Ceres CLONE 1398972-F
  misc_feature: Encodes the peptide sequence at SEQ ID NO. 26480
  misc_feature (394)..(394): n is a, c, t, g, unknown, or other
  misc_feature (435)..(435): n is a, c, t, g, unknown, or other
  misc_feature (436)..(436): n is a, c, t, g, unknown, or other
  misc_feature (464)..(464): n is a, c, t, g, unknown, or other
  misc_feature (502)..(502): n is a, c, t, g, unknown, or other
  misc_feature (531)..(531): n is a, c, t, g, unknown, or other
aaagctggagctccccgcggtggcggccgctctagaactagtggatcccccgggctgcaggaattcgcacgagaccattacctagaacatcctaatcgaaaaatatacccccgtcccatcgtatacgaatcacagacaaagcacgagcggtggtagctggccagccaccatggctccaccacctctgttcccgctcccgcctctcctcatcctcctcgtcatcgtgcctctgttccccaccgccgcgccgacggccacgacgctgccgctgtaccgccacctaccgcacgtagccgaggccgtggcatcgcaccaccacccgctgtcccgcctgggcgccgcgtcgctggcccgcgcgttgcaccctcagcgccgggaccccaacccacacagncagaaaggatcagggcgccacccgtcagtaccagccaccgnncgcggtgtacccgcacttctacgggggntacgcccttcacggggtcgttcgggacgcccgccgaancccgttccccggtggtctccaaacccggnaggcacctccaggtgggggcttgcacctcgaagttaaaaagggggaaattggttttccccattgggtttcggggggcccgggttttccccccaaaaaaccccccccccccccccccgggggggtgcccaaccccttccggggagggggtaccttttggcggaaaacctcccaacaaggggggcgggcccccttttttccccgggggacaattagcccccccgc

SEQ ID NO: 26480 - protein, 132 aa, Zea mays
  misc_feature: Ceres CLONE 1398972-F
  misc_feature (75)..(75): Xaa is any aa, unknown, or other
  misc_feature (89)..(89): Xaa is any aa, unknown, or other
  misc_feature (99)..(99): Xaa is any aa, unknown, or other
  misc_feature (111)..(111): Xaa is any aa, unknown, or other
  misc_feature (121)..(121): Xaa is any aa, unknown, or other
MAPPPLFPLPPLLILLVIVPLFPTAAPTATTLPLYRHLPHVAEAVASHHHPLSRLGAASLARALHPQRRDPNPHXQKGSGRHPSVPATXRGVPALLRGXRPSRGRSGRPPXPVPRWSPNPXGTSRWGLAPRS

SEQ ID NO: 26481 - DNA, 618 bp, Zea mays
  misc_feature: Ceres CLONE 1398973-F
  misc_feature (192)..(192): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
tggagctccccgcggtggcggccgctctagaactagtggatcccccgggctgcaggaattcgcacgagaccattacctagaacatcctaatcgaagaagattgcctagcttaaaccttgagtgttctcttccctctcaacatcaaaccaactaagccagctgcaatcttctctgtctaatcaacttcatcgntgtttcatacagtggcaaaatgattgctggggaagctaattttgatgggtctcatgaacatattctccatggaaggatcaaggagtccctgatctttccaaactttcatctttgacaaaccaattttgaacaggaaaatttcaaattgcgccctttttacaaaaaaaaactctccattccggccaccttttccttgggggtgggagggggggaaaacccaattccacccccctggggggtttggctttgcggggggcctattggggtccctcttgggggagaaatcccctcccccaaaaaaaaaaaaaaatttccccccgggcaaaagggggcaacggggnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26482 - DNA, 748 bp, Zea mays
  misc_feature: Ceres CLONE 1398977-F
  misc_feature: Encodes the peptide sequence at SEQ ID NO. 26483
  misc_feature (511)..(511): n is a, c, t, g, unknown, or other
  misc_feature (512)..(512): n is a, c, t, g, unknown, or other
  misc_feature (514)..(514): n is a, c, t, g, unknown, or other
  misc_feature (515)..(515): n is a, c, t, g, unknown, or other
  misc_feature (661)..(661): n is a, c, t, g, unknown, or other
  misc_feature (698)..(698): n is a, c, t, g, unknown, or other
tggagctccccgcggtggcggccgctctagaactagtggatcccccgggctgcaggaattcgcacgagaccattacctagaacatcctaatcgaaaaatcgccccttgaaccctagctcccgcaactgccgccgccactcccacgcccgcagccatgccgcccaagctcgacccgtcgcaggtggtggaggtgttcgtccgtgtgaccggcggcgaggtcggcgcagcgtcttcgctggcccccaagatcggcccgctcggtctttcccccaagaagatcggagaggacatcgccaaggagacggccaaggactggaagggcctccgcgtcaccgtcaagctcaccgtccagaaccggcaggccaaggtctccgtcgtcccctccgccgcggcgctcgtcatcaaggcgctcaaggagccagagagggaccgcaagaaggtcaagaacatcaagcacagcggcaacatcagcctcgcacttttaaagaaaaatttccccggagcactttgnngnnccggttccttggcccaaggaatttgccccgtacccgtcaaagaagatccctcggtaacctggcgtcagccgtcgggtggcaccgtccaacggcaaggaccccccagggacctgtggcctccatggtccctgcggatccccgcttgnccgcaaactccgctttgtaattgtcgcgcactggggnagatagaggaattttccttatggttgcccccttcggaaggtatatttctg

SEQ ID NO: 26483 - protein, 198 aa, Zea mays
  misc_feature: Ceres CLONE 1398977-F
  misc_feature (12)..(71): Pfam Name: Ribosomal_L11_N Pfam Description: Ribosomal protein L11, N-terminal domain
  misc_feature (119)..(119): Xaa is any aa, unknown, or other
  misc_feature (120)..(120): Xaa is any aa, unknown, or other
  misc_feature (121)..(121): Xaa is any aa, unknown, or other
  misc_feature (169)..(169): Xaa is any aa, unknown, or other
  misc_feature (182)..(182): Xaa is any aa, unknown, or other
MPPKLDPSQVVEVFVRVTGGEVGAASSLAPKIGPLGLSPKKIGEDIAKETAKDWKGLRVTVKLTVQNRQAKVSVVPSAAALVIKALKEPERDRKKVKNIKHSGNISLALLKKNFPGALXXXGSLAQGICPVPVKEDPSVTWRQPSGGTVQRQGPPRDLWPPWSLRIPAXPQTPLCNCRALGXIEEFSLWLPPSEGIFL

SEQ ID NO: 26484 - DNA, 763 bp, Zea mays
  misc_feature: Ceres CLONE 1398980-F
  misc_feature (312)..(312): n is a, c, t, g, unknown, or other
  misc_feature (448)..(448): n is a, c, t, g, unknown, or other
tggagctccccgcggtggcggccgctctagaactagtggatcccccgggctgcaggaattcgcacgagaccattacctagaacatcctaatcgaaaagtccctccactcctcccgtcgagcacttggcactgccaatggcggcagccgcccacaccccttcgatgcgcgcaagccgcctcctttcctcctgagatcgacgcacctcctcctctcgtactccattcccgctccaagttcgtttcttcggcaccgagccatcgcacggccgcccccgcatctcgtcctgctctcaggtccttgggctccgccgntcttcgacaggggcgcgccccggtgcccactccgcgaaatccgagtcccttgtgcagctccgtagggtggaagagatccatcaggcggtgagcggtaggaggcgcccgtacaactgaggggactggcaatgcccgnccggggaaagcccactctgcacgggggtccgtccccccgggtttggctgcggtttgggacccaaaaaataccacccaaaacttttgttcccccgcggaaaggggcttttggggggggtttaatgtttggcctgggcccccctcctcggggggggggggccccgttttggccctcttggaaaaggaaatgagtgtgtgccccaacaacgaaagaaaggggttttttaaaaaaaaaccccccctatccaaaaggggggggggggtttcaccgggtggggggaagaaaccccttgtgggcgctctcccccccgctttt

SEQ ID NO: 26485 - DNA, 699 bp, Zea mays
  misc_feature: Ceres CLONE 1398982-F
  misc_feature: Encodes the peptide sequence at SEQ ID NO. 26486
  misc_feature (107)..(107): n is a, c, t, g, unknown, or other
  misc_feature (179)..(179): n is a, c, t, g, unknown, or other
  misc_feature (208)..(208): n is a, c, t, g, unknown, or other
  misc_feature (362)..(362): n is a, c, t, g, unknown, or other
  misc_feature (367)..(367): n is a, c, t, g, unknown, or other
tggagctccccgcggtggcggccgctctagaatagtggatcccccgggctgcaggaattcgcacgagaccattacctagaacatcctaatcgaaaaacaaaccgaanaaggccgcgacgagccgacgatctctactgcccccttccggccttcggcgaccgtgacgagcaacgacgacnacggcgacgatggccgcttcctccctctngcacgggcacttgctcctgtttctcctcgtggtcgtcacatcggcctggctcggtacgcggcagcgcatcaagccgggtctggagagggctacacgatcgccggccgcgtcaagatcgatggcatgagtgagaggggctatggtcttccagccnagacntcaacacaaaagggatactttaatggggggcaaaaggtttacattttgcaagccaagacggttacttttggattccaaaaaggggcagctgggactaacgggggttttttttagggaagcgggtctttgtaaagtggggccaaaccagtccccggggggaaatgcccacaaaaaaaaaaaggatttgggtggtttgtttcttaagcccgggggaggaacccggatttccaagggggggggccccccccgggggaaaaaaattttttcccggaaaaaaaataatctggaaatttgcccccggggggggggaggggggtttataaatacttttc

SEQ ID NO: 26486 - protein, 48 aa, Zea mays
  misc_feature: Ceres CLONE 1398982-F
  misc_feature (7)..(7): Xaa is any aa, unknown, or other
MAASSLXHGHLLLFLLVVVTSAWLGTRQRIKPGLERATRSPAASRSMA

SEQ ID NO: 26487 - DNA, 706 bp, Zea mays
  misc_feature: Ceres CLONE 1398983-F
  misc_feature: Translation starting site: 174
  misc_feature: SWISSPROT Homolog: EC 1.11.1.6 Catalase
  misc_feature (504)..(504): n is a, c, t, g, unknown, or other
  misc_feature (622)..(622): n is a, c, t, g, unknown, or other
  misc_feature (643)..(643): n is a, c, t, g, unknown, or other
  misc_feature (658)..(658): n is a, c, t, g, unknown, or other
  misc_feature (676)..(676): n is a, c, t, g, unknown, or other
aaagctggagctccccgcggtggcggccgctctagaactagtggatcccccgggctgcaggaattcgcacgagaccattacctagaacatcctaatcgaaaaatgtaaaccacactccactccagcactgaacacttgattgattcagtaggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgggagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcggnggtccccggagacgaccgcgacccgcgcgggttcgccgtgaaagtctacacccgcgagggcaactgggacctgctgggcaacaacttccccgtcttcttcatccgcgacggctcaggnttccccgacgtgatccacgcngtcagccccaacccngcgtcgaacgtgcagagnaaactggcgcgtgttcgacttcctgtcgca

SEQ ID NO: 26488 - DNA, 722 bp, Zea mays
  misc_feature: Ceres CLONE 1398985-F
  misc_feature: Encodes the peptide sequence at SEQ ID NO. 26489
  misc_feature (365)..(365): n is a, c, t, g, unknown, or other
  misc_feature (518)..(518): n is a, c, t, g, unknown, or other
  misc_feature (591)..(591): n is a, c, t, g, unknown, or other
tggagctccccgcggtggcggccgctctagaactagtggatcccccgggctgcaggaattcgcacgagaccattacctagaacatcctaatcgaaaaaaaaccgaaaaggaggacaaaatttctcctctcgaagaaccctagcggcaaaacctttgctccgtcccgccgacgcctgctcccatcccgccgccggcgctgccacccgcatctgccaaggggctcgccgccggggaggctgctcgcggtgccgcgctctctcccgcgcccgaccttggccctcccctcctccatgatctgcgcgatctccggcgaggagccggacgagccggtcgtgtcgaagaagtcggtgctactcttcgagcgncggctcatcgagcgctacattgaggaccatggcaagtgtgccgccacctacgacgaccctcacatggatgatatcgtgccggtcaagacaacacgatcgtgaagcccagccttttgcaggctgcaagcatccaggactccctggcatttttcnaccgaaggggaggctctcaggctttccaatttgcttggaacaacagctttccccgggaagacaagaactaagnttggcccttacccaaatggcggtggctgcggggtatacccccaataaagaagggaaaaaaaaggctctggggcccttttgggtcacgttgaaaaaaaaattccggcccctttgagggaatgtttccttgct

SEQ ID NO: 26489 - protein, 58 aa, Zea mays
  misc_feature: Ceres CLONE 1398985-F
MICAISGEEPDEPVVSKKSVLLFERRLIERYIEDHGKCAATYDDPHMDDIVPVKTTRS

SEQ ID NO: 26490 - DNA, 697 bp, Zea mays
  misc_feature: Ceres CLONE 1398986-F
  misc_feature: Encodes the peptide sequence at SEQ ID NO. 26491
  misc_feature (153)..(153): n is a, c, t, g, unknown, or other
  misc_feature (505)..(505): n is a, c, t, g, unknown, or other
tggagctccccgcggtggcggccgctctagaactagtggatcccccgggctgcaggaattcgcacgagaccattacctagaacatcctaatcaaaaaacccaggacgaggcccagggaggatcctcccgactccgacgctgcgtaggactccnccgactccgacggcgtccgcccgcgtcgcgtgccacgcccacgccacgccggccgccgcgaggaaagaacaccgggtacttccccttcccttacgctccagtttcacaagtcgcgagccgtgcgtcgcgtcgacgcgagttccgcgtgagggagcaggcagttgcagttggaggcggtgacgaaaccctaggacttgagctccagcgcacggctcgggtcctcctcaccgttcccggcgatggaccggcggcaggagctctgcaggaacttccagcgcggcagctgcaagtacggatcgcactggcagtttgtgcacgcctcctctcagcagcagcagcaggcgaagcccancccgttttgggtcggcttagggagtaggcagcagcaacagcagcagtcttcgtttcgggcggagttcggcagcagcagcagcagaagcccaccccgtttgaatttggagggcaaggaagtgcggttgcccagcccaaaacggtccgggccagcaaagcatttaaaaaaatggggtaaggccccccccccccc

SEQ ID NO: 26491 - protein, 101 aa, Zea mays
  misc_feature: Ceres CLONE 1398986-F
  misc_feature (38)..(38): Xaa is any aa, unknown, or other
MDRRQELCRNFQRGSCKYGSHWQFVHASSQQQQQAKPXPFWVGLGSRQQQQQQSSFRAEFGSSSSRSPPRLNLEGKEVRLPSPKRSGPAKHLKKWGKAPPP

SEQ ID NO: 26492 - DNA, 739 bp, Zea mays
  misc_feature: Ceres CLONE 1398987-F
  misc_feature: Encodes the peptide sequence at SEQ ID NO. 26493
  misc_feature (309)..(309): n is a, c, t, g, unknown, or other
  misc_feature (347)..(347): n is a, c, t, g, unknown, or other
  misc_feature (359)..(359): n is a, c, t, g, unknown, or other
  misc_feature (363)..(363): n is a, c, t, g, unknown, or other
  misc_feature (382)..(382): n is a, c, t, g, unknown, or other
ggagctccccgcggtggcggccgctctagaatagtggatcccccgggctgcaggaattcgcacgagaccattacctagaaacttccttagctaacttcccagccccgacaccttggccgccgctccgtgcgcacccagttgctgaggttgcaacgctgcagccggcgaggatcggatgaaccaccaacccctcctataaatcctaaccgagtcctctgcttctgctctcatccatctgtagagtgcaacatgcagtgccccatggacactgctgctagtggaacctcgccagtgatgcaattccatagncatgctgatgagtctatcgcccattcatctccattggncacattaatacnacgntcacagccgcattgctatngggatggatcccccagcgaattcccccttgctgggagccccctcatttgttctcatgggctctcattcttgggatctagggccgaaagatctcgcaatctggagggtaactggcgattttttcggcaaccctgcaggttttgcaccaaacttttgattgccccttcggggatttggggatttttgaatgggcccaaaagggcccttgtttacccaatgaaccaaaaaattcggggtgtttaaaaaccccggggggagggttttggaaaagtttttttggaaaatttttggaaaggaaaaaaatttttcccggggatatcggggcaggggcaaaattttttttcccccccgagggggg

SEQ ID NO: 26493 - protein, 120 aa, Zea mays
  misc_feature: Ceres CLONE 1398987-F
  misc_feature (16)..(16): Xaa is any aa, unknown, or other
  misc_feature (29)..(29): Xaa is any aa, unknown, or other
  misc_feature (33)..(33): Xaa is any aa, unknown, or other
  misc_feature (41)..(41): Xaa is any aa, unknown, or other
MDTAASGTSPVMQFHXHADESIAHSSPLXTLIXRSQPHCYXDGSPSEFPLAGSPLICSHGLSFLGSRAERSRNLEGNWRFFRQPCRFCTKLLIAPSGIWGFLNGPKRALVYPMNQKIRGV

SEQ ID NO: 26494 - DNA, 702 bp, Zea mays
  misc_feature: Ceres CLONE 1398989-F
  misc_feature: Encodes the peptide sequence at SEQ ID NO. 26495
  misc_feature (523)..(523): n is a, c, t, g, unknown, or other
aaagctggagctccccgcggtggcggccgctctagaactagtggatcccccgggctgcaggaattcgcacgagaccattacctagaacatcctaatcgaaaaatctctctcccgtctctccccagtgggcgtgggggcgccgcatggaagccatggacgtcaagtacaagcccgtcatgttccccaacggcgccggcctcaagaagccgaagccggcggcggtcgtggcgctggccggggagccgctgtaccgggagtgcctcaagaaccacgccgcgagcctgggcggccacgccgtcgacggatgcggcgagttcatgccctcgccgggggccaaccccgccgacccgacgtctctcaagtgcgcggcgtgcgggtgccaccacaacttccaccgccggacgctggagggttcccctccgccgcccgcgcccgtgccgctggtgctcccgcctccgccgagattgatgcacggccaaccgcaccgcgaccggtaggagacgccctaggaccgccacccggnggtcgtcgacgccgacgactccgattgcgactcgggaagctcagagtacgaccagcagcgatcagtagtcccgtcgccgtcgccgaaacaactgctgccggcgccgttgggggagcagccaccgacaccgtcctacttcccgacggagcgcacgtggagctctctctaggttccagcgg

SEQ ID NO: 26495 - protein, 117 aa, Zea mays
  misc_feature: Ceres CLONE 1398989-F
  misc_feature (31)..(92): Pfam Name: ZF-HD_dimer Pfam Description: ZF-HD protein dimerisation region
MEAMDVKYKPVMFPNGAGLKKPKPAAVVALAGEPLYRECLKNHAASLGGHAVDGCGEFMPSPGANPADPTSLKCAACGCHHNFHRRTLEGSPPPPAPVPLVLPPPPRLMHGQPHRDR

SEQ ID NO: 26496 - DNA, 626 bp, Zea mays
  misc_feature: Ceres CLONE 1398992-F
  misc_feature (171)..(171): n is a, c, t, g, unknown, or other
  misc_feature (247)..(247): n is a, c, t, g, unknown, or other
gagctccccgcggtggcggccgctctagaatagtggatcccccgggctgcaggaattcgcacgagaccattacctagaacatcctaatcgaaaaaaataccgaagtctacttccattccttcctttctcctttcatatacccgcgtcgcccacgagcccgccgtggcgacngaagtgtggacctcgcccggagcaaaggctaatggggccaccgcaagccagccaggccggggtcatcacatcgagnctggccggggcgatgccgtcaacaccgaattagctttctataattccggaatgggggagactcctccaaaggtaaaaatattcggacgaagggacttcccccaaccaattgcacccctttaagaaaacccgggttggtgggggaaaaattccgggggcgggggaaaccaggccctccaaaaaaaaaaaagggtttttttaaaaaatttgtgggggttttaaaaaattttgaattttttcccccttttgtggggggaattttccctcataaaaaagggggggcggggggggaaaaatataataaaccccttgggggggggggggggcccctctgggggaaagggggggaccccccccttttttttttcccccccgcgttt

SEQ ID NO: 26497 - DNA, 727 bp, Zea mays
  misc_feature: Ceres CLONE 1398993-F
  misc_feature (290)..(290): n is a, c, t, g, unknown, or other
  misc_feature (352)..(352): n is a, c, t, g, unknown, or other
  misc_feature (389)..(389): n is a, c, t, g, unknown, or other
  misc_feature (418)..(418): n is a, c, t, g, unknown, or other
  misc_feature (421)..(421): n is a, c, t, g, unknown, or other
  misc_feature (442)..(442): n is a, c, t, g, unknown, or other
  misc_feature (443)..(443): n is a, c, t, g, unknown, or other
  misc_feature (459)..(459): n is a, c, t, g, unknown, or other
  misc_feature (460)..(460): n is a, c, t, g, unknown, or other
tggagctccccgcggtggcggccgctctagaactagtggatcccccgggctgcaggaattcgcacgagaccattacctagaacatcctaatcgaaaagaaaaacggtcaggttttgcgtgtagcatatgctaaaagtacacatggacctgcatcagggggttctcagtcaaacagccttgctgcagctgccattgaggctgcatcatttgctcagcagtatgatgccataggttgggctccaaaagagtacaatcctgatgacaaacagaacaacaactctgaatctcanaaagatggcagcacagcacagtcgggatttgtttgggatgaaaaatctggttactactatgnatctgcatctggattctattatgatggaactactggnctttactatgacagcaaactctggagttnggntattcatatgatcaacagacnntcacatatgtcccttnngtatgacccagagcacactaaggcagccggggaaggcgcccagcgaaaacacgaaaactcaaatagtatagtgggaaaaaggttgggatctctgccccctgctgcacaataaacaaggggaaaaattcctttcctgaaccttgtaagttgttaaaaggttgactggttgccaaaaagaagaaaagggaaagggaaaaaaataaaatgcccccaaaaaaagctccttatttaaaaaaaagaggcgatgcccctattttgggaaaaaag

SEQ ID NO: 26498 - DNA, 659 bp, Zea mays
  misc_feature: Ceres CLONE 1398996-F
  misc_feature: Encodes the peptide sequence at SEQ ID NO. 26499
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
ctagaactagtggatcccccgggctgcaggaattcgcacgagaccattacctagaacatcctaatcgaaaaaacgcatttcgctccccacagcggctcggccacaacccacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacaagctccgccaggttgctgtgtgaagtccaagggtgtcacatggattcagcacaagatttccaacccaggacattctctataaagttgtggccaccaagtgaaagcacacggatcatgctttgtgacaggatgacaaacaatctgtctacagagtccattttctctcgccaatatcggcttttggggaagccaggagctcatgaggatgcaaaacgattgagaacttgttgcttgctgggcatcaaaagagcgatggatggatctgttcactatgcagaccatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26499 - protein, 82 aa, Zea mays
  misc_feature: Ceres CLONE 1398996-F
MDSAQDFQPRTFSIKLWPPSESTRIMLCDRMTNNLSTESIFSRQYRLLGKPGAHEDAKRLRTCCLLGIKRAMDGSVHYADHA

SEQ ID NO: 26500 - DNA, 705 bp, Zea mays
  misc_feature: Ceres CLONE 1398997-F
  misc_feature: Encodes the peptide sequence at SEQ ID NO. 26501
  misc_feature (616)..(616): n is a, c, t, g, unknown, or other
  misc_feature (625)..(625): n is a, c, t, g, unknown, or other
  misc_feature (639)..(639): n is a, c, t, g, unknown, or other
  misc_feature (691)..(691): n is a, c, t, g, unknown, or other
aaagctggagctccccgcggtggcggccgctctagaactagtggatcccccgggctgcaggaattcgcacgagaccattacctagaacatcctaatcgaaaacattgaatttggccgagtaacagaaccgtgtctgtttttaattcctgacggttagagatggcccacccctccgccgccgccgtatcctccacggcgctcgctgcaaaccctagctctggcgccagcgaggaaggaggcgcccgctctccgccgtcgccgtctcagagggggcgggccaaggtggtgatcgttatgggcgccacgggcgccggcaagtcgcggctggccgtcgacctcgcggcccacttcgccggcgtcgaggtggtcagcgccgactccatgcagctctaccgcggcctcgaagtcctcaccaacaaggctcccctccacgagcagaacggtgttcctcatcatctacttagcgtgattgatccctctgtcgagttcacttgccgtgatttccgcgaccgtgccctgccgattatacaggaaatagtggaccgcggtggcgtccctgtggttgtcggcggcacaaacttctacatccaggctctcgttagtccattcctcttgnatgatatgncagaagaaatgcanggctgtactctgagagatcacatagatgacggccttaccgatgaagatgaangcaatgggtttgaa

SEQ ID NO: 26501 - protein, 182 aa, Zea mays
  misc_feature: Ceres CLONE 1398997-F
  misc_feature: SWISSPROT Homolog: EC 2.5.1.8 tRNA isopentenyltransferase
  misc_feature (153)..(153): Xaa is any aa, unknown, or other
  misc_feature (156)..(156): Xaa is any aa, unknown, or other
  misc_feature (160)..(160): Xaa is any aa, unknown, or other
  misc_feature (178)..(178): Xaa is any aa, unknown, or other
MAHPSAAAVSSTALAANPSSGASEEGGARSPPSPSQRGRAKVVIVMGATGAGKSRLAVDLAAHFAGVEVVSADSMQLYRGLEVLTNKAPLHEQNGVPHHLLSVIDPSVEFTCRDFRDRALPIIQEIVDRGGVPVVVGGTNFYIQALVSPFLLXDMXEEMXGCTLRDHIDDGLTDEDEXNGFE

SEQ ID NO: 26502 - DNA, 672 bp, Zea mays
  misc_feature: Ceres CLONE 1398998-F
  misc_feature: Encodes the peptide sequence at SEQ ID NO. 26503
  misc_feature (576)..(576): n is a, c, t, g, unknown, or other
aaagctggagctccccgcggtggcggccgctctagaactagtggatcccccggctggaggaatttccacgagaacattacctaaaacattctaattgaaaactctcattctagaggagtccgcgtcgtcagggccgcttcgcgtgcgacgcctccatatatggtttcgccggcgtcggcgatggacccagcccccgtgagccccgatcgttggtgggccagtccgggctttggtgtcgtgtcctcacgtctacgacgatatggtctcaatttctccgcctccagcctcgtcgaggcccccatcgagggcttccttgagtactccggtgtatctcagtccggccctgccctgggggcggaccactcgtccgcggggccctcgttgccgttgtgggcgtcggaggcctgtgctcttctctccgctgccgctgctgcgtacggtcaggtttcgatccgaattcagggcgcgccaggcgacacggaggccatcgtcgcgtcgaatgcgggtgactcgatcgaggattgatcgaggcgaccagcgggtctgaggttgaccaggtcttccgctgcggcaggnctgtccgcgctacggatgcggagacaaacgtggcgggtccgcacgtacgggaggggagcagggaacgcgcgtacaacgctacgactgtacacgttg

SEQ ID NO: 26503 - protein, 114 aa, Zea mays
  misc_feature: Ceres CLONE 1398998-F
MDPAPVSPDRWWASPGFGVVSSRLRRYGLNFSASSLVEAPIEGFLEYSGVSQSGPALGADHSSAGPSLPLWASEACALLSAAAAAYGQVSIRIQGAPGDTEAIVASNAGDSIED

SEQ ID NO: 26504 - DNA, 713 bp, Zea mays
  misc_feature: Ceres CLONE 1398999-F
  misc_feature: Encodes the peptide sequence at SEQ ID NO. 26505
agagctggagctccccgcggtggcggccgctctagaactagtggatcccccgggctgcaggaattcgcacgagaccattacctagaacatcctaatcgaaaagtatcgtctcctctccttcctgacattggcactggcagctgcactcaccggaagccatggaagacttgctctactactccctcaccatagccatctgcatcgcagtcatcgccctcctctccatccttcgttcgttcaccgctaccggacggccgccggcgctcccgcccggcccgtcgctgctgtcgctgatcaccccgctcctcttcctcggccgaacgaacttccgcatcgaggggatcctctccggcgcgcggccccgctacggacccgtcttcacgctctacctgctcccgtcccgccccggccattttcatcgccaaaccacccggggcgcccccccgtggttggggcagggcgggcccccctttcgccaacggggcggcagaacagccacccccttccgcctttttctcaggggaccagggcaaaatcacattccggggccctaacggccccggtttggaggcgcggctccctcaaaaacctccaagggaacaaagggtccaacccccaacccgacaggggacgcggaattgcccaccccccccaccgccgaagagccttagaggggccccccaccccccggatatccagacgggaaaacaaaa

SEQ ID NO: 26505 - protein, 131 aa, Zea mays
  misc_feature: Ceres CLONE 1398999-F
MEDLLYYSLTIAICIAVIALLSILRSFTATGRPPALPPGPSLLSLITPLLFLGRTNFRIEGILSGARPRYGPVFTLYLLPSRPGHFHRQTTRGAPPWLGQGGPPFRQRGGRTATPFRLFLRGPGQNHIPGP

SEQ ID NO: 26506 - DNA, 672 bp, Zea mays
  misc_feature: Ceres CLONE 1399003-F
  misc_feature: Encodes the peptide sequence at SEQ ID NO. 26507
  misc_feature (133)..(133): n is a, c, t, g, unknown, or other
  misc_feature (192)..(192): n is a, c, t, g, unknown, or other
  misc_feature (246)..(246): n is a, c, t, g, unknown, or other
  misc_feature (425)..(425): n is a, c, t, g, unknown, or other
  misc_feature (436)..(436): n is a, c, t, g, unknown, or other
  misc_feature (449)..(449): n is a, c, t, g, unknown, or other
  misc_feature (450)..(450): n is a, c, t, g, unknown, or other
  misc_feature (530)..(530): n is a, c, t, g, unknown, or other
  misc_feature (564)..(564): n is a, c, t, g, unknown, or other
  misc_feature (622)..(622): n is a, c, t, g, unknown, or other
gctctagaactagtggatcccccgggctgcaggaattcgcacgagaccattacctagaacatcctaatcgaaaaacgtaaggacaaacgcgaacggaaccctccccagcagatgagcggagtaggtgggcggngttctcttccactcccgctccagctttctctggcccgatcgatgctacattcccgcggngagccgctcgccttcctccgcgggccttgggctacccaacccatcgccgagccngctcgcgcggtcccccctccatctttgcccggctctctcgcctcggaggacggacagagaaagagaggatgagaagggactcctcgacccgcgtcccgcgctcgggctattggaccgaggggggtgcggtggatttggagcggcggggtggactcgtcgctgatggtattctccgatgncagaggcaggnagagaagcggacnnaggcgcggcggcggcggatctccgaggcgtcgccgctagcgtcagggccacggatacggcagctgtaagcacaaagcggnaaaagcgataccgactggccttatggatagcatnatgcgcctgataataaaggaaagggagaaagcctgtcatgatcccagtattcaagacncagaatcccttactggcacagccgatgcaaatactatgataggaagatgt

SEQ ID NO: 26507 - protein, 50 aa, Zea mays
  misc_feature: Ceres CLONE 1399003-F
  misc_feature (2)..(2): Xaa is any aa, unknown, or other
  misc_feature (10)..(10): Xaa is any aa, unknown, or other
  misc_feature (37)..(37): Xaa is any aa, unknown, or other
  misc_feature (48)..(48): Xaa is any aa, unknown, or other
MXEAGREADXGAAAADLRGVAASVRATDTAAVSTKRXKRYRLALWIAXCA

SEQ ID NO: 26508 - DNA, 700 bp, Zea mays
  misc_feature: Ceres CLONE 1399009-F
  misc_feature: Encodes the peptide sequence at SEQ ID NO. 26509
  misc_feature (425)..(425): n is a, c, t, g, unknown, or other
  misc_feature (446)..(446): n is a, c, t, g, unknown, or other
aaagctggagctccccgcggtggcggccgctctagaactagtggatcccccgggctgcaggaattcgcacgagaccattacctagaacatcctaatcgaaaaaagcggcataggaaaaaggagactaaagttaatcacgaaacaaggcctcgacctttccagaaatatacataccgaggatataaggctgtttcagatcgaagtgggcgagaccctacaggcggtttcaaaggccctgtacagaatgaaccagagttgcaagctccactaaactcatcagccttggatgtcaagacaagtgacactacagaaatattttctgctactatcaatggtgcccagactgatgctaagaacaccacttctcagcctttatctaaagtgcaccatgtttggggttgtattccacggtcgccctccatggntgaaatagtgaagatggcagncctcaagtaaagtgggagcaaatctgtagcaaagacacctgcgtgcaaccgttggttgatcagttttttcaaaacccaaatcttgggcccaaaaaataacaaaattgttttgattaaaagaaggcccggcccacaaaaaaattgcccaacgggggggggaggggcgcccccacaaaaaaggctccccttttaaaatgcccccccccggggaaaaaagatttaccccccttcacgggggtttgccaaaagttttc

SEQ ID NO: 26509 - protein, 151 aa, Zea mays
  misc_feature: Ceres CLONE 1399009-F
  misc_feature (142)..(142): Xaa is any aa, unknown, or other
  misc_feature (149)..(149): Xaa is any aa, unknown, or other
KAGAPRGGGRSRTSGSPGLQEFARDHYLEHPNRKKRHRKKETKVNHETRPRPFQKYTYRGYKAVSDRSGRDPTGGFKGPVQNEPELQAPLNSSALDVKTSDTTEIFSATINGAQTDAKNTTSQPLSKVHHVWGCIPRSPSMXEIVKMAXLK

SEQ ID NO: 26510 - DNA, 697 bp, Zea mays
  misc_feature: Ceres CLONE 1399011-F
  misc_feature: Encodes the peptide sequence at SEQ ID NO. 26511
  misc_feature (27)..(27): n is a, c, t, g, unknown, or other
  misc_feature (54)..(54): n is a, c, t, g, unknown, or other
  misc_feature (545)..(545): n is a, c, t, g, unknown, or other
  misc_feature (658)..(658): n is a, c, t, g, unknown, or other
aaagctggagctccccgcggtggcggncggttcttcatagaggatcccccgggntgcaggtatttcccacgagaccattacctagaacatcctaatcgaaaacaggatcttagctccagttctccgccgcaggggtctctatgcgtacgtctgcaacgtaaggcgagaatgccagaactcctatcaggatctcatgaacaccggctaatgtctgccttacatggagactacgagccagaataggaaatccaatgcggaatacatggaggactagaagaaagtggcgatcgcggctctgaaaacgaacgctttgatggcctaacacaactttacggattgcatgaataggcggaggaacagtgcctaggcgatgtctcatctcaattctgcatgagcgtgaacctgacgaagtacactgtgtggatgtcttccgacaacttcttgtacttgaagagctgctaccatcgcatcatgatgactaccacatgatgctagtatttctcaagtcaacatagtttgatatcgagaagacaaagcatatgtgntctgatatgctgaggtggagaacggagttcgctgctcataccattctcgaagaattcgaattcaaacaagctgatagggtgatagaatgctaccctcaacgatactatggggntgataaggaaaggaggtctgtctactttttaacggttcc

SEQ ID NO: 26511 - protein, 52 aa, Zea mays
  misc_feature: Ceres CLONE 1399011-F
  misc_feature (2)..(2): Xaa is any aa, unknown, or other
  misc_feature (40)..(40): Xaa is any aa, unknown, or other
MXSDMLRWRTEFAAHTILEEFEFKQADRVIECYPQRYYGXDKERRSVYFLTV

SEQ ID NO: 26512 - DNA, 675 bp, Zea mays
  misc_feature: Ceres CLONE 1399012-F
gctctagaactagtggatcccccgggctgcaggaattcgcacgagaccattacctagaacatcctaatcaaaaaaacgaaatccgaccgcgctcgccccggatgctgcgacgatgttcggtgactccgacggatccaaggacgccagcgccgccgagccagggtagaacccgtgggagccgcccttccccaggcgggagctcacgctcagcagctacctctgcgacaaggcgccgcccgccgcggcggggccatcctcgccgcccaaccccgaggcggcggctggcctggtcgaagacgccgcgcccagcgccaaggtgtgcgtcgagcgggatttcgtccgcctcaacgggcccatacgcggcgacccgcccggagacgactcctccgtggtagggggtaagaagccccgcctagagccgctccagttctcggtctccctctccaccgatgcgcccggccggcgatagaatccacaaaaaccgccctcctcccggctggctccgacttaactagcgtcatttcttcccggcagagggaaatattgcgggttggaagccgcggggcccaacgacacccacccctagtgactgaccgcgcccccaagcggccacccaaggcgaaaactaatagcggcaacccgctgggccgccccccgaaatcttcaactccggag

SEQ ID NO: 26513 - DNA, 620 bp, Zea mays
  misc_feature: Ceres CLONE 1399013-F
  misc_feature: Encodes the peptide sequence at SEQ ID NO. 26514
gcagttctcgtggatcccccgggctgcaggaattcgcacgagaccattacctagaacatcctaatcaaaaaaaaacaacacacgaacaccgtaccgcaacgtagccggctaggggaagagctctttccttcagctgtgccgtgcacaacgcacggtacgctggtttggtttgcatcgcccccgccaagaaagacgctgccgtgagcgggctgagcgggcggtaagcagcatcaggcggccgacatgccgagcggcagcgtgttctccgggtcggtgaacctcaagcacgtcaagctggggtaccagtacctgggtgaaccactatcctagactctgctgctggtgccggtgatgtccgccacggagctggagctgccgcgcctcggccccggagagctgctctcgctgtggcgctcgctggagctggacctggtacacatactctgctccgcgattctggacgtcttcgtcggccacggtgtaccgtgatgtcccgccccaggcccgtgtaccttgggggattacgcttgttaaaaaccccccgcacactgctgggggaccttccccccccttaatggaggccacgcgtccttaataaagataaaaaaaaaaagggtgtg

SEQ ID NO: 26514 - protein, 45 aa, Zea mays
  misc_feature: Ceres CLONE 1399013-F
MSATELELPRLGPGELLSLWRSLELDLVHILCSAILDVFVGHGVP

SEQ ID NO: 26515 - DNA, 698 bp, Zea mays
  misc_feature: Ceres CLONE 1399016-F
  misc_feature: Translation starting site: 252
  misc_feature (540)..(540): n is a, c, t, g, unknown, or other
  misc_feature (653)..(653): n is a, c, t, g, unknown, or other
ggagctcaccgcggtggcggccgctctagaactagtggatcccccgggctgcaggaattcgcacgagaccattacctagaacatcctaatcaaaaaaaacccgaatcccaaacggaggagggcactcggcgaggcaggtggcgattctgcgattctcctgtcaccttccgtcgtctccatccccttccatttccggcgagggtcaaagcaggcctcttgctcttgggggtggtttgagagagggagagaacatggccgcggcggcggtgttggtggtgctcacggtgtcagcgctggcgggggcagcggccggcggtgatatcgtccaccacgatgacgaggcacccaagatccctggatgctccaacgattttatcctggtaaaagtgcaaagctgggtcaatggcaaagagggtggcgagtttgttggcgtcggtgctcggtttgatccaaaatcgtctccaaggagaagcacgcaaaccgaactaaactcacgctggcagaccctatggactgctgctctcctccgaaacataaggntcctggagatgttcttttagtcaaaggggaaagtgcaattcacaagaaagcaagtttgctgaagctgctggtgcttctgctatagtatcataaacatgtccacgaatggtacnagatggtctgcgaaaagaatgaaccgacctgacataatatacctg

SEQ ID NO: 26516 - DNA, 611 bp, Zea mays
  misc_feature: Ceres CLONE 1399019-F
  misc_feature: Encodes the peptide sequence at SEQ ID NO. 26517
  misc_feature (113)..(113): n is a, c, t, g, unknown, or other
  misc_feature (323)..(323): n is a, c, t, g, unknown, or other
  misc_feature (387)..(387): n is a, c, t, g, unknown, or other
ggagctccccgcggtggcggccgctctagaatagtggatcccccgggctgcaggaattcgcacgagaccattacctagaacatcctaatcgaaaaaccaatcgaccgacccgngatccttcccttccgtctgacgtcgtcgtagcagatcttatctcaaaccctaccgaccaacagctgcttgctcgggacgggaaccggagttggattgcgatggcgctgcagtacgtggaggcgcagcggcaggcgcgcccggacctcgccgactggtatgcttccctcgccgacctctaccagcagaagctatggcaccagctcaccctncagctcgaccaattcctacagctccaggccgcacagaccggagacactatcattcagctctacnacaattttcatcaactgattttggagacccaagattaatcccgggtccaaggttgggcccctttttggggggggggagaggtttttcccccccccccccccccggaagggggggggggaattccccttttaaggggggggggaaccaaaatggggggggagaaaaaaagggggcccgggggttaaaaaagaacccccccttttttttttggggagagaaaaatc

SEQ ID NO: 26517 - protein, 70 aa, Zea mays
  misc_feature: Ceres CLONE 1399019-F
  misc_feature (59)..(59): Xaa is any aa, unknown, or other
MALQYVEAQRQARPDLADWYASLADLYQQKLWHQLTLQLDQFLQLQAAQTGDTIIQLYXNFHQLILETQD

SEQ ID NO: 26518 - DNA, 693 bp, Zea mays
  misc_feature: Ceres CLONE 1399023-F
  misc_feature: Encodes the peptide sequence at SEQ ID NO. 26519
  misc_feature (514)..(514): n is a, c, t, g, unknown, or other
tggagctccccgcggtgggcggccgcttctagaactagtggatcccccgggctgcaggaattcgcacgagaccattacctagaacatcctaattgaaaaacatcgatcagtcgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaagggaaggatggagaagaagccgaccatcctcatgaacaggtacgagctcgggcgcacgctcgggcagggcacctttcgcaggtgtacccacggcggaaccctcgcgtcggcgagagcgtggcccatcaggtcatcgaacaggagaaagtgatgcgcgtcggcatgatcgaccagatcaggcgcgagatctccgtcatggccctcgtccgcaccccaaagtngtggaattgcacgaggtgttggccgcaaaaacaaaaatacttccccatggaaaactccggggggggaagtttttcccccggtccccggggggtttaaggggacccccggaaaaggatttccccctttttggggggcctaaattttgccaaaggggggggttaaacccgccacacagccc

SEQ ID NO: 26519 - protein, 55 aa, Zea mays
  misc_feature: Ceres CLONE 1399023-F
  misc_feature (24)..(24): Xaa is any aa, unknown, or other
MRVGMIDQIRREISVMALVRTPKXWNCTRCWPQKQKYFPMENSGGGSFSPGPRGV

SEQ ID NO: 26520 - DNA, 684 bp, Zea mays
  misc_feature: Ceres CLONE 1399030-F
  misc_feature: Encodes the peptide sequence at SEQ ID NO. 26521
  misc_feature (373)..(373): n is a, c, t, g, unknown, or other
  misc_feature (400)..(400): n is a, c, t, g, unknown, or other
  misc_feature (535)..(535): n is a, c, t, g, unknown, or other
  misc_feature (646)..(646): n is a, c, t, g, unknown, or other
  misc_feature (676)..(676): n is a, c, t, g, unknown, or other
  misc_feature (679)..(679): n is a, c, t, g, unknown, or other
  misc_feature (684)..(684): n is a, c, t, g, unknown, or other
gctctagaactagtggatcccccgggctgcaggaattcgcacgagaccattacctagaacatcctaattgaaaacttccaatttttctcccaaataaaaaccagccgcagcgggaggtggcgcgacgcgaacccacccaccctgcgaacccggccgcaaaattctcctctcggattccgccgccgcgaaccgtcccctcgacgaggctgctgcgatagatttttcttaccattcgaatagttgatgagcgagaatacagagcaagaatcttgatggtgcgtgtggtacaacttggttaaggaaagctgactgcttgaagtgaccatgttggaccatcttgctatcattgcgtctgagttaggggacgacgcancggattttgaggttgatggcatcgacnacctcagcgagaacgatgtcagcgactaggagatcgatgctgacgagctcgcccgacgaatgtggaagggacaggtcaagctaaagaggatcagggagaggcagcagaagcttgccctgcagcggctggagctgnagaagacaagacaaagagatttcagaccagccctccggaagaagatgacgagggccccagacgggatcctcaagacatgctcaggctgatggagtgtgcaatgcccgaggntccgtgtacggaatcatccctgagaaagtnagnctggn

SEQ ID NO: 26521 - protein, 34 aa, Zea mays
  misc_feature: Ceres CLONE 1399030-F
  misc_feature (17)..(17): Xaa is any aa, unknown, or other
  misc_feature (26)..(26): Xaa is any aa, unknown, or other
MLDHLAIIASELGDDAXDFEVDGIDXLSENDVSD

SEQ ID NO: 26522 - DNA, 725 bp, Zea mays
  misc_feature: Ceres CLONE 1399032-F
  misc_feature: Encodes the peptide sequence at SEQ ID NO. 26523
  misc_feature (290)..(290): n is a, c, t, g, unknown, or other
  misc_feature (329)..(329): n is a, c, t, g, unknown, or other
  misc_feature (330)..(330): n is a, c, t, g, unknown, or other
  misc_feature (340)..(340): n is a, c, t, g, unknown, or other
  misc_feature (347)..(347): n is a, c, t, g, unknown, or other
  misc_feature (368)..(368): n is a, c, t, g, unknown, or other
  misc_feature (369)..(369): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (415)..(415): n is a, c, t, g, unknown, or other
  misc_feature (416)..(416): n is a, c, t, g, unknown, or other
  misc_feature (440)..(440): n is a, c, t, g, unknown, or other
  misc_feature (549)..(549): n is a, c, t, g, unknown, or other
cacccgcggtggcggccgcttttctagaactagtggatcccccgggctgcaggaattcgcacgagaccattacctagaacatcctaatcgaaaaaggattagtttgaccccctccagtacgtccgcaccgcaaggcctctcgccgtccttggacattctccgtccgtcgcctttgcctggggcagataacaatatctgatatccctgggccttcgccgtccgggcccccctaccttctctcatccgtcctcacacaaagcagaagggggaggagtttttagggaggaggnggcggcaggaggagccattattatttctttcttcagcgnncattcctggnccaccanccggcgcgctatattactccnnggtcgtgggacagcatgcagaaggggcgtgtcctttccctgnnngnnatggcgaaggagttgcccgcccgncgaggttctggcttccgggacgagttcctggacgacgacttctttctccaagaggaaaaggggggggtcccggccaaaacgaaaacccccgaggagaaaggggatgaantccttttccaaccggggggcggttttttcttgggggggggaaggggaacgtctcccctgaaaaggcccaaggttatcccgcctccccccaaacatatttggggggcctggagtttctccggaagagaaacccacaggggggggggaaaaaaaaaattctcccccccttcctctaaa

SEQ ID NO: 26523 - protein, 114 aa, Zea mays
  misc_feature: Ceres CLONE 1399032-F
  misc_feature (10)..(10): Xaa is any aa, unknown, or other
  misc_feature (11)..(11): Xaa is any aa, unknown, or other
  misc_feature (56)..(56): Xaa is any aa, unknown, or other
MQKGRVLSLXXMAKELPARRGSGFRDEFLDDDFFLQEEKGGVPAKTKTPEEKGDEXLFQPGGGFFLGGGRGTSPLKRPKVIPPPPKHIWGAWSFSGRETHRGGGKKKFSPPSSK

SEQ ID NO: 26524 - DNA, 720 bp, Zea mays
  misc_feature: Ceres CLONE 1399036-F
  misc_feature (196)..(196): n is a, c, t, g, unknown, or other
  misc_feature (240)..(240): n is a, c, t, g, unknown, or other
  misc_feature (266)..(266): n is a, c, t, g, unknown, or other
  misc_feature (302)..(302): n is a, c, t, g, unknown, or other
  misc_feature (326)..(326): n is a, c, t, g, unknown, or other
aagctggagctccccgcggtggcggccgctctagaactagtggatcccccgggctgcaggaattcgcacgagaccattacctagaacatcctaatcgaaaaagagcgagctagaagcctagaaccggcaggaagccagacgagcggagccaccacgcgtgagctgcaacgtaggcggcgggggcatgccgggccgnctggcggggcgaggcgaaggccgctgctaggcgaagtggccggngccgggaaacggggcggaaggcgtcnatggcggtcgtggcgcgctgctgctggcgtgcccgncctgctcctgctctggccctcggngggctatcgctgccgggggcctcgacggtccggaggacgcgggggggggtctcgttttcggcccccgttcgggtttccgaaatccgcctttaaatcggggtaaaagaagcggggggaacaaggcgaacccctgccacgaagtgtttttttggccacccccccgctccctggacacaccttctctccccagggaaaagggagcccttttgtatcccttgggaaaacccctaaagcaaaaagccccccggtctttgttccacaacgggggggaaaaaaacaaagcgggggggcaccactcttagcgatgttttctcaaaagaggggcccacaaaatatttcgcgtaatcggggaaaagggggcccaaacccccccttctctgcgcggggggggggg

SEQ ID NO: 26525 - DNA, 706 bp, Zea mays
  misc_feature: Ceres CLONE 1399037-F
  misc_feature: Encodes the peptide sequence at SEQ ID NO. 26526
  misc_feature (605)..(605): n is a, c, t, g, unknown, or other
  misc_feature (689)..(689): n is a, c, t, g, unknown, or other
aaagctggagctccccgcggtggcggccgctctagaactagtggatttcccgggctgcaggaattcgcacgagaccattacctagaacatcctaatcgaaaagtctcttttccagttccagacctgaagaaactccgaccggtggcggcaggatctgtgccgcgatggcgacgtcgaacaccgctcggatggaggacggcggcggtgacctgcggagcaccatcaagaagtggaacatcatctaccctgtctacctcaactccaagaagacggtcgccgagggccgccgcatcgccgctgccaaggcctgcccggaccccacctgcatcgagatcgctgactgctgttcgcacctcaagatcccccacgccatcgagttggataaggcgtaccctcgggatttcttccaggtggggagggtcagggtgcagcttaagaaagatgacggctcccccgtcaatcctgctattaaaacaaagaagcagctgatgatccaagtagcagagctagttcccaagcatcacggaaggacaaagaagcaagagttcaatttgaggaaacctccatccttccactatgatttgcttctcttaggcttcctgacngtgatgtgtggccttattggtatccctccatcaaatggtgtcattcccacatcacccatgcacacgaagagtttggctactctncagcatcagctgcttcg

SEQ ID NO: 26526 - protein, 180 aa, Zea mays
  misc_feature: Ceres CLONE 1399037-F
  misc_feature (24)..(120): Pfam Name: SRP19 Pfam Description: SRP19 protein
MATSNTARMEDGGGDLRSTIKKWNIIYPVYLNSKKTVAEGRRIAAAKACPDPTCIEIADCCSHLKIPHAIELDKAYPRDFFQVGRVRVQLKKDDGSPVNPAIKTKKQLMIQVAELVPKHHGRTKKQEFNLRKPPSFHYDLLLLGFLTVMCGLIGIPPSNGVIPTSPMHTKSLATLQHQLL

SEQ ID NO: 26527 - DNA, 672 bp, Zea mays
  misc_feature: Ceres CLONE 1399041-F
  misc_feature (383)..(383): n is a, c, t, g, unknown, or other
tggagctccccgcggtggcggccgctctagaactagtggatcccccgggctgcaggaattcgcacgagaccattacctagaacatcctaatcaaaaaaaattcatcttcttcgtcttcatcgcagcatcggcgctccatcttctgctccctcccccacttcgtgctcgggttccatcttccgctccttcccccactcgcggtcggcacgcaggctcggccggcgtcagcggctccccatcccgccagtacaggaagagggccgccgcttggagctcgcgggaggtagcgtcgccgcccgcgcatggaggtcccgaatggctgaatcctgacccgctgctggagagtctcgcgcctaaatcacatcatattgagcttctcgccntttggatccgtcttattatttgctcacactgaagaattagtttgcactttggaggaaaatgagtgggtgctcaaaggagggtgctcgaggaaaggtagtcacttcacaaccaacaaaacgccctttgggatgacagcagctttggaattcgaggcctggggaaaattaattccggccggggggagggggattcccggggctcttcggaaaaaggggggaaaatttggaaaaattccacggggggggattcccggggagaaaaaaagcccctttttaaacgggggggggg

SEQ ID NO: 26528 - DNA, 708 bp, Zea mays
  misc_feature: Ceres CLONE 1399042-F
  misc_feature: Encodes the peptide sequence at SEQ ID NO. 26529
  misc_feature (431)..(431): n is a, c, t, g, unknown, or other
  misc_feature (470)..(470): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (591)..(591): n is a, c, t, g, unknown, or other
  misc_feature (672)..(672): n is a, c, t, g, unknown, or other
  misc_feature (673)..(673): n is a, c, t, g, unknown, or other
aaagctggagctccccgcggtggcggccgctctagaactagtggatcccccgggctgcaggaattcgcacgagaccattacctagaacatcctaatcgaaaaattacaaccgaccaacgcgctttgcaacgcctccgctgcaatcagcccccgcggcgagattgccctgcccctgagtgctagttctcgccgttacgtaaggcttcttggccttgcgtcctccgtctttcgttgctgatacatcgaggtattaaagaagctgcctggttccgggcagcagaggtcgccgccgcctgcagcaatggccgacttctcctggctcacggtgcttggcttcctattcctcaccttcaactcaggcatggcgatttatcggtccaacggtgacgccggctccgtcgctttcgtcgtggtatcttatctcgacctgntggccctgttcgcctgcttgcgctactacgagcagttgnatcagcagcactcccaaaagcgcgcgagggtcaagggcatgggttggagcctcacgaccctccttactatcatgtnnncagtacaggtggctgagattatgcccctgccagtcaaacttgntgtctggtcgatggcagccgctaccacctgtggcggctacacgctttcttcgtcacagcgagaagtctgtcatgccagcgnngcgacactgcccgccgcgaccaggatgcatcctcc

SEQ ID NO: 26529 - protein, 135 aa, Zea mays
  misc_feature: Ceres CLONE 1399042-F
  misc_feature (44)..(44): Xaa is any aa, unknown, or other
  misc_feature (57)..(57): Xaa is any aa, unknown, or other
  misc_feature (82)..(82): Xaa is any aa, unknown, or other
  misc_feature (83)..(83): Xaa is any aa, unknown, or other
  misc_feature (97)..(97): Xaa is any aa, unknown, or other
  misc_feature (124)..(124): Xaa is any aa, unknown, or other
MADFSWLTVLGFLFLTFNSGMAIYRSNGDAGSVAFVVVSYLDLXALFACLRYYEQLXQQHSQKRARVKGMGWSLTTLLTIMXXVQVAEIMPLPVKLXVWSMAAATTCGGYTLSSSQREVCHASXATLPAATRMHP

SEQ ID NO: 26530 - DNA, 804 bp, Zea mays
  misc_feature: Ceres CLONE 1399043-F
  misc_feature: Encodes the peptide sequence at SEQ ID NO. 26531
  misc_feature (16)..(16): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
ggtttttcaccatacncaacnnnaccccccccaccccccaccacccgtgggggccagagctggactccccgcggtggcggccgctctataactagtggatcccccgggctgcaggaattcgcatgagaccattacctagaacatcctaatcaaaaaacggggccgccgggcggactcttctgacttggcaaccgccgcgcagcgcgacgagcgccacctgcttgctgccgcgtgcctgcgtgcgtgtgcgtccaccactgaccccgcgcccgcccgccgcccctgcccctccactccacttgctcactcgacggctcgtcgcggaccgcttcccccccggccaagggatggacgcgcttcgcctacggccgtccctcctccccgagcggcccggcgcgggccgcccgcgagatcattttctaccaccatggtgtgccatacaacgaaatggggaaggacgaatttgcttatctagccaaaggaccccacggccctacctaggcatcgaccatggcaaactcttccaatgggaaaccccccctattcgcaggatataaggatcggggaatacacacaactgctggccaagtgctcgcgggggcaaacagtcttcccgtcctgaaaccccgaaaacaccacagatccctacacacccacactgcgaaatagcaaccaaccaaccgcccctcccagcatgcccatcccatccccccgctccttcccccgcccccaccgctacctcgtccgtcagggacacaatgcatgtaaaagtactagctgcccccagtgtacccccatacctta

SEQ ID NO: 26531 - protein, 69 aa, Zea mays
  misc_feature: Ceres CLONE 1399043-F
MDALRLRPSLLPERPGAGRPRDHFLPPWCAIQRNGEGRICLSSQRTPRPYLGIDHGKLFQWETPPIRRI

SEQ ID NO: 26532 - DNA, 671 bp, Zea mays
  misc_feature: Ceres CLONE 1399045-F
  misc_feature: Encodes the peptide sequence at SEQ ID NO. 26533
aaagctggagctccccgcggtggcggccgctctagaactagtggatcccccgggctgcaggaattcgcacgagaccattacctagaacatcctaatcgaaaaaagtgccacgtgtaccatacgtcgcgaaacatctcgacccaaccgacgccccgcctcttaaaacggcgaccttcctccatggccaaatcgttgtcctcctccgcttccctccaaatccaccctggatccaaccccgattttccccagcagaagcaaacccgagcaaattgagcgcttgcagcttcacccggcgaagcagaatcgaatcggagccgctcgccactccgcgatggggatcctcctccggtccctcctcgtcgcctcgctcgtcctcagttcgctcgtcttgcacgtcgcagcggctaaaactatagaaccttacaaggttctaggagttgacaagaatgctagccaacgggatattcagaaagcctttcacaaactttctctaaaataccaccctgacaagaataaagggaagggcgcacaggaaaaatttgaagaaataaacaatgcatatgagattctatctgatgaagagaagaggaaaaactatgacctctacggggatgagaaaggtaaccctgaattttgggggtggaaattttggaaatcatggggggtctaac

SEQ ID NO: 26533 - protein, 112 aa, Zea mays
  misc_feature: Ceres CLONE 1399045-F
  misc_feature (29)..(90): Pfam Name: DnaJ Pfam Description: DnaJ domain
MGILLRSLLVASLVLSSLVLHVAAAKTIEPYKVLGVDKNASQRDIQKAFHKLSLKYHPDKNKGKGAQEKFEEINNAYEILSDEEKRKNYDLYGDEKGNPEFWGWKFWKSWGV

SEQ ID NO: 26534 - DNA, 747 bp, Zea mays
  misc_feature: Ceres CLONE 1399055-F
  misc_feature: Encodes the peptide sequence at SEQ ID NO. 26535
  misc_feature (594)..(594): n is a, c, t, g, unknown, or other
agagctggagctccccgcggtggcggccgctctattaactagtggatcccccgggctgcaggaattcgcacgagaccattacctagaacatcctaatcaaaaattgtagagcagtgcgacagagttccccgatcgaagcagattgaggtccactgtgctgtactgctgtgcgtcaatcatggaagcaatccaccttgcctacgtgctcgtcttcctcttgcccatcctcctcctccgtctccggcgccgcgggcctcctccagtcaagcggccacgaacaacgacggcccactgcccgcaccccagcccggtcctgggcaacaccctccacttcatccgcaaccgccgccgcttcttcgactggtacgcggacatgctccgcgccgcgccgtccggtgccatcgaggcgtgggggcccttgggcgcgggccacgccgtcaccaccgccagcccggccgacgtcgaccacctcctgcgctccagcttcgacaagtacgccaagggcgcgctcttccgcgacgccaccgcggatctcatcggcgacgggctcttcgccgccgacggccgcctctggagcctccagcggaagctggngtcgcacgccttctcgtcccgctcgctcccgcggttcaacgacggcgtcctcgacctgcacctgcggcgcccgtttcctgccgctcccggaaccccgcaaccaagggacgacggggtcccttggacccgcaatgaacgcgctttcgcccggat

SEQ ID NO: 26535 - protein, 189 aa, Zea mays
  misc_feature: Ceres CLONE 1399055-F
  misc_feature (139)..(139): Xaa is any aa, unknown, or other
MEAIHLAYVLVFLLPILLLRLRRRGPPPVKRPRTTTAHCPHPSPVLGNTLHFIRNRRRFFDWYADMLRAAPSGAIEAWGPLGAGHAVTTASPADVDHLLRSSFDKYAKGALFRDATADLIGDGLFAADGRLWSLQRKLXSHAFSSRSLPRFNDGVLDLHLRRPFPAAPGTPQPRDDGVPWTRNERAFAR

SEQ ID NO: 26536 - DNA, 674 bp, Zea mays
  misc_feature: Ceres CLONE 1399061-F
agagctggagctccccgcggtggcggccgctctagaactagtggatcccccgggctgcaggaattcgcacgagaccattacctagaacatcctaatcgaaaaaataattctagtattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaatcaatttcttcgtccgccttcgcccctgcttacgtccccgctactaaccctaggatcattctgtcttttctcgtttcttatccgactcttcttcgttttatgcctatcagttatgaggttgaacgccttcagaagcttctctactagattagtgtaaatagtagacttgttcgagtttagcttggctggaagaattagtctctggtccgtgtttatatctgctagcaataatggctgcgatgaacggagaggtattgggtgaatgtggaaggaacataaatagtctcaagagaaagcgggagagccccgctgcatatgctgctggcgtattctgcacctctga

SEQ ID NO: 26537 - DNA, 880 bp, Zea mays
  misc_feature: Ceres CLONE 1399066-F
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (541)..(541): n is a, c, t, g, unknown, or other
  misc_feature (735)..(735): n is a, c, t, g, unknown, or other
  misc_feature (880)..(880): n is a, c, t, g, unknown, or other
gggcccggccccctgcatcccttccgctggtgtggggggggnnngggcaaactggagctccccgcggtggcggccgctcttttactagaggatcccccgggctgcaggaattcgcacgagaccattacctagaacatcctaatcgaaaaaccttggcttgctatttccccaacaacctcctccctcttaaccgcggcgtgccgagtgcggcgggcgcggatggcaacggtcgcctccacctcccgctcccccggcgcgttcggcgccaaaacccctgccccatgccgtgggctgagcccgcccccggtcctgaccccgaaccccgcattcgcgaggtcttagccccgcaccccccgcctggcggagggcccgcgacgacctccacactgggagagcctgggctcgcaccagtcgccccaacccccgcgcgacggccggcggacaggaacccggcgccccacgatgcccccccacgctcctgcgccagccctgactgagccgaggacacgtgacctgccttcgaggcgatgcgccacaccgngaccagggcctgggccatccagagccgacgctgcagcctctccactccccgcctagtccacctggagcagccccccccggcccaaacggcccgcctcacgagacctttgcgggccctcctcgcggcgaccggccctcgctcccgcgacccgagggcacccgaatcccggggcaacccacacatacgccccaagnacccatagacagtagcaagcgggccgccccctttccccactcaccgccacagatcacgcccccaaggctgcctcccgccggccggcagcctccccgcgccgacccccagccgcgtcgcccacgcacgccgactcgcacctcgctn

SEQ ID NO: 26538 - DNA, 744 bp, Zea mays
  misc_feature: Ceres CLONE 1399068-F
  misc_feature: Encodes the peptide sequence at SEQ ID NO. 26539
  misc_feature (744)..(744): n is a, c, t, g, unknown, or other
agagctggagctccccgcggtggcggccgctctagaactagtggatcccccgggctgcaggaattcgcacgagaccattacctagaacatcctaatcgaaaaatccacagctcgcatccgatttccaatttcaaatccttcgatcgcgcagcgccgcccgccctctcgcagctctctccgatggcccgcacgaagcagacggcgaggaagtcaactggcggcaaggcgccgcggaagcagctggccaccaaggcggcgcgcaagtcggctccggccaccggcggcgtgaagaagccgcacaggttccgccccggcaccgtcgctctccgcgagatccgcaagtaccagaagagcacggagctgctcatccggaagctgcccttccagcggctggtgcgtgagatcgcgcaagacttcaagaccgaccttcggttccagtcctccgctgtcgccgcgctgcaggaggccgccgaggcgtatctggtgggtctctttgaggacaccaacctctgcgccatccacgccaagagggtcaccatcatgcccaaggacatccagctcgcgcgccgcatcaggggcgagagggcctgattgctgctctgtcttcctgtttctgtaatgtctgaactaggcgatggactctatcgcttcttgtcctgcaatcgtgtaccgatgttcttggcaaatcaatttggctgttatgaatgtgattcagtgatttgatttaaaaaaaaaaaaaaaagn

SEQ ID NO: 26539 - protein, 136 aa, Zea mays; identical to SEQ ID NO: 6923
  misc_feature: Ceres CLONE 1399068-F
  misc_feature (58)..(132): Pfam Name: Histone Pfam Description: Core histone H2A/H2B/H3/H4

SEQ ID NO: 26540 - DNA, 768 bp, Zea mays
  misc_feature: Ceres CLONE 1399070-F
  misc_feature: Encodes the peptide sequence at SEQ ID NO. 26541
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (25)..(25): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
nnnnnnnnnnnnnnnnnnnnccccncccggggnnnnggggggggggggaaagctggagctccccgcggtggcggccgctctagaactagtggatcccccgggctgcaggaattcgcacgagaccattacctagaacatcctaatcgaaaaacggttaaagttgtggcaggaggagtgggggcgcgggagagatgataaggatggcggcagcgtctcagccgccatcgtcagccttgcggatgcacgggtgcggcggcgcggcttctgcgtcgtccgcgcccgtgcgcctcttcacggagtcgcggggtagagtcgtggcgtcgattgggaggggcaggaggcggaggcgcgccatctcgtgctgctcgtctccagacgcagatggccctcgccccgccgcgccaccgacctccgcagcgccttccgacgggtcgatacagctctattcccagatcgagagggtaatcacggaggcggcaaagcagtcccgggaaggctgggggtcgactggagattggaccgaagtggagggatcatgggtggtgagaccgaagtccttggagccatcattttggtggccactttggtggagggaatttttggtggaggccgctcccccagatcacatagccgcgttcttccctcgagggtccccgccgaacagggggagcctttgggtggattggctacgcccctgtagtgcaagacggctttttggaccaattgtctttccagttggccaggatgaagggcctccaatctttaaag

SEQ ID NO: 26541 - protein, 36 aa, Zea mays
  misc_feature: Ceres CLONE 1399070-F
  misc_feature (4)..(4): Xaa is any aa, unknown, or other
  misc_feature (5)..(5): Xaa is any aa, unknown, or other
PPGXXGGGGKLELPAVAAALELVDPPGCRNSHETIT

SEQ ID NO: 26542 - DNA, 556 bp, Zea mays
  misc_feature: Ceres CLONE 1399071-F
  misc_feature (481)..(481): n is a, c, t, g, unknown, or other
aaagctggagctccccgcggtggcggccgctctagaactagtggatcccccgggctgcaggaattcgcacgagaccattacctagaacatcctaatcgaaaaataaagattactcatagattaaagtagggtttggacgtctgcctgtccatttcggcgtctgttcttagcggccgacaagcggaatctggacaagtcccctgcttcaacccatcccctctcatcgattcattgcccacaaaggcagctgaattgctccacagcgtttggaatggggagaaaattgggattccggacccccacccgatttaaaatttggccgtttttcgggccccaccccgcgggtttttcaaatttccccgggggggggcccccccccccacaaaacagccgcccaaaaccccccgggggggggggggcccccaaaaaaaaaaaaaggggggggggggggggggggggggggttaatttttttatttttnggcgccgcccgtcttttctttttttgggggggggggggggggggggtggttgtttggggggggggggggatcccc

SEQ ID NO: 26543 - DNA, 562 bp, Zea mays
  misc_feature: Ceres CLONE 1399080-F
  misc_feature (304)..(304): n is a, c, t, g, unknown, or other
  misc_feature (313)..(313): n is a, c, t, g, unknown, or other
  misc_feature (314)..(314): n is a, c, t, g, unknown, or other
  misc_feature (327)..(327): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (528)..(528): n is a, c, t, g, unknown, or other
  misc_feature (529)..(529): n is a, c, t, g, unknown, or other
aagctggagctccccgcggtggcggccgctctagaactagtggatcccccgggctgcaggaattcgcacgagaccattacctagaacatcctaatcgaaaaagaaaatacgcacctgctcctcactcttctttatatttttttctccatttggcaacttttgcttgtcgttcatgtatatgcatgaccctttcacacatatgatcagaagataagcacatgcaagacgatctcgcgtggatatgatgcatggatcagacctaacctctatatcatcaccaaacgctcgtagatgatgctatacnattccatgnnataaatatatatnagtaaaaaaaaaagaaccgtacgggcatacttaaaattagaattaattggctgcccatggacaaactttgcttggaaaggaaaacttggggaatccccccctgaaacgggagggccccaatttcgggccattatgggggaaaatcccccgggggggaggcggggctttttaaaacccccccccctccccccnnnnnnnnannaaaaaaaaaaagggggggggcacacaaacaaaa

SEQ ID NO: 26544 - DNA, 763 bp, Zea mays
  misc_feature: Ceres CLONE 1399082-F
  misc_feature: Encodes the peptide sequence at SEQ ID NO. 26545
  misc_feature (360)..(360): n is a, c, t, g, unknown, or other
  misc_feature (404)..(404): n is a, c, t, g, unknown, or other
aaagctggagctccccgcggtggcggccgctctagaactagtggatcccccgggctgcaggaattcgcacgagaccattacctagaacatcctaatcgaaaaagatcagttagtagttcaccagagttcacacaaaaatcacaagcaagcagtcgcgtgtgtagctcgcaacaatggcgacgaaccccggcctcttcaccgagtggccgtggaagaagctcggcaacttcaagtacctgctgctggcgccgtgggtggcgcacggcggctaccaagcggcgaccaaggggtggagggcggccgacctggggtacgtggccatcctcccgtcgctgctcctccgggcgctgcacaaccagncgtggatcaccgcgtcccgcctgcagagcgcgcgcggccggcgncaggtcgtggaccgcggcatcgagttcgagcaggtgggacggcgagcgcaactgggaacgaccagatcctgctcaggggaatcctccctgtacctgggcttcacctaactggcgggggggcaacaacctgccccttgggggggcgggaagggccccccgctttattgccttggtggaacccgggcccgtagagttcctttaaaatgggttgaaccggggggttgaccaaccatttcttttattcccgggaaacctttcccaacaccgcgcctctttttggacggaggagaaaaccccccggaatcccttattttggggggggcccgggggggaaaaaataattttttccccccccattg

SEQ ID NO: 26545 - protein, 112 aa, Zea mays
  misc_feature: Ceres CLONE 1399082-F
  misc_feature (63)..(63): Xaa is any aa, unknown, or other
MATNPGLFTEWPWKKLGNFKYLLLAPWVAHGGYQAATKGWRAADLGYVAILPSLLLRALHNQXWITASRLQSARGRRQVVDRGIEFEQVGRRAQLGTTRSCSGESSLYLGFT

SEQ ID NO: 26546 - DNA, 711 bp, Zea mays
  misc_feature: Ceres CLONE 1399084-F
aaagctggagctccccgcggtggcggccgctctagaactagtggatcccccgggctgcaggaattcgcacgagaccattacctagaacatcctaatcgaaaactgctagtgctcagtcctcgccctctcgctttccgagggagcctttggctttcccctccgcccgccagccattaatggcggcggcatctccatccactcccccctcgcccccctcccactgctgctacttctagaagcgctggtggcaggacatgcggcatcccggccgctggcgctggagcgagagttggatggtggtggtgttcagcccccctccctcttcaggattagggaggagcgatccgtgcaggccaacgcggcgtgcgtgacccagaaagggaaaccgccgccttttttctcttctgccgccccgcttttccaatccctcctcaacctcatccgccccgcccgcaccatcaccaaaaaggaccccggcattcttcttcctcgtctcctctgcgcctgcttgacgtttgctcgtgctcccacacctcctttctgattcagccagggattccttccgcggagcgacgcgtcgccatgggaaaactggctggcgccgccagcatcagcttccgacagagcccctcccccgggggccctcctccccccccagaggagcggggcccaacaattttagaaaaaaaaaaaaaaggcgggggggtcaca

SEQ ID NO: 26547 - DNA, 830 bp, Zea mays
  misc_feature: Ceres CLONE 1399087-R
  misc_feature: Translation starting site: 162
  misc_feature: SWISSPROT Homolog: EC 4.2.1.92 Hydroperoxide dehydratase
ttccgattgggtaccgggccccccctcgaggtcgacggtatcgatattttttttttttttttttatttgcacaagtgttttttttattaccacaacggccgccggcggccagcggccggccgggaggaagagacaccgatcgaagtcgaacacagacgagcatgtggatgacgaggagggcctactcaatttactttattgcttggccggcgccggcgacgtcgcacgccaccgatggatcctatacagcgcactcactgctgcgctccggcggcggctgctgcctgcgccacgctcggcgacgcctggcgcttgacgagcttggtgaaggaggtgccctccacctcgaagtcgtcgtagcgccggaacagctcggccagcagcatgcacgccgtgtccaccaccacctccttggcggcgcactgcttgttcccgggcccgggctgcgccgtctccggcccgttggaccagaagaggtgctgcagcagcctggcgccgtcgtcgccgaggaagcgttccggcacgaactcctcgggccgctcgaacacctcggggtcccgcatcgccagcggctggtacccgcacagcacctcgcccgcggacacctggtacgcggcgccgccgtgggagcgcagcacgaagtccctgcgcgcgcgcccgaactgcagcggcacgggcggctgcatccgcagcatctcgtacaccgtcgaccgcaccagcggcatgccctcgcggacggtggcgaacccgaactcgccgtctttgccaccatggagagccgcacctcgtcacgcatgcgctcgcgcagcgcccacgcgacgccgacttgg

SEQ ID NO: 26548 - DNA, 528 bp, Zea mays
  misc_feature: Ceres CLONE 1399094-F
  misc_feature: Encodes the peptide sequence at SEQ ID NO. 26549
  misc_feature (342)..(342): n is a, c, t, g, unknown, or other
  misc_feature (375)..(375): n is a, c, t, g, unknown, or other
aaagctggagctccccgcggtggcggccgctctagaactagtggatcccccgggctgcaggaattcgcacgagaccattacctagaacatcctaatcaaaaagatctacctgtctgttcttcgatcgagtctgagagatttgggaggaggagggaaacaaagcgaaagagcccatcttttttgtctttttggttcggtttcgtggttgcttcttttggaccccgcggaggagcccaccgtttctacaaaaacccaatctttgctgccttctcagcggtcgagatcgataggtttccagatctgaggctccgtgttctggctgtgagatcggaggcgcagcantccgagcacgcagctagtaaggaaagtatcccnagaaaaggtgcagatttttgctgggggggcaacgaagcgaggaaccaggttactggcaaaaggaaaagggccaaagggggggggaaggggcgcccggaaaaatgagggaaatgcctttccaggttcctggatgggatttaatttgaaagcttt

SEQ ID NO: 26549 - protein, 159 aa, Zea mays
  misc_feature: Ceres CLONE 1399094-F
  misc_feature (114)..(114): Xaa is any aa, unknown, or other
KAGAPRGGGRSRTSGSPGLQEFARDHYLEHPNQKDLPVCSSIESERFGRRRETKRKSPSFLSFWFGFVVASFGPRGGAHRFYKNPIFAAFSAVEIDRFPDLRLRVLAVRSEAQXSEHAASKESIPRKGADFCWGGNEARNQVTGKRKRAKGGGKGRPEK

SEQ ID NO: 26550 - DNA, 731 bp, Zea mays
  misc_feature: Ceres CLONE 1399097-F
  misc_feature: Encodes the peptide sequence at SEQ ID NO. 26551
aaaagctggagctccccgcggtggcggccgctctagaactagtggatcccccgggctgcaggaattcgcacgagaccattacctagaacatcctaatcaaaaaatcctctttcctttggacccctaactagttagaactactgttgctcctccgattaggtcttctagcagctagacagacaagcaagaaccatccctccccctacgggttaccgctgctactcatggtggcgcacactgactcctggtgccctcgggtatgatcctgacatgaacaggccgatgaggatgagctccctgttcatcaaggacaagctcttcagacacccggatctcctttgccaaggactgcacccactagcgtctacgtcaaccaacagcatatgctatgtggccgtgcttatctgcaccttccaagactaatccaactgagcagtaactgatagaacgactctagtggaaagtgaatgaagaatcgtcgacatctcatctctctcatgcagactagatcataaccatgatatatgcggagcacaacatatgttacacccacctcgagaaatttgcaggggacaccatcgacgcgctgaccaagcacttcttcatcaggctcacgaaggcctacaccacgaccgaacaggaagaagatgcatatacagatggattgcgacggtcactaggtcgagacgatgaggcacgacaccggtaataccctgactgtgatgagtgaa

SEQ ID NO: 26551 - protein, 63 aa, Zea mays
  misc_feature: Ceres CLONE 1399097-F
MIYAEHNICYTHLEKFAGDTIDALTKHFFIRLTKAYTTTEQEEDAYTDGLRRSLGRDDEARHR

SEQ ID NO: 26552 - DNA, 741 bp, Zea mays
  misc_feature: Ceres CLONE 1399098-F
  misc_feature: Encodes the peptide sequence at SEQ ID NO. 26553
  misc_feature (343)..(343): n is a, c, t, g, unknown, or other
  misc_feature (344)..(344): n is a, c, t, g, unknown, or other
  misc_feature (465)..(465): n is a, c, t, g, unknown, or other
caaagctggagctccccgcggtggcggccgctctagaactagtggatcccccgggctgcaggaattcgcacgagaccattacctagaacatccgaatcgaaaaatcgcagaaattctccgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaaggccaaggcggagaagcggctacctgcgggcaagtccgccggcaaggaggcgnncgacaagaaggggaggaagaaggcgaagaagagcgtggagacctacaagatctacatcttcaaggtctccgttctcccccaattcgccttcacctcgccgcttcctccttgaccgccaccngttgacgtcgtccttccggcgaggtagctcgccggaagacctcacctggacttttccgacgcaccctccacacactctttaaccctccggaatggccgcctgcttctagctcgtcgacgccccaatctccgcttgcttcctcgacagccccatccgcctcttctcgctctcgctacggctcctctgcctgttcgccatggcgatccgcatcaccgtctcctactccggctacgtggcgcagaacctcgccgcgtcgctcggccaccgcttctcctc

SEQ ID NO: 26553 - protein, 88 aa, Zea mays
  misc_feature: Ceres CLONE 1399098-F
  misc_feature (52)..(52): Xaa is any aa, unknown, or other
MAPKAEKKPAAKKVAEEEPSEKAAPAEKAPAGKKAKAEKRLPAGKSAGKEAXDKKGRKKAKKSVETYKIYIFKVSVLPQFAFTSPLPP

SEQ ID NO: 26554 - DNA, 700 bp, Zea mays
  misc_feature: Ceres CLONE 1399100-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (126)..(126): n is a, c, t, g, unknown, or other
  misc_feature (127)..(127): n is a, c, t, g, unknown, or other
  misc_feature (304)..(304): n is a, c, t, g, unknown, or other
  misc_feature (327)..(327): n is a, c, t, g, unknown, or other
  misc_feature (333)..(333): n is a, c, t, g, unknown, or other
  misc_feature (381)..(381): n is a, c, t, g, unknown, or other
  misc_feature (382)..(382): n is a, c, t, g, unknown, or other
  misc_feature (398)..(398): n is a, c, t, g, unknown, or other
  misc_feature (404)..(404): n is a, c, t, g, unknown, or other
  misc_feature (406)..(406): n is a, c, t, g, unknown, or other
  misc_feature (425)..(425): n is a, c, t, g, unknown, or other
nnnnnnnnnnnnnnnnnnnnnnnnnnnnnnnnnnnnnnnnnnnnnggggggggtggnnnnnnnnnnnnnnnnnnnnnnnnnnnnnnnnnnnnnnnnnnnnnnnnnnccaaagctggggctccccgnncggtggcggccggctctagaactagtggatcccccgggctgcaggaattcgcacgagaccattacctagaacatcctaatcaaaaaacatcgattttcctccggaatcgtaacctcagaaagccaaatctcattctccggcgctcaggcccacccaagcgtcgactctcccgatccnatcggtacctcctagttcctcgnccgcgntagcgccgtcgggcgaacagcggtgacttggcgagggcgcttgggcgnncgacatcatccactangatggnanggtgagcaaagaccggggnttgggtcttggtcaaaaccatggggggcctctggaagactactaacatccccaataaactttctgaaagccgggggcccaaaaggaccctgtgtgaattatgggggaacccggggcccggttgggaagggtcctccccctcccggaatctgggggggccaacttgggaaaaggtttttaatccaaaaaaatttcgggggggtttcttcaaggaaaaacagggtttttttttcctccccaaaaaagggggcccccaaaaaggggttttggcccctt

SEQ ID NO: 26555 - DNA, 734 bp, Zea mays
  misc_feature: Ceres CLONE 1399101-F
  misc_feature: Translation starting site: 221
  misc_feature: SWISSPROT Homolog: EC 1.11.1.6 Catalase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (29)..(29): n is a, c, t, g, unknown, or other
  misc_feature (31)..(31): n is a, c, t, g, unknown, or other
nnnnnnnnnttttttnnnnaaaaaagaangnggtggggacgaaccacaaaactggagctccccgcggtggcggccgctctagaactagtggatcccccgggctgcaggaattcgcacgagaccattacctagaacatcctaatcgaaaaatgtaaaccacactccactccaggactgaacacttgattgattcagtaggtagctagctagctgaatcacaatggatcctaccaaggtccggccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgggagcgcatcccggagcgcgtggtgcacgcgcgggggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcggggggtccccggagacgatccgcgacccgcgcgggttcgccgtgaagttctacacccgcgaggggaactgggacctgctgggcaacaacttccccgtcttcttcatccgcgacggggtcaatttccccgacgggatccacgcgttcaagcccaaccccgcggtcgcaggggggggagtactggg

SEQ ID NO: 26556 - DNA, 718 bp, Zea mays
  misc_feature: Ceres CLONE 1399102-F
  misc_feature: Encodes the peptide sequence at SEQ ID NO. 26557
  misc_feature (510)..(510): n is a, c, t, g, unknown, or other
  misc_feature (533)..(533): n is a, c, t, g, unknown, or other
  misc_feature (544)..(544): n is a, c, t, g, unknown, or other
  misc_feature (565)..(565): n is a, c, t, g, unknown, or other
  misc_feature (603)..(603): n is a, c, t, g, unknown, or other
  misc_feature (659)..(659): n is a, c, t, g, unknown, or other
aaagctggagctccccgcggtggcggccgctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggccgggacagctgactagctgagaggcatggggatggacgccggcggcggcaagctgccgtacagctacgccggccagcaggacggcgggaagctggtgaagagcgtcagccgcgtggagccgcgcaggttcggcctgggcctcgtggcgggcttcctcgtcgtcacctgcgcctacttctccacgncaagttcgacgccatccagatcngcatgaccagncgacccgtctccagcaatgcngctggcgtcggagtcggctcgctgggagtgggcgccgncgccgccgacacctcaacggctccaggaagggatagatttgggcgcatgtccatgncccagaggggaacgaggccaagccctcaaaaagacggcgcaaagcttctccacttcggg

SEQ ID NO: 26557 - protein, 62 aa, Zea mays
  misc_feature: Ceres CLONE 1399102-F
  misc_feature (54)..(54): Xaa is any aa, unknown, or other
MGMDAGGGKLPYSYAGQQDGGKLVKSVSRVEPRRFGLGLVAGFLVVTCAYFSTXSSTPSRSA

SEQ ID NO: 26558 - DNA, 832 bp, Zea mays
  misc_feature: Ceres CLONE 1399103-R2
  misc_feature: SWISSPROT Homolog: EC 3.1.2.15 Ubiquitin thiolesterase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (155)..(155): n is a, c, t, g, unknown, or other
nnnnncccgattgggtaccgggccccccctcgaggtcgacggtatcgataagcttttttttttttttttttaaatcacttacgtttttgtgcatgcttcacataaaatggttactggtatattacaccccataaaccaagggtgttaggaggganttgagggggattaaatttcctaacagtcaaaattatcctcaatctctccaatccttcctaatcactttgatttagggatgaaacagataaggtctaacgctgcacaattccattattggctcggcacacgcacaaaagtagagagtcgtatgatccctaattcatcttggacgatccaagaatggcaacatctgcctcgattaagcagctgcccttcacaaggtaccagtccttcacagacttcgtcgccatgaaatttgaccatccccagccttcgccctccgtcgcttggaactggcaccggcctgtcattgttttgcgattgctggtcaccttgtctttgatggacagactgacttctacaagcaccccagagttctggagggaagcgtctccgtttggcttggccatatgcaggtagagggagagaaattccttatcaccgtcgatgccagtgccagaagggtacatggtcaggtaccatttgtgtccaccgatctcaaactccggtgagtagcaccgccccttcaggcttaagaagtcatcgatgacccaggtgtaagcctcccgggcactacagaagccatttctcttctgaacatgcagcgttactgaaccgtccttgaccttagcagtggtgagcttgacgagctccactccgaagaacagctgtcacc

SEQ ID NO: 26559 - DNA, 867 bp, Zea mays
  misc_feature: Ceres CLONE 1399103-R
  misc_feature: SWISSPROT Homolog: EC 3.1.2.15 Ubiquitin thiolesterase
  misc_feature (1)..(1): n is a, c, t, g, unknown, or other
  misc_feature (2)..(2): n is a, c, t, g, unknown, or other
nngggcttacgtttttgtgatgcttcaataaaatggttactggtatattacaccccataaaccaagggtgttaggagggattgagggggattaaatttcctaacagtcaaaattatcctcaatctctccaatccttcctaatcactttgatttagggatgaaacagataaggtctaacgctgcacaattccattattggctcggcacacgcacaaaagtagagagtcgtatgatccctaattcatcttggacgatccaagaatggcaacatctgcctcgattaagcagctgcccttcacaaggtaccagtccttcacagacttcgtcgccatgaaatttgaccatccccagccttcgccctccgtcgcttggaactggcaccggcctgtcattgttttgcgattgctgaccaccttgtctttgatggacacactgacttctacaagcaccccagagttctggagggaagcgtctccgtttggcttggccatatgcaggtagagggagagaaattccttatcaccgtcgatgccagtgccagaacggtacatggtcaggtaccatttgtgtccaccgatctcaaactccggtgagtagctccgccccttcaagacttaaaaatcatcgatgacccaggggtaaaccctcccgggcactacagaagccatttctcttctgaaactgcaacgattactgaaccgatcctggaacttagcctgtggtggagctttgacaaggctccccctcccttaaaaaaaagcttgttcaccaaacgaatgaaaaccccggaggaaacggtttccctttgagtagtgcttcaaagaagggaaccctgccccttgagaaatcccgggggaactccctggg

SEQ ID NO: 26560 - DNA, 567 bp, Zea mays
  misc_feature: Ceres CLONE 1399106-F
  misc_feature: Encodes the peptide sequence at SEQ ID NO. 26561
  misc_feature (315)..(315): n is a, c, t, g, unknown, or other
  misc_feature (332)..(332): n is a, c, t, g, unknown, or other
  misc_feature (391)..(391): n is a, c, t, g, unknown, or other
aaagctggagctccccgcggtggcggccgctctagaactagtggatcccccgggctgcaggaattcgcacgagaccattacctagaacatcctaatcgaaaaatccctcctcctaactccaaactacccactggttcgactcgcgttcgcatcgcaagcagcagcgttccatcgaggcaatggcggtgatggccgaagtagtgtcgaccaccggcgcggcgctccggagcccggcctcgcagcagccggcggcggcgggcgcggcgaagggcaccgacgctgagaagctccagttcatcgaggacatgacctccnacgtggacgccgtgcangagcgcgtgctgggggagatcctcgccccgcacgcggacacggagaacctccgccgggnagggtgggggcctcgccggggggtagggaacggggcaactttccggggcagggggccaatggggaaccttaaaagaaccttgaacccgtaaatttcgggggatttcccccaaaaggggaacccgctcccccccctcctgtgggggggggggacccccccggttccctcaaaattcc

SEQ ID NO: 26561 - protein, 100 aa, Zea mays
  misc_feature: Ceres CLONE 1399106-F
  misc_feature (46)..(46): Xaa is any aa, unknown, or other
  misc_feature (51)..(51): Xaa is any aa, unknown, or other
  misc_feature (71)..(71): Xaa is any aa, unknown, or other
MAVMAEVVSTTGAALRSPASQQPAAAGAAKGTDAEKLQFIEDMTSXVDAVXERVLGEILAPHADTENLRRXGWGPRRGVGNGATFRGRGPMGNLKRTLNP

SEQ ID NO: 26562 - DNA, 842 bp, Zea mays
  misc_feature: Ceres CLONE 1399114-R
ttgggtaccgggccccccctcgaggtcgacggtatcgataagcttttttttttttttttttggactcccaaaaacctatttgccattatgtcttataatttgtgtcaatactcatgcaacatgtcatacaggacaggaaccgctttgacaaaaaccaacacattccctatcttccaaggttcttttcttctacctcatcaaataggtaaaacaatataattcattcatgctatattggaggcaaaacccaactcccgacaacacctgcgacttcatgcctaccaccagaggcggtgggagcaagagcccaaatgatccaaccggctgaccttgaagactgaccacttccatgcagcaccactggtgatgcagcacaagaactgaccctgctgactgggactgacatgacaaacacctgagaccagaccaatgggaccgaatcaaggttttggaggacgacgccactaccccaactctgactagccccaaccactaggccaaggcacaatggcacagccgccattccaaatgggcatcttcagccgaagttgaatccacctgatggaacagagggctggttcccaaagttgaagccattctggggattgtcgccagagggcatggcatcatcttcctcctctagccagtaagattcgagcatcttgacagccttctcatatatctcagtgttgtcatggctctgtaggttctcaatcttgtccaggccctcagcatcatcaatcatctgtgcgtaaacattgacatcgcctgcaccaagatttttctctgcctcgccaactttcaggatgttctcaagaaccttcaagcaaactgttacaatt

SEQ ID NO: 26563 - DNA, 753 bp, Zea mays
  misc_feature: Ceres CLONE 1399114-F
  misc_feature (703)..(703): n is a, c, t, g, unknown, or other
agagctggagctccccgcggtggggggcgctctatactagtggatcccccgggctgcaggaattcgcacgagaccattacctagaacatcctaatcgaaaaaaataaaccaatacaactgactcgccccctcctaccacaaacaagtgtagtgtaccgcctctacatatcggacatgtcgcagattgaattggcgaaggggtcccgtgacggccaatactccgagcaagaaccagagtcgcagccgcatcgtaagtgggtggacctcttctccgttgccgtacctagacaaagaggacgatcggagccaggacatcgccctctgctactccaccgcccaacgtcggggctttctcatgcacctcacccggaaaacggaccacatgtgcagcgccttctcgcagaaaggagagcacccccacaaaagacgcctctggtgaatccccctcgcctatgtgatattcttctgcgagcccttcacgcctgagctccggttccccgagctgtgcttcctaccgcttcccgcggactgccacatggactgatacgtcttcatccagccaacaatgagggaccctcatcaaccaacgagagtgccgcccgacctgcaaagggcaaagtgagctgtcggcgaaattcgctggccctcgattacgaccaggcgctccttcaacaaaggacgacccccccgccggaggccgggngtagcccccaccggcccccatagttgaacgcctagaccaccacctcgggg

SEQ ID NO: 26564 - DNA, 831 bp, Zea mays
  misc_feature: Ceres CLONE 1399114-R2
gcttatgtcttaaatttgtgtaatactcatgcaacatgtcatacaggacaggaaccgctttgacaaaaaccaacacattccctatcttccaaggttcttttcttctacctcatcaaataggtaaaacaatataattcattcatgctatattggaggcaaaacccaactcccgacaacacctgcgacttcatgcctaccaccagaggcggtgggagcaagagcccaaatgatccaaccggctgaccttgaagactgaccacttccatgcagcaccactggtgatgcagcacaagaactgaccctgctgactgggactgacatgacaaacacctgagaccagaccaatgggaccgaatcaaggttttggaggacgacgccactaccccaactctgactagccccaaccactaggccaaggcacaatggcacagccgccattccaaatgggcatcttcagccgaagttgaatccacctgatggaacagagggctggttcccaaagttgaagccattctggggattgtcgccagagggcatggcatcatcttcctcctctagccagtaagattcgagcatcttgacagccttctcatatatctcagtgttgtcatggctctgtaggttctcaatcttgtccaggccctcagcatcatcaatcatctgtgcgtaaacattgacatcgcctgcaccaagatttttctctgcctcggcaactttcaggatgttctcaagaccctccaagcaaactgttacaattctgggatccgggcaaacaagcagatcacagagtgggcttaatgcaacccgtgggcacaaagtacttgatctgaa

SEQ ID NO: 26565 - DNA, 718 bp, Zea mays
  misc_feature: Ceres CLONE 1399115-F
  misc_feature: Encodes the peptide sequence at SEQ ID NO. 26566
  misc_feature (635)..(635): n is a, c, t, g, unknown, or other
  misc_feature (676)..(676): n is a, c, t, g, unknown, or other
cagagctggagctccccgcggtggcggccgctctagaactagtggatcccccgggctgcaggaattcgcacgagaccattacctagaacatcctaatcaaaaaccaaaccagcgaggcagctaccgttttgtcgccatagcactcccgccgaccccctcgccgccgcctggaatggagaccagcaccaagaagcttagcagccttcgtatcacctccctggacgacgatgacgacgagaccgagatcccgcaccagccccctcaagcaggcctctccaccgctgaagcggattatgaggacgacgacgatgaggaggaagaagccgaagtgactcttggtgtccttagcaaaccgaagcacccaggcctcctcctccgccacttgttccccagcaaggccggtggcatcccggcgtggctagacccggtgaacttgccgtcgggaaagtccagctactgtggtttctgtggcgagcctctgcagttcgtcctccaggtgttttctttgtgtgcaatgaagttgccacactcgactgcttattgtttggatatcgacttggtcacagttaggcttggttgtgtttagatttatgcaccaattgaagataatgtagcagccttccaccgaacgctgntcatgttcatgtgcccatccatggcatggcttgcttcgagnatcacatggaacattggaaagcccaagtaccgggaaacccct

SEQ ID NO: 26566 - protein, 137 aa, Zea mays; identical to SEQ ID NO: 22894
  misc_feature: Ceres CLONE 1399115-F

SEQ ID NO: 26567 - DNA, 568 bp, Zea mays
  misc_feature: Ceres CLONE 1399116-F
  misc_feature: Encodes the peptide sequence at SEQ ID NO. 26568
  misc_feature (53)..(53): n is a, c, t, g, unknown, or other
  misc_feature (62)..(62): n is a, c, t, g, unknown, or other
  misc_feature (568)..(568): n is a, c, t, g, unknown, or other
agagctggagctccaccgcggtggcggccgctctagaactagtggatcccccngggctgcanggaattcgcacgagaccattacctagaacatcctaatcgaaaaattcttttctgctgctgcgaccgtaggatcggagtccagcagcctcgccgcgttggtatggctttcccttggcccacacatcctagctcttacgcattcttcgaatttcgtcggtcgaggattaggggggtgttctcgtgcgactggtccaatttcgcggctaatcgggcctgttcctgcctcgggataatcaccctttcgtgaaccccatctggtcttggcgttcgcacccttgccgtgcggagggtagggctgcaccagcatccggaaggccggggatcttggggaccccttttccaaaaaccactggcacgttttggccttttccgcctggcggaacccaaaatcccccaaaaaaacccccccaaaaaaaaaaaggggggccccttttggggggggggggggggcatttccccaccccccccccaaagttttgggggggggtttttaaaaaaaaaaaaan

SEQ ID NO: 26568 - protein, 48 aa, Zea mays
  misc_feature: Ceres CLONE 1399116-F
MAFPWPTHPSSYAFFEFRRSRIRGVFSCDWSNFAANRACSCLGIITLS

SEQ ID NO: 26569 - DNA, 732 bp, Zea mays
  misc_feature: Ceres CLONE 1399118-F
  misc_feature: Encodes the peptide sequence at SEQ ID NO. 26570
  misc_feature (567)..(567): n is a, c, t, g, unknown, or other
  misc_feature (689)..(689): n is a, c, t, g, unknown, or other
agagctggagctccccgcggtggcggccgctctagaactagtggatcccccgggctgcaggaattcgcacgagaccattacctagaacatcctaatcgaaaattcaacctctagctgattgatctctggtttaccactctttccttccctccttcaattctaaataccacaaatcaaagttgctttgcgatggtgagcagcagcatggacacgacgagtgacaaacgtgcgtcatccatgctggctcctaaccctgggaaggccacgatcctcgcccttggccacgccttcccgcagcagcttgtcatgcaggactacgtcgtcgacggcttcatgaagaacaccaactgtgacgacccggagctcaaggagaagctcaccagactctgcaagacgacgaccgtgaggactcggaacgtggtgatgtcggatgagatcctcaagaactacccggagctggagcaggaggcgctgccgacgatgaatcagcgtctggacatctcgaacgcgacggtgacgcagatggcgactgaggcgtccctgtcgtgcgtccgctcgtggggcggngcgatctcgtccatcacccacctcgtgtacgtctcgtcgagtgaggcgcgcttcccgggcgacgacctgcacctggcgcgcgcactggtgctgagcccggacgtccgccgcgtcatgatgancttcaccggctgctcgtgcaggatgactcatctccgcgagcgc

SEQ ID NO: 26570 - protein, 181 aa, Zea mays
  misc_feature: Ceres CLONE 1399118-F
  misc_feature (10)..(179): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (167)..(167): Xaa is any aa, unknown, or other
MVSSSMDTTSDKRASSMLAPNPGKATILALGHAFPQQLVMQDYVVDGFMKNTNCDDPELKEKLTRLCKTTTVRTRNVVMSDEILKNYPELEQEALPTMNQRLDISNATVTQMATEASLSCVRSWGGAISSITHLVYVSSSEARFPGDDLHLARALVLSPDVRRVMMXFTGCSCRMTHLRER

SEQ ID NO: 26571 - DNA, 627 bp, Zea mays
  misc_feature: Ceres CLONE 1399119-F
  misc_feature: Encodes the peptide sequence at SEQ ID NO. 26572
  misc_feature (535)..(535): n is a, c, t, g, unknown, or other
  misc_feature (551)..(551): n is a, c, t, g, unknown, or other
agagctggagctccccgcggtggcggccgctctagaactagtggatcccccgggctgcaggaattcgcacgagaccattacctagaacatcctaatcgaaaaacacgatcgatcgggccaggcccgcattctatgggatccgtctctccactctcttctctaccgaacacaatctcatccgtcttcctcttccccatcagccgccctaccgagtcttcgcacgcacgacgcttcgtcaggatcgattcgcgagacctctcctgtccggatcgaggttcatggtttacatatgcgcgtttgtttactgatgcataccacgaccacctgatccggatgtcaggacagatctcctgctttaatcgagtccagttcatgtatgaactctcccttttcctggcacgttgctagatgtaaaagggtgttccgggatttaagagaaccacccacgcatccatgtctgaccagcaaaggcactacggcagctacgagctcctcccggctcacccagatttgcggtgcctggtctgcacgcggncgttcactcttgacgncgaggtcacgacagcttgggagctttagcatatgcagggagggcagacgacggtgctaatggcagcacagggacac

SEQ ID NO: 26572 - protein, 41 aa, Zea mays
  misc_feature: Ceres CLONE 1399119-F
  misc_feature (28)..(28): Xaa is any aa, unknown, or other
  misc_feature (33)..(33): Xaa is any aa, unknown, or other
MSDQQRHYGSYELLPAHPDLRCLVCTRXFTLDXEVTTAWEL

SEQ ID NO: 26573 - DNA, 709 bp, Zea mays
  misc_feature: Ceres CLONE 1399131-F
  misc_feature: Encodes the peptide sequence at SEQ ID NO. 26574
  misc_feature (617)..(617): n is a, c, t, g, unknown, or other
  misc_feature (660)..(660): n is a, c, t, g, unknown, or other
  misc_feature (661)..(661): n is a, c, t, g, unknown, or other
caaagctggagctccaccgcggtggcggccgctctagaactagtggatcccccgggctgcaggaattcgcacgagaccattacctagaacatcctaatcgaaaagtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaaacacttccccgtcttctttcatcgcgacggnatcaagttccccgacgggatccacgcgtttcagcccaaccggnngtcgcacgtggaagagtactggcggggtggtccaacttcctgtcccac

SEQ ID NO: 26574 - protein, 178 aa, Zea mays
  misc_feature: Ceres CLONE 1399131-F
  misc_feature (18)..(178): Pfam Name: Catalase Pfam Description: Catalase
  misc_feature: SWISSPROT Homolog: EC 1.11.1.6 Catalase
  misc_feature (163)..(163): Xaa is any aa, unknown, or other
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGKHFPVFFHRDGIKFPDGIHAFQPNRXSHVEEYWRGGPTSCP

SEQ ID NO: 26575 - DNA, 730 bp, Zea mays
  misc_feature: Ceres CLONE 1399132-F
  misc_feature: Translation starting site: 381
  misc_feature (637)..(637): n is a, c, t, g, unknown, or other
  misc_feature (699)..(699): n is a, c, t, g, unknown, or other
  misc_feature (730)..(730): n is a, c, t, g, unknown, or other
caaagctggagctccccgcggtggcggccgctctagaactagtggatcccccgggctgcaggaattcgcacgagaccattacctagaacatcctaatcaaaaaaaaccctagattcggatccgccatcaacaggctccgccatcaacaggctcgaacgccctctcctcaaaccctaccagatcttgtcgttcggcgcctcaaaccccagattcggatccgccatcaccatagaggtgggggctgacggcatagcgctcatcaccatcgccaacctgcccgtggtggatgcgccatcgcctgaggtgagccgcggggaaatgagggatccttggaggcagagctggcgtcgcgtcgctggtggacgctggtgctggtgaacatggcgtcggtgctggaaaagatagacgagatgttgctgctcgccgtgtacaataaggtgtgcacgtcgctgggcgcttctcgacggcgctgggctcccaaaccctttgtcgcgcgctcgttcaagccgcctactacctactcaaagcctacgcctccgcgcgccatgatcgggcccgtgtcgtcgctgtcggagccttcacctgggccaccatcgccttcctcgtcgccatctccggcagcttcctctaggaaggncatctggtatttcgaaggaatctatgcgtactccctcagataccaggtgttcgtttccatgnataacccatctggtatagtgggactgcacgn

SEQ ID NO: 26576 - DNA, 771 bp, Zea mays
  misc_feature: Ceres CLONE 1399134-F
  misc_feature: Translation starting site: 302
  misc_feature (27)..(27): n is a, c, t, g, unknown, or other
  misc_feature (32)..(32): n is a, c, t, g, unknown, or other
  misc_feature (510)..(510): n is a, c, t, g, unknown, or other
  misc_feature (521)..(521): n is a, c, t, g, unknown, or other
aaagctggagctccccgcggtggcggncgctncatacctaatggatcccccgggctgcaggaattcccacgagaccattacctagaacatcctaatcgaaaaatgggatagatccataagtttgtataagatgagcaccgtctagtcgtagctagtttcgttccgctgcagcagaggcagagttcctctcctcgacgacgcggtttctcctcatcctcgcccgctctgaccgctgactgaaagtggtcaacacagaagaaaggagccatatcggtaaggtaaaagccggatcattggaataatgccgccccacaagatcgagactgggcatcacgatgtggtggttgatatcaccatggattactacgggaagccactatatacgggctcctctgataacgctataaagatcattgccagaaagcggaaactcgcacccccagattggaaccttgagggggaaccacggcccattatggccattcgcgtgggctaatcccaaggttcgcnccatgcattgnatcctgcatgtacgacggccgggtgatcttcttggacgaaaggaaacaagcccggagcaatgggaattggcaaaacacctttgctgaggaaaaagttctacagcaaacttcaaatgcgtggggggccatctgagctgagaactaatgattgagcttgggggaagcaagtaaaggggagcaatattaatatacacatgctttctttaaaatggagagggggggaaaaccaaaatgttatttagcaagggta

SEQ ID NO: 26577 - DNA, 734 bp, Zea mays
  misc_feature: Ceres CLONE 1399141-F
  misc_feature: Encodes the peptide sequence at SEQ ID NO. 26578
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (25)..(25): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
nccccccccccnnnnnnnnnnnntnccccccctnnnnnggggagnggaccatactggagctccccgcggtggcggccgctctagaactagtggatcccccgggctgcaggaattcgcacgagaccattacctagaacatcctaatcgaaaaagactctagtgtaccccagtcccggggtctagtctgagggccgttcccatggccaaccgggcgaggccactccacgccatctacatgaccagcagctcccatgaccctgacaagtgggcgcacctcgtcaaggagtacgcctcgcaatccttgctccgggaagccgccctcgtctacgccaggaacctgccccgccggacgcaccaccagcccctcctccccgtcctcctcaaggccgccgctgcctcctccccgaccgagctaggtctcgggagggccctccatgcggaggccctcaagtcccgcctttgcccgcgatctgctcgtcggcaccacgatcgtgtcgatgtactgcaagtgtggcgcactcgccgacgcgcgcagggcgttcgacgaaatgccggaccggaacgtcatcaggtacaacgcgcttctcgccggttacgccgtggcgggggacatggacggggccctggctctggtcggtgggatgcgctcctggacccacgtcacgggggcgacgcttgatccgcgggtttccgggagaagggccgacatgggcggagggctccggaggggggtt

SEQ ID NO: 26578 - protein, 100 aa, Zea mays
  misc_feature: Ceres CLONE 1399141-F
MRRPSSPAFARDLLVGTTIVSMYCKCGALADARRAFDEMPDRNVIRYNALLAGYAVAGDMDGALALVGGMRSWTHVTGATLDPRVSGRRADMGGGLRRGV

SEQ ID NO: 26579 - DNA, 729 bp, Zea mays
  misc_feature: Ceres CLONE 1399142-F
caaagctggagctccccgcggtggcggccgctctagaactagtggatcccccgggctgcaggaattcgcacgagaccattacctagaacatcctaatcgaaaagcaagaggtaacactcgcgtctcattctcccgttcttgaggggcaatcgcgaatcgcgctcctcgcggtagcggtcgattacccggctccgcccagatccgccgcggctgcgctccagttccctgtcgcgtgcgtagggctcctcgtccctccctctatccccggctgtgtacggactggggatcggggatccctccggaccgggataggattttcgttttgctggcgaggaagggagcttcccccgatagatgtctcacctccgataccctggatttcgtccgtggcgagtggctaccgcttctgctccttttgtgacagctgaatctttgtggttcgaaggcgattgacttgggttcactgacgcggtgacgcccaatgagctcccacgtctccacatcgcggggtcttcatcccccaggcaagcttgggacgttggactcacccggtgcgtggcagccgccagcacctatggctcagcccgaagcaggccgcggtgatgaccaggaggtcaggctgttgtcggttgcttggaatcaggactgtggatgcttcgctgccggtaccagtaacggattcaggatctttaactgtgagcctttcaggagactttcaggagggatctc

SEQ ID NO: 26580 - DNA, 846 bp, Zea mays
  misc_feature: Ceres CLONE 1399146-F
  misc_feature: Encodes the peptide sequence at SEQ ID NO. 26581
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (25)..(25): n is a, c, t, g, unknown, or other
  misc_feature (26)..(26): n is a, c, t, g, unknown, or other
  misc_feature (35)..(35): n is a, c, t, g, unknown, or other
  misc_feature (48)..(48): n is a, c, t, g, unknown, or other
  misc_feature (49)..(49): n is a, c, t, g, unknown, or other
gggccccccccnnnnnnnnnntncnntaaggcgantctccccgggggnnggggcagagctggagctccccgcggtggcggccgctctagaactagtggatcccccgggctgcaggaattcgcacgagaccattacctagaacatcctaatcaaaaagcaaggagtccggtctccgaaaaccgacaagacgatagcaaatcgaaggaggacacggctgctggtggccgcattcggtcgggggaggagcacgaggagccatggcctgcctgcacgaccacagctgcgaggatcacaactgcgccgccgactggtcgctctacaaccacatcgacgtccccaagggggtggctctcaacgaatcgggggcccgggagccgtcaaggccgtccttcacgccctggggaacaccgcccttgaacccctccgcgcgtttttctggggggggaatgaagggtgacccctgaagtaacttaattttcttccccggttgaccttagaatggttaagaatcaacgagccttttccctgttggtggggggtgggctaatgggaaacaacgccccggcccaaagaagggagagggcgttttaccccccaaaacggaaagggggattggcgctttttgcgggggggcccaaacacccttgggccccccggggggggggcaaggggggaatttaacacagggaaaccccgggaggggggggttttttggggaacggaaaaaaaaaaatattcacggggttccccgaggggggggagttaaaccccaacacccggattattcccgcgcgaacacttggggggcgggggccccccccaccaaactctttttcccggcggggg

SEQ ID NO: 26581 - protein, 68 aa, Zea mays
  misc_feature: Ceres CLONE 1399146-F
MACLHDHSCEDHNCAADWSLYNHIDVPKGVALNESGAREPSRPSFTPWGTPPLNPSARFSGGGMKGDP

SEQ ID NO: 26582 - DNA, 645 bp, Zea mays
  misc_feature: Ceres CLONE 1399151-F
  misc_feature: Encodes the peptide sequence at SEQ ID NO. 26583
  misc_feature (473)..(473): n is a, c, t, g, unknown, or other
aaagctggagctccccgcggtggcggccgctctagaactagtggatcccccgggctgcaggaattcgcacgagaccattacctagaacatcctaatcgaaaaacaagacgagatctacccgctgccccctcgcattcccctcccccgcgtcgtcatctccccaaatccccccaaaccctaccgccgatccggccccagatcgccatggccgcgcccaacagcaatgacgccgccagcgccagcggcaccggcccggctggcgaggaggacatctccatcgaggcgttggcgcggcgcgtgcaagagcacatgaccctcaactcgaaccccgccgctcgccgccacaagttctgggagacacagcccgtcggccagttccgcgacgccgccgacgcatcgctaccgaacggccccatcgagccgccccacgcactctccgaggggcgcgccgacccctacccactggccgccgncttcgagtggctcacctgcgacctcgatgacgacgcgctcctcgcccgactctactcgttgctcgcccacaactacgtcgaggatgacgagaacatgttcccgttcaattactccccgggccttcctccggtggggggttaagccggcgtctttttttcggggctgggaaaa

SEQ ID NO: 26583 - protein, 136 aa, Zea mays
  misc_feature: Ceres CLONE 1399151-F
  misc_feature (68)..(137): Pfam Name: NMT Pfam Description: Myristoyl-CoA:protein N-myristoyltransferase, N-terminal domain
  misc_feature: SWISSPROT Homolog: EC 2.3.1.97 Glycylpeptide N-tetradecanoyltransferase
  misc_feature (90)..(90): Xaa is any aa, unknown, or other
MAAPNSNDAASASGTGPAGEEDISIEALARRVQEHMTLNSNPAARRHKFWETQPVGQFRDAADASLPNGPIEPPHALSEGRADPYPLAAXFEWLTCDLDDDALLARLYSLLAHNYVEDDENMFPFNYSPGLPPVGG

SEQ ID NO: 26584 - DNA, 656 bp, Zea mays
  misc_feature: Ceres CLONE 1399153-F
  misc_feature: Translation starting site: 326
  misc_feature (324)..(324): n is a, c, t, g, unknown, or other
  misc_feature (343)..(343): n is a, c, t, g, unknown, or other
  misc_feature (360)..(360): n is a, c, t, g, unknown, or other
aaagctggagctccccgcggtggcggccgctctagaactagtggatcccccgggctgcaggaattcgcacgagaccattacctagaacatcctaatcaaaagaaaaatttagaaaaagtctagacgacgcgcttgtgtgcgtggccggacctgaaaagccggttcctcccccgaccccggcgccccaccgcagccgccggctcccaccgcccggcgcaccccgtcacctctccaccaaccggatacccggacggatccgctcccacctggatcctgatccggggaagtcaaaggggagatcgaagcttgagcagagggagccanaatggtgaaggacacgcgntactacgacgtgctggncgtggacccgtccgccaccgagtccgagatcaagaaggcgtactacgtcaggggcgaggctggtccaccccgataagaacccgaaatggatcgcaggcccgcggagaagttccagggaactaggagaagcataccaagggtctcagtgaccctacacagcgccaagcttatgactcaacatggggaaagacggcatctccaacggagggggatttattggatcctgcaaacattttttggcaattcctggtttggaaggggagcttttttggagggaatatttttgggccaactgg

SEQ ID NO: 26585 - DNA, 822 bp, Zea mays
  misc_feature: Ceres CLONE 1399154-F
  misc_feature: Encodes the peptide sequence at SEQ ID NO. 26586
  misc_feature (11)..(11): n is a, c, t, g, unknown, or other
  misc_feature (21)..(21): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
gggcccccccncaacatatantcccccccgccgggnnnggggggnnnggccaaagctggagctccccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactaggctaggttagccttttaatcgtcgtcgagaagcaagaagggcgcgcacgcaagcaggcaagcaagaagagagccgatcgaccgagagctagcacgcgatggcgaggtcttccaagatgatggtgggggcaggctctgctggccttggccctggccgtgtcgaccgccgagggggagggaacatcaggaccacgacgacggaaaaacaaggacgacgcggggggtgcagcccgaagaccttcccggcccttcgacccgcctccggggggggcggcgccccccggggggttcggggggcctcccccggggggaaggaatttccggggcaggcaggaatttcccccggggttcaagcattggcccccggccaggcggcaagccagccctaacccggggtttcaggcttgggcccgcggaggcgggaaggattggccccctctttcgggggggcggggtccccccggggtttcaaggcgcggctctcgggggggaagtggcccgggggttggccccaccgggccggggttccggtccccccgaaggaacccccaaaacaaagcccgggaacgggccaaaaaagggggggctagagagagggg

SEQ ID NO: 26586 - protein, 96 aa, Zea mays
  misc_feature: Ceres CLONE 1399154-F
MARSSKMMVGAGSAGLGPGRVDRRGGGNIRTTTTEKQGRRGGCSPKTFPALRPASGGGGAPRGVRGASPGGKEFPGQAGISPGVQALAPGQAASQP

SEQ ID NO: 26587 - DNA, 681 bp, Zea mays
  misc_feature: Ceres CLONE 1399157-F
  misc_feature: Encodes the peptide sequence at SEQ ID NO. 26588
  misc_feature (343)..(343): n is a, c, t, g, unknown, or other
aaagctggagctccccgcggtggcggccgctctagaactagtggatcccccgggctgcaggaattcgcacgagaccattacctagaacatcctaatcgaaaaacatgttacagcgactcggcctgccgcgatttttataatgcgccgcggtggccgtcgctagtggtacatatcagcaccgcccctgcctcgaggttgcgtgttttgttctctgtgagcgccgtgggtgttgatggcgtcaacggcgtactcgcggccatccaagccgccagggccggcggccggagacaggagcggaccgcggctggccaaggagctcggcaggatcgagcccaagaagctnggcatcgggctggttgccggctgctgcttcgcgctgctcacctacctctccttttgcccggctggtttgcatctactcgccgggtttcgacagctcgtcgtccatgggtggtgaagaacatgccgccagcaacgacgacgggtgccgggtacagctacaggggcgctgccggtggagcaaaaggcccaaggggaggagcaaaaagaaggttctggacccctgagggggacccgcacatggcaaatttacccggggggtcccaaaaagggtccggcgggagggggcccccggggacaaaacccggccggggggggccttttttacgagagcccaaatcc

SEQ ID NO: 26588 - protein, 74 aa, Zea mays
  misc_feature: Ceres CLONE 1399157-F
MASTAYSRPSKPPGPAAGDRSGPRLAKELGRIEPKKLGIGLVAGCCFALLTYLSFCPAGLHLLAGFRQLVVHGW

SEQ ID NO: 26589 - DNA, 761 bp, Zea mays
  misc_feature: Ceres CLONE 1399158-F
  misc_feature: Translation starting site: 441
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (33)..(33): n is a, c, t, g, unknown, or other
  misc_feature (35)..(35): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (761)..(761): n is a, c, t, g, unknown, or other
nnnnnnttttnnnnnnnnncccccccccccccnanaacgggccnnnggcaaagctggagctccccgcggtggcggccgctctagaactagtggatcccccgggctgcaggaattcgcacgagaccattacctagaacatcctaatcgaaaaatgaccattgcgtgatagatcgcaccggtctcggtctccgtgtctcactctcaagttgcagcagccagtcatttcgttggcaaccagggcagaaataaatatccgtggataagagctgcgctgtgtgctgctgagatatcaagaacggtagggtggaagacaaggccccgttctcgattaacccaagccaaagagtcagagggagagagagagagagagtcgtattggtcgtcacctgtcgaaggttttcggtgtctcctgagccacagctgctgctgctgctggaaccatggagatggaggccgtggagtcgcacggcggcgccggtcgccggacgcccaagaggggatcgcggcatctcctgggcctgcgtcttcatcctggcgagtaactgcttccaggtcatcgcctacttcgccgtgtcgacgaccctggggaactacctcaaggaccgcctgcaccagggcagcaaaaggccgccgggaacggcgtcacccaactgggatgggggcacgagcgggcattcacggccggttcgggcggccggcttgtccttcggccgaacgccctttcccttcgggcaagaaaaactgggacccaatctgcggtn

SEQ ID NO: 26590 - DNA, 760 bp, Zea mays
  misc_feature: Ceres CLONE 1399164-F
  misc_feature: Translation starting site: 376
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (26)..(26): n is a, c, t, g, unknown, or other
  misc_feature (29)..(29): n is a, c, t, g, unknown, or other
  misc_feature (30)..(30): n is a, c, t, g, unknown, or other
  misc_feature (38)..(38): n is a, c, t, g, unknown, or other
  misc_feature (40)..(40): n is a, c, t, g, unknown, or other
  misc_feature (47)..(47): n is a, c, t, g, unknown, or other
  misc_feature (48)..(48): n is a, c, t, g, unknown, or other
  misc_feature (51)..(51): n is a, c, t, g, unknown, or other
nnnccccccccccccccccccccaancgnnaggggaananagggggnnggnccagagctggagctccaccgcggtggcggccgctctagaactagtggatcccccgggctgcaggaattcgcacgagaccattacctagaacatcctaatcgaaaactttcgaactgaggaaccctaggcccagcactcggcgacggcggcgcgccaccggcgacgggatcagcggcatcactcccctccttccccggcgcggcggcgccctgcacctaggccctagcactgcagcactcgacaacaggatcagcggtcgcgcccccctcctccttccccggcgcggcggcgccctgcagatctgccactgtccgcctgccggtcatggagcacctccggtggcgccccacagtgaacgagcgcgacttcattgagtgtgcggtgcaggctgacctccgtgttgacggccgccactcctttgacttccgcaagctcgagatcaccttcgggagggagggatggctcgtcagaggtgcagctcggggagacacacgtgatgggctacgtgaccgtgcagctggggcagccataaccgtgacaggccgaatggaggggacgctggccatattcaccgaggttctcccccatggcccgaacccctccctttgaagccctggggcgtcctgggggaaattaagcaattggaggctttggcccgagattatttggaccggggggcctccagggggaaaaggtcgaaggctggtcg

SEQ ID NO: 26591 - DNA, 670 bp, Zea mays
  misc_feature: Ceres CLONE 1399166-F
tggcggccgctctagaactagtggatcccccgggctgcaggaattcgcacgagaccattacctagaacatcctaatcgaaaaaagcacgagcgctgttgctgcgtctgaaccgatcccattatttgtttggtttcgttgtacgagcgatctctctcctggccgggctccggcacgttgtaatattcggtcttctcggcgcagcagcaacttgttcttgtgcactgctacttcgctgctctgggccgtttgccgttgatgctgcggacaagtatgggatagtgctgctgtgctagtgcagtttctttgcttccttacactggtaggggtggtggtctggtctctgggggagcatttggcctagaagagggggaaggtggggcgcttcttctttcttgttcaagatgaagttcatggaagctttggatccaaatccggatacttttccggaacaagggaaatggaagtccgtatttggggtttcttaattggggggagggacattccctgggttctgaaaagggacctaacaaaggttttaccctctccccaaggttttcccctccccttctcccccaggggggggccccctctttttccacaagaggttgtgagatcacccagacaaagggtgggggcgggaaaaaaaaattattcttgtggtgggcatcc

SEQ ID NO: 26592 - DNA, 843 bp, Zea mays
  misc_feature: Ceres CLONE 1399173-F
  misc_feature: Encodes the peptide sequence at SEQ ID NO. 26593
  misc_feature (32)..(32): n is a, c, t, g, unknown, or other
acccccccccctattcttactactccaccccncaccggggggggggggggcacactggcgctccccgcggtgggggccgctctataatagtggatcccccgggctgcaggaattcgcacgagaccattacctagaacatcctaatcgaaaagtttcttcttcccatctcccgagccatcgtaacccaaatcctactccaggtagatcgccgtctccgccgacgctgccggcgtgagcacaggatcagatccggtgtgatggcgttccgccgcatcttatccaccgcggtgcgccgccgctcgggcgtgggcgccgcgggggccgggaacgcgcgcgagggctccacggccgtcgctgcggggccaggtgtgctcaccccctatgccaccgcgttgcgccctcccgtgatggcgtatgaccgggatcgcggagggccgtcaacgcccagcctcccggcgtccccgaggcccccataactcggggcttacgtcccggcacggccggcccccgtggccgtccccacggccgtcactagatgggggcgtcccctggcgggggggccagaaaaacccgggccccacgaaagcttggccccaacgcggcccttggtgcaatataaccgcggagatgttttttacctcgccgccggaggcgcgacggcctaaacggctcgggcggctgggggggatgccatttggggagctgggtaggtaaagcggaggaaggggtgggtgggcgcggggggagggtgaggcggcgagtttcgcccctgagcctctgtggccgggttgagaagcgcccacaccgcctttaatcgtccacgcggctggagcgacatcaggg

SEQ ID NO: 26593 - protein, 72 aa, Zea mays
  misc_feature: Ceres CLONE 1399173-F
MAFRRILSTAVRRRSGVGAAGAGNAREGSTAVAAGPGVLTPYATALRPPVMAYDRDRGGPSTPSLPASPRPP

SEQ ID NO: 26594 - DNA, 838 bp, Zea mays
  misc_feature: Ceres CLONE 1399175-F
  misc_feature: Encodes the peptide sequence at SEQ ID NO. 26595
  misc_feature (7)..(7): n is a, c, t, g, unknown, or other
  misc_feature (8)..(8): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
ttccccnnccccnnnccccnnntcccccccccggcnnnggggcnnnnnnccagagtggagctccccgcggtggcggccgctctagaactagtggatcccccgggctgcaggaattcgcacgagaccattacctagaacatcctaatcgaaaaatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttatgccgccaagacatgggtgggggattcctgctcccaaggggaggaagagatcgttaggcaaacatcggtgatcggactggagagcaaaggctccattcacccttgggccaggtttggggcccctttgagaatgggggaaaaatttcctcccctgaaggggaatccgggggggggtcccgcggaaaaaccatcggagatggggggggatatatggctggggggggggttataagtcccccaaccataaaagggggatcccaattatatccccctccgggagcgggcacaaaacccggttgtggtggagggggggggggggggaatacccccctttgggaagagtgggggggggggtatcaaacgcgccgggtaataaattttcccccctcggggcgccggggcccctgcggtcggggaaaggcggtttc

SEQ ID NO: 26595 - protein, 85 aa, Zea mays
  misc_feature: Ceres CLONE 1399175-F
  misc_feature: SWISSPROT Homolog: EC 1.2.1.3 Aldehyde dehydrogenase (NAD(+))
MGAFAKEEHQFLAELGLAQRNPGAFACGAWGGSGPTVTSTSPTNNQVIAEVVEASVHDYEEGMRACLCRQDMGGGFLLPRGGRDR

SEQ ID NO: 26596 - DNA, 674 bp, Zea mays
  misc_feature: Ceres CLONE 1399182-F
  misc_feature: Encodes the peptide sequence at SEQ ID NO. 26597
  misc_feature (369)..(369): n is a, c, t, g, unknown, or other
  misc_feature (394)..(394): n is a, c, t, g, unknown, or other
agagctggagctccccgcggtggcggccgctctagaactagtggatcccccgggctgcaggaattcgcacgagaccattacctagaacatcctaatcgaaaaaggtttccaagacaccaggacggagacatcgaggaggcggcggagacgccgccgcgtccttccgcttctgagccgtataacaacaaacccctcggccccgtcccctctgtccatcgatcaccttgaccacgtgcctgtgccgcaggccgcagccaggcatctccggcgaatctggtttgaggcgcggagagaggatatttgcatgcgggactgatcaatcaaagcaatggcagtagcgcccatggactgcggtgctgggtcgattantctaggccacaaggttttatgccgnttcggagtacccaacagcagtagattgcgatgggtgggatatgacaggaaacaaaggacagatcagttgattgctagagccgtaatcgggggatcggacacaactagacttctcgattccggactggaagacgcaattttcaagaggattttcgataggggcttcagttggcccacctggaaagaaggtaattggtgggggaaccgaggccacttacttttttcccccaagagaagagccccttttgggaaacgcgaatggggccctggggaggggtcct

SEQ ID NO: 26597 - protein, 115 aa, Zea mays
  misc_feature: Ceres CLONE 1399182-F
  misc_feature (14)..(14): Xaa is any aa, unknown, or other
MAVAPMDCGAGSIXLGHKVLCRFGVPNSSRLRWVGYDRKQRTDQLIARAVIGGSDTTRLLDSGLEDAIFKRIFDRGFSWPTWKEGNWWGNRGHLLFSPKRRAPFGKREWGPGEGS

SEQ ID NO: 26598 - DNA, 683 bp, Zea mays
  misc_feature: Ceres CLONE 1399185-F
  misc_feature: Encodes the peptide sequence at SEQ ID NO. 26599
  misc_feature (559)..(559): n is a, c, t, g, unknown, or other
aaagctggagctccccgcggtggcggccgctctagaactagtggatcccccgggctgcaggaattcgcacgagaccattacctagaacatcctaatctaaaaacacaagcaaggcgctcaacctgccgcccgggaaaaaccctagaccggcgatgtccgtccccggcgcccccgcgggcggcggttcccgcagcttcgacttcggcgccgacgacgtgctctgctcctacgatgacttcgccgcctcgtccgagcccaagcgccccgatccggccgacagtgcgcccgattttcatgatagcagactggggaggccatttgtgaaaccttatgaacaagaaagttatgggaaagaggatgtgctttctgctgttgagagatgcatgaaaaagtatgctgataatttgctacgatcactggagggaatcactagtcggctttcgcaactggaggattattgctataagcttgagagatcccatagtggaacttcgaagtgatgtgcttcctgatgagactgaccatagggttgaggcctcttgagaaacttcttaatggngtacccgggcctatccaatttcttagggaaaaaccgggagttacttgagctcagaaaggattgggccaaatttccggctaacccagaatcctctttaaagaagggagatggccgaaactttttt

SEQ ID NO: 26599 - protein, 115 aa, Zea mays
  misc_feature: Ceres CLONE 1399185-F
MSVPGAPAGGGSRSFDFGADDVLCSYDDFAASSEPKRPDPADSAPDFHDSRLGRPFVKPYEQESYGKEDVLSAVERCMKKYADNLLRSLEGITSRLSQLEDYCYKLERSHSGTSK

SEQ ID NO: 26600 - DNA, 685 bp, Zea mays
  misc_feature: Ceres CLONE 1399189-F
  misc_feature (516)..(516): n is a, c, t, g, unknown, or other
  misc_feature (674)..(674): n is a, c, t, g, unknown, or other
aaagctggagctccccgcggtggcggccgctctagaactagtggatcccccgggctgcaggaattcgcacgagaccattacctagaacatcctaatcgaaaaaaacaggcacaggctccctcctccactgtccagtgtccactcctcgtcccgagaagcagacaaagcgcggcgctgcagatttcggtacggttcccaatgcctcccatgcccgccgtcgtcccgtgctagcacccggcgccgctcctccacctgccgcgtcgcgccgcctggatccggcgggcacgtggctaggagcctcagatccgggcgaaacccagccttccgtgcggacgtcttcactctacctccagactggcggctgccatttccccccctcttcttgctgttttttttggtgggggtggggggtggaatctgcggtggagtcttgccgtcgctcgctgtaaacgtagagctctctctctctcttggcgagtaatcctggttcttgctccatttccgtgttagtgctgncgtgtgagtggcaaggtttacgtgtaagatgtggaaacagttcctgagcagttggccccggaggtcgtcggcctccggggactcgggacattgcagcagtggcgccggcatacagcgcacgagcagctgcgcagcattccgccgggccgccccccggnctccgcattcg

SEQ ID NO: 26601 - DNA, 660 bp, Zea mays
  misc_feature: Ceres CLONE 1399277-F
  misc_feature (477)..(477): n is a, c, t, g, unknown, or other
aagctggagctccccgcggtggcggccgctctagaactagtggatcccccgggctgcaggaattcgcacgagaccattacctagaacatcctaatcaaaaaatcccaaactcttaacaacaacacacagagaaattttcttggtggtctctccactccaatggctttctcagcgactctgtctcagctttcttctctttcgacaatctcctcctcactcccactttcttctagaagcttccctcttcgatctcagactcagttcagagtcaaagcagaggcagagaaacatagcacagagactaaatccgaaggagaagcttcgccagctgcaaccaaaacccctaaaactcttcccaagaaaccggtttactcgagtcagcttcttcacttatgtttcaaatgttgaatccaataacagaaacttgatatttctcttttgaaacagtgaagaagggtcaaatcgttcgtgtagacnaggagaagtacctcaacagcatcaattacttatcagttggtcatcctcctttctacaaaggactagattacatctacgaagatcgcggcgaggtactggacattcgtgtctttgagacaggagagtatgcacttggttggatgggttggtatcccaaccgcaccggcttggctaccaacagat

SEQ ID NO: 26602 - DNA, 652 bp, Zea mays
  misc_feature: Ceres CLONE 1399295-F
  misc_feature: Encodes the peptide sequence at SEQ ID NO. 26603
ggagctccccgcggtggcggccgctctagaactagtggatcccccgggctgcaggaattcgcacgagaccattacctagaacatcctaatcgaaaaatcaaccatatgattgagaccaacaagcaagcatagaaggtggaatccagtagcaacaatagagcaacaatggcgaccaagatattttccctccttatgctccttgctcttgctacatgtgttgctaacgcgacaattttccctcaatggtcacaagctcctatagcttcccttcttcccccataccttccatcaattatagcttcaatatgtgaaaacccagctcttcaaccatataggcttcaacaaggaatcgcagcaagcaacatacctttatcgcccttggtgtttcaacaatcgccagccctatctttggtgcagtcattgggacaaaccatcagggcacaacagctgcagcaactcgtgctacctctgatcaaccaagtagctctggaaaacctttctccctactctcagcaacaacaatttcttccattcaaccaactggctacactgaaccctgctgcttatttgcagcaacaactattaccatttagccagctagctactgcctagtctcagcaacaacaacttcttccatttaaccaattggccg

SEQ ID NO: 26603 - protein, 148 aa, Zea mays
  misc_feature: Ceres CLONE 1399295-F
MATKIFSLLMLLALATCVANATIFPQWSQAPIASLLPPYLPSIIASICENPALQPYRLQQGIAASNIPLSPLVFQQSPALSLVQSLGQTIRAQQLQQLVLPLINQVALENLSPYSQQQQFLPFNQLATLNPAAYLQQQLLPFSQLATA

SEQ ID NO: 26604 - DNA, 653 bp, Zea mays
  misc_feature: Ceres CLONE 1399315-F
aagctggagctccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaatcaatttcttcgtccgccttcgcccctgcttacgtccccgctactaaccctaggatcattctgtcttttctcgtttcttatccgactcttcttcgttttatgcctatcagttatgaggttgaacgccttcagaagcttctctactagattagtgtaaatagtagacttgttcgagtttagcttggctggaagaattagtctctggtccgtgtttatatctgctagcaataatggctgcgatgaacggagaggtattgggtgaatgtggaaggaacataaatagtctcaagagaaagcgggagagccccgctgcatatgctgctggcgtattctgca

SEQ ID NO: 26605 - DNA, 652 bp, Zea mays
  misc_feature: Ceres CLONE 1399318-F
  misc_feature: Encodes the peptide sequence at SEQ ID NO. 26606
  misc_feature (485)..(485): n is a, c, t, g, unknown, or other
  misc_feature (507)..(507): n is a, c, t, g, unknown, or other
  misc_feature (508)..(508): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (517)..(517): n is a, c, t, g, unknown, or other
  misc_feature (521)..(521): n is a, c, t, g, unknown, or other
tggagctccccgcggtggcggccgctctagaactagtggatcccccgggctgcaggaattcgcacgagaccattacctagaacatcctaatcgaaaaatcgccccttgaaccctagctcccgcaactgccgccgccactcccacgcccgcagccatgccgcccaagctcgacccgtcgcaggtggtggaggtgttcgtccgtgtgaccggcggcgaggtcggcgcagcgtcttcgctggcccccaagatcggcccgctcggtctttcccccaagaagatcggagaggacatcgccaaggagacggccaaggactggaagggcctccgcgtcaccgtcaagctcaccgtccagaaccggcaggccaaggtctccgtcgtcccctccgccgcggcgctcgtcatcaaggcgctcaaggagccagagagggaccgcaagaaggtcaagaacatcaagcacagcggcaacatcagcctcgacactcttnaaaaaaaaggtgcccccggggnnttttnnngntttngtgccagggggaaagggaaattgaagctttggattcggaggtaatttgttccgtacatagaagtagaaattctttttgcacccaacacgggatttagtcttctttctccacagcccacgttcagggggctt

SEQ ID NO: 26606 - protein, 136 aa, Zea mays
  misc_feature: Ceres CLONE 1399318-F
  misc_feature (12)..(71): Pfam Name: Ribosomal_L11_N Pfam Description: Ribosomal protein L11, N-terminal domain
  misc_feature (111)..(111): Xaa is any aa, unknown, or other
  misc_feature (118)..(118): Xaa is any aa, unknown, or other
  misc_feature (120)..(120): Xaa is any aa, unknown, or other
  misc_feature (121)..(121): Xaa is any aa, unknown, or other
  misc_feature (123)..(123): Xaa is any aa, unknown, or other
MPPKLDPSQVVEVFVRVTGGEVGAASSLAPKIGPLGLSPKKIGEDIAKETAKDWKGLRVTVKLTVQNRQAKVSVVPSAAALVIKALKEPERDRKKVKNIKHSGNISLDTLXKKGAPGXFXXFXARGKGKLKLWIRR

SEQ ID NO: 26607 - DNA, 590 bp, Zea mays
  misc_feature: Ceres CLONE 1399340-F
  misc_feature (159)..(159): n is a, c, t, g, unknown, or other
  misc_feature (373)..(373): n is a, c, t, g, unknown, or other
  misc_feature (390)..(390): n is a, c, t, g, unknown, or other
aagctggagctcaccgcggtggcggccgctctagaactagtggatcccccgggctgcaggaattcgcacgagaccattacctagaacatcctaatcgaagtatctgaccacgtcacacgacaccaccaccagccctccccttcatcaattgggagcacnggcgcccgttcattcccctcttctccgctgcttgcctccggctccccaattccacgagatctccaattccaccgcgtcgtctctgcatccggaccccataccccgatcgatccctaaggcccatggttttctccgccgccgcgtcgcctctagtagccacccgctgctgactctgcttcctcctgcgtcgcccacctccgctgctgctgtcgcngtaagtgctggcgttgntgaagacgcgtaactctttaggggtcgcgatttctcgctgatcgggtccagaattgtaaagctatggatctctcggcggcccaatcggtcgaactctcggtcgggctccattcttagggtaaggccaggcccacgtttgaaggaaacgggaaacccggcccgtttgccctggtttaaaaaaaggggaggaacccaaaccc

SEQ ID NO: 26608 - DNA, 634 bp, Zea mays
  misc_feature: Ceres CLONE 1399345-F
  misc_feature: Encodes the peptide sequence at SEQ ID NO. 26609
  misc_feature (562)..(562): n is a, c, t, g, unknown, or other
  misc_feature (567)..(567): n is a, c, t, g, unknown, or other
  misc_feature (568)..(568): n is a, c, t, g, unknown, or other
tggagctccccgcggtggcggccgctctagaactagtggatcccccgggctgcaggaattcgcacgagaccattacctagaacatcctaatcgaaaaacaaacacgtgacacctccgcccaccctcgccccctccctaccggcaccgcccagatggcctgctcccacatcgccgccgcgggggtctcctcccccgccgcagcggcggctcgttccccggcgcattctcccgcttccgccttcgcgcgcctccggtcgacgcctcgtttcgcgagcgctggcttgtcggttaagggaaacggagcggcgttcccgttggtcgccgccgcggggccggccgcggcggcaccggtggccgacctggacggccgcccggccacggagaagcagcccatcatcgtcatcgacaactacgacagcttcacatacaacctctgccagtatatgggggagcttggattgaacttcgaagtataccgcaatgatgaactgaccatagaagatgtgagaaggaagaacccaaggtgcatacttatttctccaggacctggtgaaccacaagnatcgnngatatcattgcagactgttcttggaatacgccccaccatccgcatttttggagtttgcatgggtct

SEQ ID NO: 26609 - protein, 160 aa, Zea mays
  misc_feature: Ceres CLONE 1399345-F
  misc_feature: SWISSPROT Homolog: EC 4.1.3.27 Anthranilate synthase
  misc_feature (137)..(137): Xaa is any aa, unknown, or other
  misc_feature (139)..(139): Xaa is any aa, unknown, or other
MACSHIAAAGVSSPAAAAARSPAHSPASAFARLRSTPRFASAGLSVKGNGAAFPLVAAAGPAAAAPVADLDGRPATEKQPIIVIDNYDSFTYNLCQYMGELGLNFEVYRNDELTIEDVRRKNPRCILISPGPGEPQXSXISLQTVLGIRPTIRIFGVCMG

SEQ ID NO: 26610 - DNA, 646 bp, Zea mays
  misc_feature: Ceres CLONE 1399348-F
  misc_feature: Encodes the peptide sequence at SEQ ID NO. 26611
aagctggagctccccgcggtggcggccgctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggtcgggacagctgactagctgagaggcatggtgatggacgccggcggcgtcaagctgccgtacagctacgccggccagcaggacggcgggaagctggtgaagagcgtcagccgcgtggagccgcgcaggttcggcctgcgcctcgtggagggcttcctcgtcgtcacctgcgcctacttctccaccgaccagttcgacgccatccagatcgccatgaccagccgacccgtctccagcaatgcggctggcgtcggagtcgattcgctggaagtggtcgccgccggcgccgacacctccaaggcctccagggagggattagatttg

SEQ ID NO: 26611 - protein, 99 aa, Zea mays
  misc_feature: Ceres CLONE 1399348-F
MVMDAGGVKLPYSYAGQQDGGKLVKSVSRVEPRRFGLRLVEGFLVVTCAYFSTDQFDAIQIAMTSRPVSSNAAGVGVDSLEVVAAGADTSKASREGLDL

SEQ ID NO: 26612 - DNA, 687 bp, Zea mays
  misc_feature: Ceres CLONE 1399349-F
  misc_feature: Encodes the peptide sequence at SEQ ID NO. 26613
  misc_feature (411)..(411): n is a, c, t, g, unknown, or other
  misc_feature (413)..(413): n is a, c, t, g, unknown, or other
  misc_feature (422)..(422): n is a, c, t, g, unknown, or other
  misc_feature (426)..(426): n is a, c, t, g, unknown, or other
  misc_feature (429)..(429): n is a, c, t, g, unknown, or other
aaagctggagctccccgcggtggcggccgctctagaactagtggatcccccgggctgcaggaattcgcacgagaccattacctagaacatcctaatcgaaaacttaaagcacgcgcgcgccctgtgctccccctcagtcctcgctagtcctttctccatcacaaacgctattcttttttccctaaagctcggagaccgccggaagcgagcgatgggtgcaagacgaagagcctgctgttggcgctcagcgtggcggcgctgctcgcggcgcagtcggactcccacggcctgagggacttcacgagcgggagcggcgaggcgacgacgacgccggagatgcagaccttcttcagccccaggccgctgcggcgctcccggaggccctcgacgcctccatgcccgcaaagcgangnggggcggcngctntcnttcccgttcatggtaagggacgacacgtttccctgaaagaaaggaacgccgttctggagacgagcaaggaggctagaagggcctcacctgggggggaacaaagggacaaagggtcaggaactttacccgcaaaccggagggtccttaacgggggtccctgggggcccggacctggaagcatcccctcaaaacgataaacggggatcccttggttttttcctcaaacaccctcgctgggggggggtcccaagggggggg

SEQ ID NO: 26613 - protein, 76 aa, Zea mays
  misc_feature: Ceres CLONE 1399349-F
  misc_feature (6)..(6): Xaa is any aa, unknown, or other
  misc_feature (11)..(11): Xaa is any aa, unknown, or other
  misc_feature (12)..(12): Xaa is any aa, unknown, or other
MPAKRXGAAAXXPVHGKGRHVSLKERNAVLETSKEARRASPGGEQRDKGSGTLPANRRVLNGGPWGPGPGSIPSKR

SEQ ID NO: 26614 - DNA, 659 bp, Zea mays
  misc_feature: Ceres CLONE 1399351-F
  misc_feature: Encodes the peptide sequence at SEQ ID NO. 26615
  misc_feature (575)..(575): n is a, c, t, g, unknown, or other
tggagctccccgcggtggcggccgctctagaactagtggatcccccgggctgcaggaattcgcacgagaccattacctagaacatcctaatcgaaaaactaaaaacatgggactccaccctgtctccgaggccaacgcttcaagccccttcggctctctctccgccgccgaattctactccctccattccgtcgcccactcctccgcctacatcaccaacccaaccggtctcaaactcttcacccaatggtggacccctctccaccgtccaccactcggcctcatcgccgtcgtccacggcttcaccggcgagtccagctggttcctccaactaacctccgtcctcttcgccaagtcagggttcctcacttgcgccatcgaccaccaaggccacggcttctccgacgggctaaccgctcacatccccaacatcaacctcatcgtcgacgactgcatctccttcttcgacgacttccgtagccgtcacgcttcctcctcctccctaccttccttcctctactccgagtccctcggcggcgcgatagctctctacatcaccctccgccagaaatcanaatggaacggtctcatcctcagcggcgccatgtgctccatcagccacaagttcaaaccccccgtggccgttacaacacctctta

SEQ ID NO: 26615 - protein, 184 aa, Zea mays
  misc_feature: Ceres CLONE 1399351-F
  misc_feature: SWISSPROT Homolog: EC 3.1.1.23 Acylglycerol lipase
  misc_feature (157)..(157): Xaa is any aa, unknown, or other
MGLHPVSEANASSPFGSLSAAEFYSLHSVAHSSAYITNPTGLKLFTQWWTPLHRPPLGLIAVVHGFTGESSWFLQLTSVLFAKSGFLTCAIDHQGHGFSDGLTAHIPNINLIVDDCISFFDDFRSRHASSSSLPSFLYSESLGGAIALYITLRQKSXWNGLILSGAMCSISHKFKPPVAVTTPL

SEQ ID NO: 26616 - DNA, 614 bp, Zea mays
  misc_feature: Ceres CLONE 1399356-F
  misc_feature: Encodes the peptide sequence at SEQ ID NO. 26617
  misc_feature (396)..(396): n is a, c, t, g, unknown, or other
  misc_feature (404)..(404): n is a, c, t, g, unknown, or other
aagctggagctccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaggtggagacgcaccactacgtctcccgctcaancagacttnctcagtgcgcgtctatgactcgacaaagcgacgcgcgtctcatcggcgtgagacatcgtgtcgaggaagatctcgactcgctgccccgcgagagcagcggctgtggcactcgcacgcgacgagatcaagtcaggcctgttgaccaacccccacttggcggggctgctggagaaaggggaaactggacccaatggcccccaactttcggaa

SEQ ID NO: 26617 - protein, 153 aa, Zea mays
  misc_feature: Ceres CLONE 1399356-F
  misc_feature (26)..(149): Pfam Name: DUF1264 Pfam Description: Protein of unknown function (DUF1264)
  misc_feature (81)..(81): Xaa is any aa, unknown, or other
  misc_feature (84)..(84): Xaa is any aa, unknown, or other
MASSDGKPLPTPASVGGGGGSSTAPPGQPTTVASKVLDMGAAAMQSLRPVKQAKQHMCTFALYAHDPKRQVETHHYVSRSXRLXQCASMTRQSDARLIGVRHRVEEDLDSLPRESSGCGTRTRRDQVRPVDQPPLGGAAGERGNWTQWPPTFG

SEQ ID NO: 26618 - DNA, 628 bp, Zea mays
  misc_feature: Ceres CLONE 1399358-F
  misc_feature: Encodes the peptide sequence at SEQ ID NO. 26619
  misc_feature (290)..(290): n is a, c, t, g, unknown, or other
  misc_feature (368)..(368): n is a, c, t, g, unknown, or other
  misc_feature (509)..(509): n is a, c, t, g, unknown, or other
aaagctggagctccccgcggtggcggccgctctagaactagtggatcccccgggctgcaggaattcgcacgagaccattacctagaacatcctaatcgaaaaagcgaaaccccagaatgttcgtcctccgcaaaaccctcctccatgcgccgccggccgccgccgcggcggtcccctctcggatctcttccctcctccgcctcatcccctctgcatctttttctgaggtaagcggaggtggggaagaatggggcgcctcctcacccggaggcggcggcggcaggggtggnggtgggaacgaatggagctccacctggtctaccggcctcaccaaggaccatttcgacggatcctcggcctccgtcggncgttctgtcccttgggagtcagcgcccgtctctcgtgagcgggcggccattcgcgctatggatgagtgggacgagagggtccgggaactggagcgtaacaatgtcgaggcgaaggcgtatgtggattcatgggacgaccgnatggcggagaactgtccgctgctgaagcaggtgcgggagccgggcgctcggggctcgtatctcaggactcggagaacaagagatgtacggctgcacaaggagaccccgcgacttacacg

SEQ ID NO: 26619 - protein, 170 aa, Zea mays
  misc_feature: Ceres CLONE 1399358-F
MFVLRKTLLHAPPAAAAAVPSRISSLLRLIPSASFSEVSGGGEEWGASSPGGGGGRGGGGNEWSSTWSTGLTKDHFDGSSASVGRSVPWESAPVSRERAAIRAMDEWDERVRELERNNVEAKAYVDSWDDRMAENCPLLKQVREPGARGSYLRTRRTRDVRLHKETPRLT

SEQ ID NO: 26620 - DNA, 697 bp, Zea mays
  misc_feature: Ceres CLONE 1399361-F
  misc_feature: Encodes the peptide sequence at SEQ ID NO. 26621
  misc_feature (697)..(697): n is a, c, t, g, unknown, or other
aaagctggagctccccgcggtggcggccgctctagaactagtggatcccccgggctgcaggaattcgcacgagaccattacctagaacatcctaatctaaaaaaaaaactagcgcttactgttttgcacggccatagtctcgatccccaccgagtccagcaaacagcaccaccccaccctcttcgcggctccggcagccgcgccaccatggcttctcctgcgggggctaacagcggggcctcctcctcgagagggacacccttgcctttgcccttccccttccccgctgcggcgcacttcccctcccgcggcgccggtcccttcctgtcgcagcactatcacccgccctccacctccgacggcgacgatgaggtcgaagaagacgagggaagcatggacgacggcagcgccgaagaggatgatgccgagctgtccgacggaggggctctcggctcgccgcggcgacgcgccttctccgctccaggtgaaccaagggtttgcgcagagggctttcaggtattggacgtatggagataaatgggggaaaatggggagggaggtcaatcccaggaggggcagcaatgggcatttatgtaaccatggaaacggaggattgggcgtcaatcaccaagaaaggggatgaacctggtaccatccccaaaagatgggaaaaggggaagacggccccatgggagan

SEQ ID NO: 26621 - protein, 109 aa, Zea mays
  misc_feature: Ceres CLONE 1399361-F
MASPAGANSGASSSRGTPLPLPFPFPAAAHFPSRGAGPFLSQHYHPPSTSDGDDEVEEDEGSMDDGSAEEDDAELSDGGALGSPRRRAFSAPGEPRVCAEGFQVLDVWR

SEQ ID NO: 26622 - DNA, 682 bp, Zea mays
  misc_feature: Ceres CLONE 1399362-F
  misc_feature: Encodes the peptide sequence at SEQ ID NO. 26623
  misc_feature (447)..(447): n is a, c, t, g, unknown, or other
  misc_feature (465)..(465): n is a, c, t, g, unknown, or other
  misc_feature (501)..(501): n is a, c, t, g, unknown, or other
  misc_feature (550)..(550): n is a, c, t, g, unknown, or other
  misc_feature (559)..(559): n is a, c, t, g, unknown, or other
aaagctggagctccccgcggtggcggccgctctagaactagtggatcccccgggctgcaggaattcgcacgagaccattacctagaacatcctaatcgaaaagcgtttgttctcctgttcatcacccgtgcgtgctctctctctctctctctctctctctcgtgcggcaactgcgaggccgccgacgcccgacggcagggtgcccaggccttcttcggtcccatcgcgaggccatagttgcatcattcgcctgagacgactgcccagcaccaggactgatctcctcactaggggcgtagaggtgaagagaagaacttgacaatgagcagcataggcacaggttacgatctgtctgtcaccaccttctccccagatggtcgcgtcttccaggtcgaatatgctaccaaggccgtcaacaccagcgggaactggttgtttgggatcaantgcaaagatggattggtncctggggtggttgagaagctggtaacctcaaagagnatggctggaagggcaaaaccggaggaatccattcagtgaccggcctttnaaactgggntggttgctggtttagcagcagatggcaggcaaattgttcccaaggacgaagtcagaagctgccagtttatgaaaaggtctatggagaacccattcctggtaaggaaatggctgatcgcgtggc

SEQ ID NO: 26623 - protein, 72 aa, Zea mays
  misc_feature: Ceres CLONE 1399362-F
  misc_feature: SWISSPROT Homolog: EC 3.4.25.1 Proteasome endopeptidase complex
  misc_feature (42)..(42): Xaa is any aa, unknown, or other
  misc_feature (60)..(60): Xaa is any aa, unknown, or other
MSSIGTGYDLSVTTFSPDGRVFQVEYATKAVNTSGNWLFGIXCKDGLVPGVVEKLVTSKXMAGRAKPEESIQ

SEQ ID NO: 26624 - DNA, 658 bp, Zea mays
  misc_feature: Ceres CLONE 1399364-F
  misc_feature: Encodes the peptide sequence at SEQ ID NO. 26625
aagctggagctccccgcggtggcggccgctctagaactagtggatcccccgggctgcaggaattcgcacgagaccattacctagaacatcctaatcgaaaactttttgctcggctgacaccaggtagccgcccctcctctatccaccccttcacttgcttggtcttccactcacccctctctcgttattcacccggtctcctctcctgcaaagaggtacgtaactgcactttcctgctcagtcttttgatcggtttcagtgatgcactgatgctgtagagtttcgtttctgttagtactctaatcaacggacaacggtttctgttagtattcttgggttcatggctgtctgcagattgtcgcccttgctctgcctgctctattcggcctcagttcattctgtcgtaaacctcacctcgtaactgaaataagccatatgcgccgcgcgtcgaagcttagtgtctgatcgatacgctatccctacaattttctgagctgttgaactcctgcgcccgtctcctcgtcgaggacaggaagatgagctcgctacacgccacacgagcggagcttggcctggttgtcctgtacctgaacaaagccgaggcccgggacaagatctgcagggcgatccagtacggctccaagttcgtaagcaacgg

SEQ ID NO: 26625 - protein, 40 aa, Zea mays
  misc_feature: Ceres CLONE 1399364-F
MSSLHATRAELGLVVLYLNKAEARDKICRAIQYGSKFVSN

SEQ ID NO: 26626 - DNA, 697 bp, Zea mays
  misc_feature: Ceres CLONE 1399366-F
  misc_feature: Encodes the peptide sequence at SEQ ID NO. 26627
  misc_feature (559)..(559): n is a, c, t, g, unknown, or other
aaagctggagctccccgcggtggcggccgctctagaactagtggatcccccgggctgcaggaattcgcacgagaccattacctagaacatcctaatcgaaaaacccattccacccaccacccaccttcctttcctctctctctgtctgactgtctccctccgtccctcgaagcttctctggtttcagacgcaaccccgcgggtcgcgggatcaaggagccagagagcgggacgcagcgagcgttccgccggagatcgagaccgtagctagggtttgaggcgccgggctgcggtggacgagatgtcgacgccggcgaggaagcggctgatgcgggacttcaggcgcctgcagcaggacccgcccgccgggatcagcggcgcgccgcacgacaacaacatcatgctctggaacgccgtcatattcgggccggatgatacgccgtgggacggtggcacgttcaagtttaccttgcagtttacagaagattacccaaacaagccaccaactgttcgatttgtcctctaggatgtttcatccaaatatatatgcctgagggaangcatcctgtttggatatcctacagaaaccagtggagtcctaaatatatggatgttggctgcaattttaactttctatccaagccccctggctggtgtgatccaaaacccaaactccccctgcaaactcagaaggcagg

SEQ ID NO: 26627 - protein, 74 aa, Zea mays
  misc_feature: Ceres CLONE 1399366-F
  misc_feature (8)..(74): Pfam Name: UQ_con Pfam Description: Ubiquitin-conjugating enzyme
  misc_feature: SWISSPROT Homolog: EC 6.3.2.19 Ubiquitin--protein ligase
MSTPARKRLMRDFRRLQQDPPAGISGAPHDNNIMLWNAVIFGPDDTPWDGGTFKFTLQFTEDYPNKPPTVRFVL

SEQ ID NO: 26628 - DNA, 717 bp, Zea mays
  misc_feature: Ceres CLONE 1399367-F
aaagctggagctccccgcggtggcggccgctctagaactagtggatcccccgggctgcaggaattcgcacgagaccattacctagaacatcctaatcgaaaaatcccttagcctgacgctggcgctgccgctgccgccgcccatgtccgccgccccgccccgccgcgtggtcatctgcggcggcggcgtggtgggcgcgtgcacggcctacttcctcgccacccacgccgcgtcccccaccgtcccgacgctcgtcgagagggcgccccccggcgtgcgccccgccctcggggaaagccggcggcttcctggcgcttggactggtgcgactccaccccggcggtgtacaggctcgcgcggtcctccttcccgctccagcggggggtggacgatgtcctccgtcggccccgacccctcacacttccggcacagcggcaccctgtccatcctgctcccccagcatccctctgccttcttttacctacccacaaaccccgatgatctctcccttggctctaccccccctgcgacatacgagagttcagaaaagtagccaggggcctccgatgccaacattgcaatgagtaagaagggcacctcacaacatatatcaacccgcaccattgttcggtattggaggatcaacactataaggagtgggtgaccaaggtatttagacgacgtaataaaccatacacatcgcgccggtgtgatctg

SEQ ID NO: 26629 - DNA, 740 bp, Zea mays
  misc_feature: Ceres CLONE 1399369-F
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (181)..(181): n is a, c, t, g, unknown, or other
  misc_feature (186)..(186): n is a, c, t, g, unknown, or other
  misc_feature (642)..(642): n is a, c, t, g, unknown, or other
  misc_feature (649)..(649): n is a, c, t, g, unknown, or other
  misc_feature (666)..(666): n is a, c, t, g, unknown, or other
ccagctggagctcaccgcggtggcggccgctctagactagtggatcccccgggctgcaggaattcgcacgagaccattacctagaacatcctaatcgaaaaatactgtacaggccaattcgttcgcagactcgccaaactgctgccccgagcggccgagcccccccccccccaaannnncnggagnttgaaatactcaggttttcctcctcgccgtgtcggtcctcgccttgtctcgcccccaaatccaacccaaactcctccaagctccgtccctggcctgcctcccccataccccaagggcacaggccgccctctggttagatgtacactcgcacaccaccagcacaatgagcgacccccttatctcacccaaattcttacccccccccaggggccggggggggggattgtatattttccttttgttaggcgtgtggtccccggtcaaaaatgggtatggcccggggaggcccgacactctccttcctctgggtctccctcccgaaaagcattcgtgtgggcccccgccgctctcctatcggcggggagccctattgtctttacaaggcgtttctgataatgtttccccccgggcggcgttgctactgccttctcggtccctttttctcttctccggggngaacacnaacacgcctccctgttnctctcttcccctctctttcgcccccttgccaccgaggctacaattcccctccaacccccgccgaccccgccgcc

SEQ ID NO: 26630 - DNA, 681 bp, Zea mays
  misc_feature: Ceres CLONE 1399374-F
  misc_feature: Translation starting site: 268
  misc_feature (681)..(681): n is a, c, t, g, unknown, or other
aaagctggagctccccgcggtggcggccgctctagaactagtggatcccccgggctgcaggaattcgcacgagaccattacctagaacatcctaatcgaaagcaggagaaaccaaagaaaagttgctttttctttattttcttcgtcctcttgttctcgactcgctgcccactgcgtcacccgaatcccttcgatccaatctccaaaccctaggcagcccgccatcagattgttaggtcctccttccttaaaccgcggcggccggccatgtcccacggcggcggcggcgggagggcgaaagtgacgccgaacctggcggtggacggcgagggcacgcggacgctcaatctcaccgtgctgcagcgcctcgaccacgccgttgaggacatcctcatcaccgcggctcacgtcacgctctacgacttcgacaccgacatcaaccagtggagccggaggaaccgtggaggggtcgctctttgtcgtcaagaggaatgctcaacccagattccagttcattgtcatgaatcgcaggaatcagattatctagttgaagatctttttgggagattttgaataccaactacaagctccttatataatgtaccgcaatgttgctcaagaagtattaaggaaatctggttttacattttcccaggagtgtcaacagtttgcaaatctttn

SEQ ID NO: 26631 - DNA, 592 bp, Zea mays
  misc_feature: Ceres CLONE 1399378-F
  misc_feature: Encodes the peptide sequence at SEQ ID NO. 26632
  misc_feature (230)..(230): n is a, c, t, g, unknown, or other
  misc_feature (294)..(294): n is a, c, t, g, unknown, or other
  misc_feature (308)..(308): n is a, c, t, g, unknown, or other
  misc_feature (323)..(323): n is a, c, t, g, unknown, or other
  misc_feature (371)..(371): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (418)..(418): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (531)..(531): n is a, c, t, g, unknown, or other
  misc_feature (535)..(535): n is a, c, t, g, unknown, or other
  misc_feature (592)..(592): n is a, c, t, g, unknown, or other
aaagctggagctccccgcggtggcggccgctctagaactagtggatcccccgggctgcaggaattcgcacgagaccattacctagaacatcctaatcgaaaaatcaatcaaatactcacaagcatggggcaccaggcgcagcacgccacggacgacaccgaggagctgctggcagcgcaccgcgagctgtggtgccatgcccttgggctacgtcaagtccatggcgctcnatgcgccttggacctgcgcatccccgacaccatccaacgctgcggcggaagcgccacccctagncagctgctcgccgncagcgaggtcccggngtccaaccctcgctaactccgacgggtcatgcgcacgctgacgctggntttttttttttcgggggggttnnnnnnnnnnntttccnnnnnngggncggnnnnnnttttgnnnnnnnnnnngnnnngccgtttttcctttcggggttcccccccgggggtcccccccggtgctttccccccgggggggggggnnnncgggccccccctngggntttttttggggggggttttttcccccccttttttccggcgcgcgggggggggttccn

SEQ ID NO: 26632 - protein, 71 aa, Zea mays
  misc_feature: Ceres CLONE 1399378-F
  misc_feature (36)..(36): Xaa is any aa, unknown, or other
  misc_feature (57)..(57): Xaa is any aa, unknown, or other
  misc_feature (62)..(62): Xaa is any aa, unknown, or other
  misc_feature (67)..(67): Xaa is any aa, unknown, or other
MGHQAQHATDDTEELLAAHRELWCHALGLRQVHGAXCALDLRIPDTIQRCGGSATPXQLLAXSEVPXSNPR

SEQ ID NO: 26633 - DNA, 620 bp, Zea mays
  misc_feature: Ceres CLONE 1399379-F
  misc_feature (261)..(261): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (475)..(475): n is a, c, t, g, unknown, or other
  misc_feature (476)..(476): n is a, c, t, g, unknown, or other
  misc_feature (552)..(552): n is a, c, t, g, unknown, or other
  misc_feature (596)..(596): n is a, c, t, g, unknown, or other
aaagctggagctcaccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagnctagccagcacttacagaaaggggcgtgggnnnaggaaatccccggggaaaagaaaattttgcaaggggggggggattaaaaaataaaatttagaaaatcccgggggggagaaaaaaaaaaaaaaagggccgccccccccatttttttttgcgggaaacaaccccctgtttgtggggggggcccccccccccccccccccgggggggggggggnnccccccccccccccccccccccccctggggggggaaggaaaccccaacaccccccgcccccccccccccccccctnttttttctctctccttgcggggggggggggggggggggggtttntacctactcggccgccctccttcg

SEQ ID NO: 26634 - DNA, 665 bp, Zea mays
  misc_feature: Ceres CLONE 1399380-F
  misc_feature: Encodes the peptide sequence at SEQ ID NO. 26635
  misc_feature (262)..(262): n is a, c, t, g, unknown, or other
  misc_feature (285)..(285): n is a, c, t, g, unknown, or other
  misc_feature (665)..(665): n is a, c, t, g, unknown, or other
atagctggagctccccgcggtggcggccgctctagaactagtggatcccccgggctgcaggaattcgcacgagaccattacctagaacatcctaatcgaaaatcggtccctcctctgcttcacacagaccagtgcgcgctcaattcccccctctagcgcctccaccgcaccaaaccggtccaacgggacctatgctctagcctcagagcaaaccaccgcctgaattgggcggcaattgggggaggattcgcggcaggcaggncgcgggatccgttgtcgggatgnattgcggctgtcaacagagtgccggcgggctggggcgaggatgagatgtccgtgctgccgcggacaccaagggtggtggtcaccggcaacaaccgcacccagtcggtgctcgtgagattggcacgcggtccagaaaaaaagccgtcggccctcggaggagggcatttggctggtccttaactaatgggaatagagggaaaagctggaggcgcaaaggtttaaaggggggataaaacccccacgcattgggcgagggagattggggatgacctgttggtttggggaaaacattgcatgggaaatttgtctggatttgtggtgctcccgaggaaagtcaccgaatatcccgactgccaccccgggggggagggggagagtgn

SEQ ID NO: 26635 - protein, 44 aa, Zea mays
  misc_feature: Ceres CLONE 1399380-F
MSVLPRTPRVVVTGNNRTQSVLVRLARGPEKKPSALGGGHLAGP

SEQ ID NO: 26636 - DNA, 744 bp, Zea mays
  misc_feature: Ceres CLONE 1399381-F
  misc_feature (744)..(744): n is a, c, t, g, unknown, or other
gctctagaactagtggatcccccgggctgcaggaattcgcacgagaccatacctagaacatcctaatcgaaaagttcctttcgggccgcttcgtggtggcgccgtggcgcccaccaccacctcacctctcagtctctcaccacctatagcaataccacgagtccacgatccatggaatagactagactacaccgctcggccggtgacgacgacggcgacagccgacagtctatccccaactacgctctgcaccagcgccttatccgccgccctggggtttgtttttggcgcggttgcccagctgataaaggcccaaaggcattaaagcatgggacacccccctgccgatgagggttgggggatccctggcaggtcccctcctttccccgcggcgcccccctcgggagggaaaaggggagtggcggccccaactacgactaaatgtgaggcttgggacattctagcatcacccaccccgcccctgactccatcattaccgtgcattctcctcccccccccatacttcgaccaccgcccacgtcacccctctcccgataatagaaccgccacgcgtggttcggcgggaggtcggggaggcaggtgctgcactcagactgtgggactgcgatggagtaggtacaccagaggcccgcagggggagggcgtagccgcgggcgtgatcggttaatgtaattcagccccctccgccgcctctccgcgcggacaggaccggcacggacgcan

SEQ ID NO: 26637 - DNA, 690 bp, Zea mays
  misc_feature: Ceres CLONE 1399384-F
  misc_feature (301)..(301): n is a, c, t, g, unknown, or other
  misc_feature (431)..(431): n is a, c, t, g, unknown, or other
  misc_feature (461)..(461): n is a, c, t, g, unknown, or other
  misc_feature (472)..(472): n is a, c, t, g, unknown, or other
  misc_feature (473)..(473): n is a, c, t, g, unknown, or other
  misc_feature (559)..(559): n is a, c, t, g, unknown, or other
  misc_feature (637)..(637): n is a, c, t, g, unknown, or other
tggagctccccgcggtggcggccgctctagaactagtggatcccccgggctgcaggaattcgcacgagaccattacctagaacatcctaatcgaaaaacaccgcaatcttcaatctccccagcaatccctagcagaagccttccatcctcactcgctcgatggcccgcacgaagcagacggcgaggaagtccaccggcggcaaggcgccgaggaagcagctggcgactaaggcggcccgcaagtctgcccctgcgaccggcggagtgaagaagccccaccgcttccgccccggcaccgtcngcgctccgggagatccgcaagtaccagaagagcacggagctgctgatccgcaagctgccgttccagcgcctgggtgcgggagatcgcgcaggacttcaagaccgacctacgcttccgaagctctgctgtnctccgcgctgcaggaggcggctgaggcctnaccttgtcggnnctcttcgaggacaccaacctctgcgccatccacgccaagcgcgtcaccatcatgcccaagaacatccagcttgccgccgcatccgngggggggagagggcctaagcgccatattttctgtcatcagtgcccgatcagaagatgaagaataatggtggggttccnggaagtttggggttactggcgaaaccatcggagggggggcctggtcccttgcg

SEQ ID NO: 26638 - DNA, 630 bp, Zea mays
  misc_feature: Ceres CLONE 1399386-F
  misc_feature: Encodes the peptide sequence at SEQ ID NO. 26639
  misc_feature (112)..(112): n is a, c, t, g, unknown, or other
  misc_feature (349)..(349): n is a, c, t, g, unknown, or other
  misc_feature (630)..(630): n is a, c, t, g, unknown, or other
gctctagaactagtggatcccccgggctgcaggaattcgcacgagaccattacctagaacatcctaatcgaaaaatcaaccatattattgagaccaacaagcaacatagaangtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttnatcgcccgttgttgtttcaacaatcgccagccctatccttttggtgcagtcattggtacaaaccatcagggcacaacagctggcagcaactcgtgctacctctgatcaacccaagtagctctggcaaaacctttctcccctactctcagcaaaaaacatttcttccattccaaccaattggctacactgaaacccggctggcttattttgcagcaccacctattaaccttttaacccgggtaggtactggccaaatcccaagaaaaaaaaacttttttccn

SEQ ID NO: 26639 - protein, 103 aa, Zea mays
  misc_feature: Ceres CLONE 1399386-F
  misc_feature (69)..(69): Xaa is any aa, unknown, or other
MATKIFSLLMLLALSTCVANATIFPQCSQAPIASLLPPYLPSIIASICENPALQPYRLQQAIAASNIPXIARCCFNNRQPYPFGAVIGTNHQGTTAGSNSCYL

SEQ ID NO: 26640 - DNA, 609 bp, Zea mays
  misc_feature: Ceres CLONE 1399390-F
  misc_feature: Encodes the peptide sequence at SEQ ID NO. 26641
  misc_feature (282)..(282): n is a, c, t, g, unknown, or other
aaagctggagctccccgcggtggcggccgctctagaactagtggatcccccgggctgcaggaattcgcacgagaccattacctagaacatcctaatcgaaaagcttcgtggccgccttttttcagagaaaacagagggaggaaagaaaaagctcacccccctctctcttcccaccacctctctcacgtgtgtgaggtggcgagcccaaggaggagcgggaggccacaagtccgatccgcccgtatctaatccgctcgagcgcagcggctcgttcctcgcggnggcgcacggttggcatttcgagtgctgagacatcggcttcattgaatcctaaagcacggttgagccatggctggctcccttgctgcctcagccttcttccctgggccaggggcgtctccagcagcatccgcgaagaacttggctggtgaagtaccggataggttgagcgtccgtggtattgtcgcaaaggctaatggcaattctggggacatggcagtgaaggctcaagcacaaacccttcccgaggttagtgggaccagggtaaccctcagaatggcagctcagacacagaggaggcgataccctacactgctcccagaacatcta

SEQ ID NO: 26641 - protein, 87 aa, Zea mays
  misc_feature: Ceres CLONE 1399390-F
MAGSLAASAFFPGPGASPAASAKNLAGEVPDRLSVRGIVAKANGNSGDMAVKAQAQTLPEVSGTRVTLRMAAQTQRRRYPTLLPEHL

SEQ ID NO: 26642 - DNA, 694 bp, Zea mays
  misc_feature: Ceres CLONE 1399391-F
  misc_feature: Encodes the peptide sequence at SEQ ID NO. 26643
aaagctggagctccccgcggtggcggccgctctagaactagtggatcccccgggctgcaggaattcgcacgagaccattacctagaacatcctaatcgaaaaacgcgcccacctcctctgctctctcctctcccccacctctgcgtccgtgcgttgtgtttgtttaggcgacaaccgcgaggcgcaatggcggccgggcgagagctggtggtgagtttcggcgagatgttgatagacttcgtgcccaccgtggcgggggtctcgctggcggaggcgccggccttcctcaaggcgcccgggggcgcgcccgccaacgtcgccatcgcggtctcgcgcctcggcggcggggacgtctttgtcgctaagctcgcggacggcgagtggggccgcatgctcatcgccctcctccgcgacaaaggggacagcaataggggagaagtattcgaacccggcgcgagaagcgaaggcagcctccgcacactgctaggagcacgccagtgggatggcccggtcacaacactagcacagcgcaggaacaggtccggccgggtgacgtactatgcggtggttcatggatctaaaggcacaaggtccttgcctagggtgccgccattctatcctccctgcattcttgcggtttcttctttgctctgtgctgtcatatgcttacccttgttctctgtttgttgtggtc

SEQ ID NO: 26643 - protein, 169 aa, Zea mays
  misc_feature: Ceres CLONE 1399391-F
  misc_feature: SWISSPROT Homolog: EC 2.7.1.4 Fructokinase
MAAGRELVVSFGEMLIDFVPTVAGVSLAEAPAFLKAPGGAPANVAIAVSRLGGGDVFVAKLADGEWGRMLIALLRDKGDSNRGEVFEPGARSEGSLRTLLGARQWDGPVTTLAQRRNRSGRVTYYAVVHGSKGTRSLPRVPPFYPPCILAVSSLLCAVICLPLFSVCCG

SEQ ID NO: 26644 - DNA, 618 bp, Zea mays
  misc_feature: Ceres CLONE 1399395-F
aaagctggagctccccgcggtggcggccgctctagaactagtggatcccccgggctgcaggaattcgcacgagaccattacctagaacatcctaatcaaaaaagtcccattctcatcccaattgggtgcgccatccccgcgcacacacacacgtcgagggagacgaagggataggagggagaggcagcgattgcaaagatggctagggctgggagcatgcacgcggcggatccaacaggccggataagcacactgctcgcgctgcgctagctcctcgccatgctctagccgctggccctgctcctgcccttccagtggcgcactcaacgggggcgttcgatgtcgcggcctccacgttggggctagcgggaaaaggggaaggcacgtcatcaatggtttacgggtgccggccgggtcgcccatggtcgccgtgcgaagggagatcgccacacgccgggcgcaggagaccgggcgggagtacgagctgatccccgggtagtggacatggtccatctcttgctattttggtcccctcacatctgctaggtggtggaattgctccgctttactctgctaatgcagctcgcttctggaatgtcttttgccttgcaggtttct

SEQ ID NO: 26645 - DNA, 592 bp, Zea mays
  misc_feature: Ceres CLONE 1399396-F
  misc_feature: Encodes the peptide sequence at SEQ ID NO. 26646
  misc_feature (249)..(249): n is a, c, t, g, unknown, or other
  misc_feature (339)..(339): n is a, c, t, g, unknown, or other
  misc_feature (385)..(385): n is a, c, t, g, unknown, or other
  misc_feature (441)..(441): n is a, c, t, g, unknown, or other
  misc_feature (444)..(444): n is a, c, t, g, unknown, or other
  misc_feature (450)..(450): n is a, c, t, g, unknown, or other
  misc_feature (452)..(452): n is a, c, t, g, unknown, or other
  misc_feature (514)..(514): n is a, c, t, g, unknown, or other
  misc_feature (550)..(550): n is a, c, t, g, unknown, or other
cgctctagaactagtggatcccccgggctgcaggaattcgcacgagaccattacctagaacatcctaatcgaaaaattatcgatcccagccccaggccatggcgacgaggtggaggaggtcgctgctctgggtcgccgtcgtccagttcctgaccctgtgcgtcgccgagcatctcgtagtggaagcatacaaaaagtcctacattgtgtatctgggatcacatgcatatggccgtgatgcgtcggcgnaggagcatgctcgcgcaacccagtctcaccaccacctcctggcatcgatcctcggcggcgacgacgaccaccaccatgagacggcgcggnagtccatcttctactcctacaccaagagcagcatcaatggcttcgncgcgcacctgaaggagtcggtcgcgcagcagatcgcggagcaccctgaggtgttgncgntgctgnanaagcagatgctcaagctgcacaccacgcggtcctgggacttcatggacctggagcgcgacgntcacggcctccctggctcatctggaccacgctaggntcggacaggacgtctcatcgccagctcgaaaggcggagtgtg

SEQ ID NO: 26646 - protein, 149 aa, Zea mays
  misc_feature: Ceres CLONE 1399396-F
  misc_feature (33)..(125): Pfam Name: Subtilisin_N Pfam Description: Subtilisin N-terminal Region
  misc_feature: SWISSPROT Homolog: EC 3.4.21.25 Cucumisin
  misc_feature (51)..(51): Xaa is any aa, unknown, or other
  misc_feature (81)..(81): Xaa is any aa, unknown, or other
  misc_feature (96)..(96): Xaa is any aa, unknown, or other
  misc_feature (115)..(115): Xaa is any aa, unknown, or other
  misc_feature (116)..(116): Xaa is any aa, unknown, or other
  misc_feature (118)..(118): Xaa is any aa, unknown, or other
  misc_feature (139)..(139): Xaa is any aa, unknown, or other
MATRWRRSLLWVAVVQFLTLCVAEHLVVEAYKKSYIVYLGSHAYGRDASAXEHARATQSHHHLLASILGGDDDHHHETARXSIFYSYTKSSINGFXAHLKESVAQQIAEHPEVLXXLXKQMLKLHTTRSWDFMDLERDXHGLPGSSGPR

SEQ ID NO: 26647 - DNA, 672 bp, Zea mays
  misc_feature: Ceres CLONE 1399399-F
  misc_feature: Translation starting site: 261
  misc_feature (383)..(383): n is a, c, t, g, unknown, or other
  misc_feature (472)..(472): n is a, c, t, g, unknown, or other
  misc_feature (498)..(498): n is a, c, t, g, unknown, or other
  misc_feature (571)..(571): n is a, c, t, g, unknown, or other
  misc_feature (580)..(580): n is a, c, t, g, unknown, or other
aagctggagctccccgcggtggcggccgctctagaactagtggatcccccgggctgcaggaattcgcacgagaccattacctagaacatcctagtcgaaaaatatccactattctctaggaagcaagggaatcacatcgccatggcagccaagatgtttgcattgtttgcgctcctagctctttgtgcaaccgccactagtgctacccatatcccagggcacttgtcaccactactgatgccattggctaccatgaacccatggatgcagtactgcatgaagcaacagggggttgccaacttgctagcgtggccgaccctgatgctgcagcaactgttggcctcaccgcttcagccgtgccagatgccaatgatgatgccagntatgatgccaccgatgacaatgatgccgatgccgaatatgatgccatcgatgatggtgccgactatgatgtcaccaataacgatagtantaatgatgccaccgatgatgatgccnaacatggtttcaccaatgatgatgccgagtatgatgccttcgacgatgacgccaggaaatgatgccaccgatnatgatgccnagtatgataccaccgatgatgatgcccgagcatggtgtcatcaatgataatgccaaacatgatgacagtgccacaatggtactctgattcca

SEQ ID NO: 26648 - DNA, 615 bp, Zea mays
  misc_feature: Ceres CLONE 1399401-F
  misc_feature: Translation starting site: 373
  misc_feature: SWISSPROT Homolog: EC 1.11.1.7 Peroxidase
  misc_feature (300)..(300): n is a, c, t, g, unknown, or other
  misc_feature (405)..(405): n is a, c, t, g, unknown, or other
  misc_feature (406)..(406): n is a, c, t, g, unknown, or other
  misc_feature (434)..(434): n is a, c, t, g, unknown, or other
  misc_feature (486)..(486): n is a, c, t, g, unknown, or other
  misc_feature (491)..(491): n is a, c, t, g, unknown, or other
  misc_feature (517)..(517): n is a, c, t, g, unknown, or other
  misc_feature (578)..(578): n is a, c, t, g, unknown, or other
tggagctccccgcggtggcggccgctctagaactagtggatcccccgggctgcaggaattcgcacgagaccattacctagaacatcctaatcaaaaagctttgtttttggtgtgtgcagctgggcggtccgagctacggcgtggagctggggcggctggacggcaagacgttcaacagggccatcgtgaagcacgtcctcccgggccccggcttcaacctggaccagctcaacgccctcttcgcgcagaacggcctcacgcagacggacatgatcgcgctctcaggcgcgcacacgatcngggtgacgcactgcgacaagttcgtgcggcggatctacacgttcaagcagcggctggcgtggaaccccgccgatgaacctggacttcctgcgctcgctgcggcgnntgtgccccctcagctacagccccacggngttcgccatgctggacgtcaccacgcccagggtcttcgacaacgcctacttncacancctccgctacaacagggggctgctcngctccgaacaggtgctcttcaccggacgcggctcccgacccacgtcaacctctttcgcggncaacgcaccgcttctacgaggattcgtcgccgcatgg

SEQ ID NO: 26649 - DNA, 695 bp, Zea mays
  misc_feature: Ceres CLONE 1399417-F
  misc_feature: Encodes the peptide sequence at SEQ ID NO. 26650
  misc_feature (546)..(546): n is a, c, t, g, unknown, or other
  misc_feature (547)..(547): n is a, c, t, g, unknown, or other
  misc_feature (571)..(571): n is a, c, t, g, unknown, or other
  misc_feature (596)..(596): n is a, c, t, g, unknown, or other
  misc_feature (628)..(628): n is a, c, t, g, unknown, or other
aaagctggagctccccgcggtggcggccgctctagaactagtggatcccccgggctgcaggaattcgcacgagaccattacctagaacatcctaatcgaaaaaatcccagatccacccctccccatctccatccgcggccatggcctccgccgacgccggcacttgcccgtgggatgccctcccgttgcacctccaggagcgaatcctctccctcctccccatcaccgaactacttcccgttgccgccgtgtcccgcgccttccaccgccttctgcgctccccgaccttccatgccctcctctccccgcatcgcctcgacgccttcttcctcctttccccacggctcgccgtccacccgctgtcccgccgcgtccgcactatgcccgcgttcgccgcgctctctcctccttcctacccgctcgtctcctccccgtccccatcactccttatcacctgcgcctcactccagttcctcccgccgatccccgacggagcctacctcctatccgctatcgtcccatcgcgcggctcctcccctcctgcannccttgtcgccgtcatcaccggcgncagccgcgcgttcttacaccctggnacaccggcatcccctcccccggcagtgggcgntcctagaggcgaatctccccgctgtctctcacgctctggaaaaaaaacgcggcggggtctccggatg

SEQ ID NO: 26650 - protein, 185 aa, Zea mays
  misc_feature: Ceres CLONE 1399417-F
  misc_feature (9)..(56): Pfam Name: F-box Pfam Description: F-box domain
  misc_feature (136)..(136): Xaa is any aa, unknown, or other
  misc_feature (144)..(144): Xaa is any aa, unknown, or other
  misc_feature (163)..(163): Xaa is any aa, unknown, or other
MASADAGTCPWDALPLHLQERILSLLPITELLPVAAVSRAFHRLLRSPTFHALLSPHRLDAFFLLSPRLAVHPLSRRVRTMPAFAALSPPSYPLVSSPSPSLLITCASLQFLPPIPDGAYLLSAIVPSRGSSPPAXLVAVITGXSRAFLHPGTPASPPPAVGXPRGESPRCLSRSGKKTRRGLRM

SEQ ID NO: 26651 - DNA, 654 bp, Zea mays
  misc_feature: Ceres CLONE 1399422-F
  misc_feature: Encodes the peptide sequence at SEQ ID NO. 26652
  misc_feature (549)..(549): n is a, c, t, g, unknown, or other
  misc_feature (604)..(604): n is a, c, t, g, unknown, or other
aagctgggactccaccgcggtggcggccgctctagaactagtggatcccccgggctgcaggaattcgcacgagaccattacctagaacatcctaatcgaaaaatccgactaaaaagggccagggccagggccttcgcttgcttactactcctgcttaccacactctaccttgtctcttcacgtgcacacgacgactcccccaatgtctgcggtgacggaggaggaggtgatcgtcgtcggcgcggcgcagtcggggctagcggtggcggcgtgcctgtccctgcgcggtgtgcgggcgctggtcctggagcgcgacgactgcgtggggtcgctgtggagaaagcgcgcctactaccgcctccacctccacctcaccaagaagtactgcgcgctgccgcacgcgccgcacccggacgaggcccccgcgtacctgcaccgcgacgacttctcgcggtacctggacggtgacgccgcgcgagttcgccgtccgcccgcgcctccgccgcgaggtccggtcggcgcggtacgaccccgcgagcgcgcggtggnaaaggtgtaggtcgtggacctcggcacgtgccaggacgagcagaactcggcgagntttcatgggtggtcgcgtaccggctaaaacgtcgagaagtccctgccgta

SEQ ID NO: 26652 - protein, 118 aa, Zea mays
  misc_feature: Ceres CLONE 1399422-F
  misc_feature (6)..(86): SWISSPROT Homolog: EC 1.14.13.8 Flavin-containing monooxygenase
  misc_feature (1)..(36): SWISSPROT Homolog: EC 6.3.2.9 UDP-N-acetylmuramoyl-L-alanine--D-glutamate ligase
  misc_feature (116)..(116): Xaa is any aa, unknown, or other
MSAVTEEEVIVVGAAQSGLAVAACLSLRGVRALVLERDDCVGSLWRKRAYYRLHLHLTKKYCALPHAPHPDEAPAYLHRDDFSRYLDGDAARVRRPPAPPPRGPVGAVRPRERAVXKV

SEQ ID NO: 26653 - DNA, 631 bp, Zea mays
  misc_feature: Ceres CLONE 1399425-F
  misc_feature: Encodes the peptide sequence at SEQ ID NO. 26654
aaagctggagctccccgcggtggcggccgctctagaactagtggatcccccgggctgcaggaattcgcacgagaccattacctagaacatcctaatcgaaaaacggcccaccccgatctcataatcgtcgtcttctcccacttcgacgcggctagggacggcgctaccatctcctcttctcttccggcggcttctccgtcccgtcgatcaaccgcgccgccttcgccagtataccccgcattgaggcgtcatcgttacctgcgccgaccggcacctctgtagcctcttctccaggggttgcacgaggaggaggaggttcgggcttcgccatgtcgaagtcgaacctagatgatttgcttctgcaggcagccggccggacggggaagaacactcccggccgagcaacccgcggtggaactctgggggaagcggctccgacggcttcgacgacgacgactcggaagccgcgccgacctactcgaggaaagaagcttcgtcgcaagttccgctcaagaagcggcaccagccagagcagggcggccggcgtggcagtggcggttggaaggacgaggacgacgaggaacaagacgggcgccgcagtggggggcaggactcggaaagcgccccttcg

SEQ ID NO: 26654 - protein, 100 aa, Zea mays
  misc_feature: Ceres CLONE 1399425-F
MSKSNLDDLLLQAAGRTGKNTPGRATRGGTLGEAAPTASTTTTRKPRRPTRGKKLRRKFRSRSGTSQSRAAGVAVAVGRTRTTRNKTGAAVGGRTRKAPL

SEQ ID NO: 26655 - DNA, 675 bp, Zea mays
  misc_feature: Ceres CLONE 1399428-F
  misc_feature: Encodes the peptide sequence at SEQ ID NO. 26656
  misc_feature (502)..(502): n is a, c, t, g, unknown, or other
  misc_feature (596)..(596): n is a, c, t, g, unknown, or other
  misc_feature (667)..(667): n is a, c, t, g, unknown, or other
aaagctggagctccccgcggtggcggccgctctagaactagtggatcccccgggctgcaggaattcgcacgagaccattacctagaacatcctaatcgaaaaactcatccattccatcatcccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggcatcgcctgggccttcggcggcatgatcttcgtcctcgtctactgcaccngccgcatctcggggggccacatcaaccccgccgtcaccttcggcctcttcctggcgcgcaaggtctccctggtgcgcgcgctgctctactccgntggcgcagtggctcggccccatcctgcggcgtcggctttcgtcaaggcgtttcagagcgcctacttcgacngggggacg

SEQ ID NO: 26656 - protein, 161 aa, Zea mays
  misc_feature: Ceres CLONE 1399428-F
  misc_feature (34)..(160): Pfam Name: MIP Pfam Description: Major intrinsic protein
  misc_feature (104)..(104): Xaa is any aa, unknown, or other
  misc_feature (135)..(135): Xaa is any aa, unknown, or other
  misc_feature (159)..(159): Xaa is any aa, unknown, or other
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTXRISGGHINPAVTFGLFLARKVSLVRALLYSXGAVARPHPAASAFVKAFQSAYFDXGT

SEQ ID NO: 26657 - DNA, 855 bp, Zea mays
  misc_feature: Ceres CLONE 1399429-F
  misc_feature (1)..(1): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (41)..(41): n is a, c, t, g, unknown, or other
  misc_feature (42)..(42): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (597)..(597): n is a, c, t, g, unknown, or other
nggggcccccccccccnnnnccctagcccccaccccgagannattnnnnnnnnnccaaagctggagctccccgcggtggcggccgctctagaactagtggatcccccgggctgcaggaattcgcacgagaccattacctagaacatcctaatcgaaaacgcaaacccctctcgatcgacacacgcagccgcgacccatcgcgacctgacccgaccctcccgaggccgccagccttatcctctccgcctccgcctcccgccgtcccctccgacccatcacaagcgcgagtagaagacatggcctcgacgttcggtgccacttctacagttggccttatggctgctccaacggggaaagaatgtgcgccttcagaggagggctaacttcagagtaaaagcggcctaaaggagctggacttcaaccacgatggggtcaggtaatgcaggaaacctccaagactggaagtcaattaaagcttggaaaaccctagttgggaagtaaccctccggaacccaaagggaaagggaaaggccccttttttggaaaaagacaaggaacgggtctcccccccaaaaatgtgttaaaacgaaggggggntttaaccgtgtgcacaaaaaaaagggtttctacccctggtaaaacccccccgggtgggaaaaaaaattggggaccctaaaaatttggggccagggggaaggcgcggcgccctaaaaaccaccccaccctctttttgggtggggaaggggcaaaaacccccccccctctgggggggcccccgtgcccgcggcgcggggaatctatccccaccggacataaaataagacagcagccgggcacaactggacagcgcgaaag

SEQ ID NO: 26658 - DNA, 635 bp, Zea mays
  misc_feature: Ceres CLONE 1399430-F
  misc_feature: Translation starting site: 230
  misc_feature (263)..(263): n is a, c, t, g, unknown, or other
  misc_feature (264)..(264): n is a, c, t, g, unknown, or other
aagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctgnncgcggcgcttgctggcatggtgtggcgtccgtgctccaagaacggcggtgtcgacggcctcccggcggggcctcccggtttggcggtggtggggacctggtcccagtgatcctgcagggagggccttcatgtacggggtgcgcgacctccgggagagtacgggcccatcttcccatggggatgggcaccgcaccctcatcgtggtcacctcggcggagctcatccacaaggcgctggggaaacaaggccccatgtttccgagccgggccgaggacaccccacccgcctctcttcagggtgggaaggtgaccggtaattcgggccctacggcccctggggggggctcttgccccaaactcgtcgcggagatg

SEQ ID NO: 26659 - DNA, 670 bp, Zea mays
  misc_feature: Ceres CLONE 1399434-F
  misc_feature (90)..(90): n is a, c, t, g, unknown, or other
  misc_feature (177)..(177): n is a, c, t, g, unknown, or other
tccccgcggtggcggccgctctagaactagtggatcccccgggctgcaggaattcgcacgagaccattacctagaacatcctaatcgaanaatttttcgcccgccgcccccagtcccgatccgaagctgtgcctcgtaccatttcgatcccatggcgccgacgtcgaagctgtcgancggcatcaagcgcgcttcgcggtcgcacgcgtaacatcgccgtgggctgggggccatcagggccaagaacgggggggccttccccaaggccgaaaaggccccccccgcccgggaaaaccaagtttaacctggcgaaaaaggtaagccccgggttcccaggacccgaaagccaaacctaaccagggccaggggggggatccccgccgggaaaggggttggatcccccctccccaagggggttcttgggggaaaaaaagggggttttttcaaaagaaataaaaggggggggggtcttttatttttgggggcttttaaaaaaaaagggggggaacaaaccccccgggggggaacaaaacctagttttttgttttataacccccaacggggggcccctccgcgggggggggggccccccccctttttaccacaaacttcctccgccgcggggaaaaaataagggggcgcgaaacacccgcgggcgcgcccttctttg

SEQ ID NO: 26660 - DNA, 722 bp, Zea mays
  misc_feature: Ceres CLONE 1399437-F
  misc_feature: Encodes the peptide sequence at SEQ ID NO. 26661
  misc_feature (482)..(482): n is a, c, t, g, unknown, or other
cgctctagtactagtggatcccccgggctgcaggaattcgcacgagaccattacctagaacatcctaatccaaaaatcacctataatattttgagcattcagaaacacaccaagcgaagcacattagcaacaacctaacaacaatggctaccaagatattatccctccttgcgcttcttgcgctttttgcgagcgcaacaaatgcgttcattattccacaatgctcacttgctccaagttccattattacatagttcctcccaccagttacttcaatgggcttcgaacacccagctgtgcaagcctataggctacaacaagcaattgcggcgagcgtcttacaacaaccaatttcccagttgcaacaacaatccttggcacatctaacaatacaaaccatcgcaaacgcacagcaacaacaattcctaccagcactgagccacctagccatggtgaacccctgccgctacttgcaacagcangtgcttgcatcaaacccacttgctctggcaaacgtaggtgcaaaccagccaccacaacagctgcaacagttttctgccagcgttcagtcaattaggcatggtgagaccctgccgcctacctacaaaggaacaactggtttcttttagcccgctccgttggggccatggcccctaatacctggaaaaaaattggtgcaaaaaattgaccagcttgaccccctaagtggggaaaacccgctt

SEQ ID NO: 26661 - protein, 59 aa, Zea mays
  misc_feature: Ceres CLONE 1399437-F
  misc_feature (11)..(11): Xaa is any aa, unknown, or other
MVNPCRYLQQXVLASNPLALANVGANQPPQQLQQFSASVQSIRHGETLPPTYKGTTGFF

SEQ ID NO: 26662 - DNA, 652 bp, Zea mays
  misc_feature: Ceres CLONE 1399442-F
  misc_feature: Encodes the peptide sequence at SEQ ID NO. 26663
aaactggagctccccgcggtggcggccgctctagaactagtggatcccccgggctgcaggaattcgcacgagaccattaccagaacatcctaatcgaaaaacaacaccagaatccgcgaatcacagacgcgtctatctcagcttgctgcactgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgctccaccgtgtacagcacgctgatgccgtgcctgccgttcgtccagatgggcggggccatgccgccccagccgtgctgcggcggcatccgcagcctgctgcagcaggccaacaacacccccgaccgccggcacatctggcggttgccttcagaaaagtgcccaaacggggcccaaggggagggggaacctaaattttaccgggcccccccgggtgtcccaaaaaagggggggggcccccccgcccaaaaaaaacccccccccggttattggcgcccctttatattagggtttgggggcccctgggccccccccccaaaaaaaaattttaagggcttttcaaa

SEQ ID NO: 26663 - protein, 145 aa, Zea mays
  misc_feature: Ceres CLONE 1399442-F
MAAPKLATLALAVLLAATVVAPPAAVRAAMSCSTVYSTLMPCLPFVQMGGAMPPQPCCGGIRSLLQQANNTPDRRHIWRLPSEKCPNGAQGEGEPKFYRAPPGVPKKGGGPPAQKKPPPGYWRPFILGFGGPWAPPPKKNFKGFS

SEQ ID NO: 26664 - DNA, 698 bp, Zea mays
  misc_feature: Ceres CLONE 1399443-F
  misc_feature: Encodes the peptide sequence at SEQ ID NO. 26665
  misc_feature (514)..(514): n is a, c, t, g, unknown, or other
  misc_feature (698)..(698): n is a, c, t, g, unknown, or other
aaagctggagctccccgcggtggcggccgctctataactagtggatcccccgggctgcaggaattcgcacgagaccattacctagaacatcctaatcgaaaaatttgaacctccaagttcagaaactgaccccctcgtccctccccaccatcgcgatggctgacgacgccgcggcggcggcgttcgcgccctctccctcgccaccgtcacccgtagcgcaacctctgcccgacctctccccgccgccgcccttctccccaccagccggccccctgcttccggggcgcagacgccgagcctcccggacaccccggcctccctagatccggacacccccttctccgacgccaccccgacccccgccgacgcctccgacgccgccctcgcttcggacgacggcatcaccaacccgtcggggggcaccgccggcaagcacatgacgctcgcgccgcccgccccgcccgccaagaaaccgtccaagagaagggcggcaacagcgtctggacccgcccgncctcccgcaaggcaagaagaaagcgaggcagcggggcggctcggccacgggttccgggggccccgccggggccgccagaggctccaaaccctaaggcccaaccccgggggggaggaagaatttcttccttggcccccgggaaccggctttccggccaaagggttcccaaaaaccgcccgggcan

SEQ ID NO: 26665 - protein, 87 aa, Zea mays
  misc_feature: Ceres CLONE 1399443-F
MTLAPPAPPAKKPSKRRAATASGPARPPARQEESEAAGRLGHGFRGPRRGRQRLQTLRPNPGGEEEFLPWPPGTGFPAKGFPKTARA

SEQ ID NO: 26666 - DNA, 690 bp, Zea mays
  misc_feature: Ceres CLONE 1399447-F
  misc_feature (155)..(155): n is a, c, t, g, unknown, or other
  misc_feature (261)..(261): n is a, c, t, g, unknown, or other
  misc_feature (312)..(312): n is a, c, t, g, unknown, or other
  misc_feature (355)..(355): n is a, c, t, g, unknown, or other
  misc_feature (364)..(364): n is a, c, t, g, unknown, or other
  misc_feature (440)..(440): n is a, c, t, g, unknown, or other
gctctattactagtggatcccccgggctgcaggaattcgcacgagaccattacctagaacatcctaatcgaaaagtcgcctgccttcccttccttccccagttgagttccccccgcggccccgcccccggtccccttccaccgacccaccatggntcggcgatgaggtgaggttgaggccaggtctactctccgcgaccgtcgccgacgccatcgccaacgagcagtttgctccatcttcgccatctcgcacacgaatacnatacactagttttggtagagatggaggacggcggcaaggcgccggccgggnctggggcaccctggcgcgcggtgctccgccatcctccagtggntggggcttncacgtcacccgtcatcatcatggaacagtgggatcttccagaaaactggatttccaggttcctcctcaccgggggnctggcggccacctcaatctgggtcttccaatgggaagttaacattgggatcccatgggccccaagggcgaaaccccctggtttcaagtttaaaccggagggaccccctggaaaaaaggatatttcccaaaggcccttccgcctcttgggaaaaaaaaattgggggttgggaaaaaggggacattttgggaaaaaaacccccgggttccttttggggggaaaaaaaaaaaaattttttccccccccggggg

SEQ ID NO: 26667 - DNA, 625 bp, Zea mays
  misc_feature: Ceres CLONE 1399449-F
  misc_feature: Encodes the peptide sequence at SEQ ID NO. 26668
  misc_feature (396)..(396): n is a, c, t, g, unknown, or other
  misc_feature (452)..(452): n is a, c, t, g, unknown, or other
  misc_feature (492)..(492): n is a, c, t, g, unknown, or other
tggagctccccgcggtggcggccgctctagaactagtggatcccccgggctgcaggaattcgcacgagaccattacctagaacatcctaatcgaaaactgtttaccgaattcctaaatccaatccccttgccaagctctctctttgctgcgggaggtcgaggccggagaggtcttctgggatgggatcaagaaaggggtggttccccgtggccctcctgctgttggccgactctgccctctggccgccggtcgccgccgccgccgccggaggcggcgaggccgaacacgccgttcagcagcatagcgagcgcatctcagggagtgctggtgatgtgttaaaagataatcctgtgggtaggttgaaggtcttcatttatgacttaccaaggaagtancacaagaagatggtcaccaaggattcacggtgcctcagtcacatgtttgctgctgnaattttcatgcatcgtttcttgctctcgagtgctgtccgnacactaaatcccaggaaaggtgattggttctatacaccagtttacactacttgcgatttaactaacgctggattgcccttggcgtttaagcaccacgggtgatgaggagcggatccatatatttcaacaatgg

SEQ ID NO: 26668 - protein, 137 aa, Zea mays
  misc_feature: Ceres CLONE 1399449-F
  misc_feature (72)..(72): Xaa is any aa, unknown, or other
  misc_feature (91)..(91): Xaa is any aa, unknown, or other
MGSRKGWFPVALLLLADSALWPPVAAAAAGGGEAEHAVQQHSERISGSAGDVLKDNPVGRLKVFIYDLPRKXHKKMVTKDSRCLSHMFAAXIFMHRFLLSSAVRTLNPRKGDWFYTPVYTTCDLTNAGLPLAFKHHG

SEQ ID NO: 26669 - DNA, 629 bp, Zea mays
  misc_feature: Ceres CLONE 1399456-F
  misc_feature: Encodes the peptide sequence at SEQ ID NO. 26670
  misc_feature (12)..(12): n is a, c, t, g, unknown, or other
tggagctcccgnggtggcggccgctctagaactagtggatcccccgggctgcaggaattcgcacgagaccattacctagaacatcctaatcgaaaaaactcccccggccgtcctgctcgccggcttctggctggcccctgcatccgcccagggaatcgattcgttcatccaagtgaaggcaaccagactccaggatggagttcaaagccggcgttttcaccgtggcaatgctagccatcgtcgtgctctccacaccagcagccccgcagaagcccaagagccctcccgctccgcgatccccagtcgtcctggcgccggcgccagcgcccgcaccggcggcgccgcaccacgtggacctcgcggacctcctcagcgtggccgggccgttccacacgttcctggactacctgcagaagaccggcgtcatcgagaccttccagagccaggcgaacgacacgaagcggggcggcatcaccgtcttcgtgcccaaggactcggcgttcgcggcgctgaagcagaccacgttcgccaacctcacccaggaccagctcaggtcgctgctgctgtgccacgcgctgcccaagtactactcgctggccgagttcgaccggctgagcgcgctcggcccg

SEQ ID NO: 26670 - protein, 145 aa, Zea mays
  misc_feature: Ceres CLONE 1399456-F
  misc_feature (64)..(145): Pfam Name: Fasciclin Pfam Description: Fasciclin domain
MEFKAGVFTVAMLAIVVLSTPAAPQKPKSPPAPRSPVVLAPAPAPAPAAPHHVDLADLLSVAGPFHTFLDYLQKTGVIETFQSQANDTKRGGITVFVPKDSAFAALKQTTFANLTQDQLRSLLLCHALPKYYSLAEFDRLSALGP

SEQ ID NO: 26671 - DNA, 598 bp, Zea mays
  misc_feature: Ceres CLONE 1399460-F
  misc_feature: Encodes the peptide sequence at SEQ ID NO. 26672
  misc_feature (186)..(186): n is a, c, t, g, unknown, or other
  misc_feature (347)..(347): n is a, c, t, g, unknown, or other
  misc_feature (465)..(465): n is a, c, t, g, unknown, or other
  misc_feature (483)..(483): n is a, c, t, g, unknown, or other
  misc_feature (565)..(565): n is a, c, t, g, unknown, or other
  misc_feature (566)..(566): n is a, c, t, g, unknown, or other
aagctggagctccccgcggtggcggccgctctagaactagtggatcccccgggctgcaggaattcgcacgagaccattacctagaacatcctaatcgaaaagtaagagaggattttgctaggtttttgcccccaaccgcccaactgcgcgtgctcctgccgacctcccacccctccactccccggnggttggcggctgtctcgccgaagcgacccagccgatatggcgaagggcgacgacgcgctggcgcggaagcgcaaccgtgtgcgccgcaagcgcctccgtagcagcgagaacgctgtttccgcgcgtgtcgcggcgatcatcgcctccaagcaccgccgcanatcggggaagcgccgcgcctgcgagggcatgtgcttctcgctccccacgcccgacgacccgttcaacgagcgccatggcaggaagcacaagctcgatgacgagccggccgacgacacngccgccgaacgccgctgnaggacagcggcaaccccaaagaagaagggcgcgaacaccaaaaagcagcagccggtggcaaggtatggcgcccgaggcgaanntcgaaggcggttcgcgagagggagaacgggtg

SEQ ID NO: 26672 - protein, 125 aa, Zea mays
  misc_feature: Ceres CLONE 1399460-F
  misc_feature (42)..(42): Xaa is any aa, unknown, or other
  misc_feature (87)..(87): Xaa is any aa, unknown, or other
  misc_feature (115)..(115): Xaa is any aa, unknown, or other
MAKGDDALARKRNRVRRKRLRSSENAVSARVAAIIASKHRRXSGKRRACEGMCFSLPTPDDPFNERHGRKHKLDDEPADDTAAERRXRTAATPKKKGANTKKQQPVARYGARGEXRRRFARGRTG

SEQ ID NO: 26673 - DNA, 715 bp, Zea mays
  misc_feature: Ceres CLONE 1399465-F
  misc_feature: Encodes the peptide sequence at SEQ ID NO. 26674
aaagctggagctccccgcggtggcggccgctctagaactagtggatcccccgggctgcaggaattcgcacgagaccattacctagaacatcctaatcgaaaaaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggcctcgccacgccgcccaactgctagcagtgtgctagccaagccaagccaagcaggaaggcccccggcattgctagctgtacgtgtctgtgtgtgcatctgcagcagggtgcaggcaggggcccgtacgtacgtgtctctttctctctctcatcttgtcaccgtacctatctagagtgtgtgtgttcgtactaattaaatgttcttgtcgtcgtcgtctgtgcatgcag

SEQ ID NO: 26674 - protein, 115 aa, Zea mays
  misc_feature: Ceres CLONE 1399465-F
  misc_feature (41)..(115): Pfam Name: Tryp_alpha_amyl Pfam Description: Protease inhibitor/seed storage/LTP family
MAATSSKSSSSSSSAQRAAAALLVAAAVAVSVLVVGAAAVCDMSNEQFMSCQPAAAKTTDPPAAPSQACCDALAGADLKCLCGYKNSPWMGVYNIDPKRAMELPAKCGLATPPNC

SEQ ID NO: 26675 - DNA, 625 bp, Zea mays
  misc_feature: Ceres CLONE 1399470-F
  misc_feature: Encodes the peptide sequence at SEQ ID NO. 26676
aaagctggagctccccgcggtggcggccgctctagaactagtggatcccccgggctgcaggaattcgcacgagacattacctagaacatcctaatcgaaaaattcatcagacggactcacagctcgcagcacctgcaccacttgacaaccagccagctagctaaccaaccggcggagccaagaacaagcaagagacaacttgccccgtccaggcagcatgtgcaactccaacgtcaagtccgcgggcgtcgcccagatcgacggccgcccggtgctgcagccggcgggcaaccgcgtggcggagccggacgccgcccgcccgctcaagaagtccctgcacaagtccttctccatgccgccttcctacgacaacaatgccaccgtgcccgcccgtcccgcccctgccgagaacacccgtgcggcgccggcgccgccttctctgctgcctcctacgacgccggccccggccccggccgccgcgagggcgaccaaggcggcgggcgccgtgcccgcggagaagcccagtccaaggccaggaacccgggcgccgggctgccggtgccgacgtttgcggcgcaaaagggttccaagccggcggggaacattccccccgcgccgggcgacc

SEQ ID NO: 26676 - protein, 136 aa, Zea mays
  misc_feature: Ceres CLONE 1399470-F
MCNSNVKSAGVAQIDGRPVLQPAGNRVAEPDAARPLKKSLHKSFSMPPSYDNNATVPARPAPAENTRAAPAPPSLLPPTTPAPAPAAARATKAAGAVPAEKPSPRPGTRAPGCRCRRLRRKRVPSRRGTFPPRRAT

SEQ ID NO: 26677 - DNA, 659 bp, Zea mays
  misc_feature: Ceres CLONE 1399472-F
  misc_feature: Encodes the peptide sequence at SEQ ID NO. 26678
aaagctggagctccccgcggtggcggccgctctagaactagtggatcccccgggctgcaggaattcgcaagagaccattacctagaacatcctaatcgaaaagcactcatccattccatcatcccctttgcaagtatagtctctctgctaagcgaagcgaagcttcaagctagtctcggcggctctagaagacgatgggcaagaacgacgtgatcgagagcggcgctggtggcggcgagttcgctgccaaggactacacggaccctcccccggcgccgctgatcgacgcgccggagctggggtcctggtcgctgtaccgcgccgtgatcgccgagttcatcgccacgctgctgttcctgtacatcacggtggccaccgtgatcgggtactagcaccagacggacgcgtcggtgtcgggcgccgacgcgacgtgcgcaggcgtgtacgtgctgtccatcgcctgagccttcggaggtatgatcttcggcctcgtctactgcaccgccggcatctcggggggccacatcaaccccgacgtcaccttcggcctcttcctggcgcgcaaggtctcgctggtgcgcgcgctgctctacatcgtgtcgcagtgcctcggcgccatctgcggtgtcgggctcgtctaggcgttccagagcgcctac

SEQ ID NO: 26678 - protein, 65 aa, Zea mays
  misc_feature: Ceres CLONE 1399472-F
MGKNDVIESGAGGGEFAAKDYTDPPPAPLIDAPELGSWSLYRAVIAEFIATLLFLYITVATVIGY

SEQ ID NO: 26679 - DNA, 690 bp, Zea mays
  misc_feature: Ceres CLONE 1399474-F
  misc_feature: Encodes the peptide sequence at SEQ ID NO. 26680
  misc_feature (416)..(416): n is a, c, t, g, unknown, or other
  misc_feature (470)..(470): n is a, c, t, g, unknown, or other
  misc_feature (490)..(490): n is a, c, t, g, unknown, or other
  misc_feature (509)..(509): n is a, c, t, g, unknown, or other
gctctagaactagtggatcccccgggctgcaggaattcgcacgagaccattacctagaacatcctaatcgaaaaatactcctccggatccgtgttccatcacggctacaaaaatactccgcctgcatctccaaagcacacggctccctctggtttcccgcctcctcttcacctccttcgcgtcccgacgctccctcatggccgccgctgccgcagcagcagcagcagtttcctccccgattgctccacgcgctgtggccgccgcggcctcccgccgggggttcgtcacgtttggtggaggcgccgcccgctcctcgaccacgctgcggtccggccgcgggttctctggtgtgcaaacccatgttgccgctgttgaacaagcagttgtaaaagatgctacgaagctggaagctccangttgtgttgttacaggtgcctctagagggattggaaagcaactgctctagcccntggaaaagcagatgcaaggntctggtaaatatgctcggncttcgaaagagctgaagaggtctcaaagagatgaacatctggtgggaagctatcactttgaagagatggtcaaaagaactgatgaaagccatgatgaaagcactcataataatggggaacaaaaatgggctggaaatatggcggaataacccgaaacctttattgtgggatgaaaaaaccc

SEQ ID NO: 26680 - protein, 89 aa, Zea mays
  misc_feature: Ceres CLONE 1399474-F
  misc_feature: SWISSPROT Homolog: EC 1.1.1.100 3-oxoacyl-[acyl-carrier-protein] reductase
  misc_feature (74)..(74): Xaa is any aa, unknown, or other
MAAAAAAAAAVSSPIAPRAVAAAASRRGFVTFGGGAARSSTTLRSGRGFSGVQTHVAAVEQAVVKDATKLEAPXCVVTGASRGIGKQLL

SEQ ID NO: 26681 - DNA, 650 bp, Zea mays
  misc_feature: Ceres CLONE 1399477-F
  misc_feature: Encodes the peptide sequence at SEQ ID NO. 26682
  misc_feature (611)..(611): n is a, c, t, g, unknown, or other
tggagctccccgcggtggcggccgctctagaactagtggatcccccgggctgcaggaattcgcacgagaccattacctagaacatcctaatcgaaaaacaccgcacacgcacgcacgaacgcgctcccaccccctcccgccgcaaacgccgccaaaaccccggcccgactcggcgtcctccgccaacctcctcctgggcagcgccggcggggggatatggcatcggaggacgtggtgggcaagagcaggggcgacacggccgtcaccaccatcgtcaacctggcggaggaggccaagctcgcgcgcgagggggtcaaggcgcccggccaccagatcctcaccatctgcaagtcgctcgtcgccggcggcgtagcaggcggagtgtctcgtactgctgttgctccacttgaacgattgaaaatattgcttcaggttcaaaatccgcacagcatcaagtacaatggtactgttcagggtctcaagtatatctggagaacagagggcctccgtggacttttcaggggcaatggtaccaattgtgcaagggatgttccaaaatctgccgtgaagttttttagctacgagcaggcgtcaaaggggaatctgtgggnctaccgtcaacagactggtgaaagagatgctcagcttac

SEQ ID NO: 26682 - protein, 144 aa, Zea mays
  misc_feature: Ceres CLONE 1399477-F
  misc_feature (42)..(133): Pfam Name: Mito_carr Pfam Description: Mitochondrial carrier protein
  misc_feature (132)..(132): Xaa is any aa, unknown, or other
MASEDVVGKSRGDTAVTTIVNLAEEAKLAREGVKAPGHQILTICKSLVAGGVAGGVSRTAVAPLERLKILLQVQNPHSIKYNGTVQGLKYIWRTEGLRGLFRGNGTNCARDVPKSAVKFFSYEQASKGNLWXYRQQTGERDAQL

SEQ ID NO: 26683 - DNA, 642 bp, Zea mays
  misc_feature: Ceres CLONE 1399478-F
  misc_feature: Encodes the peptide sequence at SEQ ID NO. 26684
aagctggagctccccgcggtggcggccgctctagaactagtggatcccccgggctgcaggaattcgcacgagaccattacctagaacatcctaatcgaaaaaactcgaaccgaagggacgaccgagtggagtctagactcgagagcaacctcgacctcccggatctctctcccacccacgcctcgtcggagccgtcgtctgctgcagtgatggcctcccccgacctgctcttcaatctgcgcaacctcttctacctgggcgcctaccaggcagccatcaacaacagcgacgtcccgggcctcgacgccgacgccgccgctgagcgcgacgccatcgtcttccgctcctacatcgacctcggctcctaccagctgatgatcagcgagatcgactcgacagccgctacctcgctgcaggccgtgaagctgctcgcgctgtacctcactgaagacaaggaaggtgctatctccagtctcaaggaatgggtgagtgattcagcaattgtaagccatcctgtactgcggatgattgctgaatctctctccccaactacccctcgcctgcgaccggagatgtgcccaacgaaccccgatcgcccttggcggcccgccgccggctccggaaaaaaaaactggtgggaag

SEQ ID NO: 26684 - protein, 144 aa, Zea mays
  misc_feature: Ceres CLONE 1399478-F
  misc_feature (3)..(144): Pfam Name: Coatomer_E Pfam Description: Coatomer epsilon subunit
MASPDLLFNLRNLFYLGAYQAAINNSDVPGLDADAAAERDAIVFRSYIDLGSYQLMISEIDSTAATSLQAVKLLALYLTEDKEGAISSLKEWVSDSAIVSHPVLRMIAESLSPTTPRLRPEMCPTNPDRPWRPAAGSGKKNWWE

SEQ ID NO: 26685 - DNA, 625 bp, Zea mays
  misc_feature: Ceres CLONE 1399483-F
  misc_feature: Encodes the peptide sequence at SEQ ID NO. 26686
  misc_feature (343)..(343): n is a, c, t, g, unknown, or other
gctctccaactagtggatcccccgggctgcaggaattcgcacgagaccattacctagaacatcctaatcgaaaactgattacaaacccgtcctctgtccgtcctaccaccaccgctcacctcggtttggctttctcccctcttccgcacccgcttctcgctccggattccggattccctctgctctttccctaacgaaggtagccatggcggggagaggtaaggcgatcggctcacgcgccgccaagaaggccacgtccaggagctccaaggctggcctccagttccccgtgggaaggatcgccaggttcctcaaggccggcaagtatgccgagagagtcggngccggcgcccctgtctacctcgctgccgcgctcgagtatcttggtgctgaggttcttgagctggccggcaatgggggacgtgacaacaagaagacccgcatcgtaccgggccacatctagttcgccgtccccaaccaccaaaaagtctcccccttgttggggacgggggccatccctagcggggggggaaggcccaaaacccaaaccttttgctcccaaaaaaggccggcgggcggcacccccaaggttgcgactgaacaccaagtacgaaccccttgaaac

SEQ ID NO: 26686 - protein, 85 aa, Zea mays
  misc_feature: Ceres CLONE 1399483-F
  misc_feature (19)..(86): Pfam Name: Histone Pfam Description: Core histone H2A/H2B/H3/H4
MAGRGKAIGSRAAKKATSRSSKAGLQFPVGRIARFLKAGKYAERVGAGAPVYLAAALEYLGAEVLELAGNGGRDNKKTRIVPGHI

SEQ ID NO: 26687 - DNA, 632 bp, Zea mays
  misc_feature: Ceres CLONE 1399486-F
  misc_feature: Encodes the peptide sequence at SEQ ID NO. 26688
  misc_feature (313)..(313): n is a, c, t, g, unknown, or other
  misc_feature (339)..(339): n is a, c, t, g, unknown, or other
  misc_feature (370)..(370): n is a, c, t, g, unknown, or other
  misc_feature (390)..(390): n is a, c, t, g, unknown, or other
  misc_feature (444)..(444): n is a, c, t, g, unknown, or other
  misc_feature (488)..(488): n is a, c, t, g, unknown, or other
tggagctccccgcggtggcggccgctctagaactagtggatcccccgggctgcaggaattcgcacgagaccattacctagaacatcctaatcgaaaaaaactagttagcggtcaccgggcgcccatggagcttgacgaggagacgacgttcttggacgagctcatgtcgctgcggcgggaggcggcggcggcggcgtccgcgcagtggcaagcagctgccgcctacacgggcggcggcggacaaggcatgatgatgggcgacctcctcttctacgggcggacgacggaggccgccgcgactggcaccagcggncggcggcatggaccagctctcgccgntccacccagcagagccgctgcaggtgcaggngcccccggacgctcactcgnacgaggagttcaacttcgactgcctccagggaggtttgcaaccgtacagggggncggggggcgtccgcgtaaataaccgggggcgaggccccgccggntggccccggaaagggcgctcgccgctctcacgaggccgtgggggggaggaacgaaacgagggtcccctggagggagaaaaatggggggggggggggttcccccccaagttttggttttgggggggggcccccccggaaaaaacc

SEQ ID NO: 26688 - protein, 113 aa, Zea mays
  misc_feature: Ceres CLONE 1399486-F
  misc_feature (72)..(72): Xaa is any aa, unknown, or other
  misc_feature (89)..(89): Xaa is any aa, unknown, or other
  misc_feature (107)..(107): Xaa is any aa, unknown, or other
MELDEETTFLDELMSLRREAAAAASAQWQAAAAYTGGGGQGMMMGDLLFYGRTTEAAATGTSGRRHGPALAXPPSRAAAGAGAPGRSLXRGVQLRLPPGRFATVQGXGGRPRK

SEQ ID NO: 26689 - DNA, 728 bp, Zea mays
  misc_feature: Ceres CLONE 1399492-F
  misc_feature: Encodes the peptide sequence at SEQ ID NO. 26690
tccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggagtgctgctggtcgtaccagccacggccggggcggaggacggagtggtcgaacgggaccgcaaggaggatctgctgtggtgcaagcatgcgtgcgagtggcagtacggaaaggacaccccgcggaagagtgaatgcgagagcgagtgccgcgagcgacaccagcaagctgactgccgtggccgaggacggcgacagcggggtgaacgcctacgtctccagctccgggaagagcgagtgccggccccaatgcctgcgccgccaagaggcccagcgagggaaacccatgattgattgaggcggtggcggcccccgcgaaatgggcgcccaaatgggaaaaagaataacgggcccggaaactcaaagccggggccatttgcccggggaagagtggcaaagctccaccccggggccccactgggtgggaaaaagaaaccccttccccgggggggaaccgcaaaagaacccgggagg

SEQ ID NO: 26690 - protein, 114 aa, Zea mays
  misc_feature: Ceres CLONE 1399492-F
MGKGSVGASWWAFLLLAGVLLVVPATAGAEDGVVERDRKEDLLWCKHACEWQYGKDTPRKSECESECRERHQQADCRGRGRRQRGERLRLQLREERVPAPMPAPPRGPARETHD

SEQ ID NO: 26691 - DNA, 645 bp, Zea mays
  misc_feature: Ceres CLONE 1399494-F
  misc_feature: Encodes the peptide sequence at SEQ ID NO. 26692
  misc_feature (518)..(518): n is a, c, t, g, unknown, or other
  misc_feature (556)..(556): n is a, c, t, g, unknown, or other
  misc_feature (645)..(645): n is a, c, t, g, unknown, or other
aagctggagctccccgcggtggcggccgctctagaactagtggatcccccgggctgcaggaattcgcacgagaccattacctagaacatcctaatcgaaaaattatttcttggcacctcagatcagcatattccatctccaatcccccgccgcgttcccccgcacgctttgacccataaagtcgatccatctccgagcaccaagttgaacacgcgatcccattcccattctcttgctcaatacaacctccggctccagcaagccgcagcgccaagcctagaagcggagcgcggaacacacgaggccaggaagaggaggtgctgccgtccccgcgccgccgctgtgggagtgcggggaatggggcggcacggcgtggaccagatcggcgctgtggcagcgttcgtctgggtcaccctccttcccttgctgcttgtgtgcgtcgtgtggccgggcgcccaggccggccatacaagcgagtaccggcgccaactcggctccgccatcgacatgcactcccnacgccgatgtcttccgccctcccccgggctacaatgcngcccgagcaggttcacatcacacaaggccaatcattgatggcacagccatggataattctcatgggtgacaacaagtggccctggctcn

SEQ ID NO: 26692 - protein, 78 aa, Zea mays
  misc_feature: Ceres CLONE 1399494-F
  misc_feature (54)..(54): Xaa is any aa, unknown, or other
  misc_feature (67)..(67): Xaa is any aa, unknown, or other
MGRHGVDQIGAVAAFVWVTLLPLLLVCVVWPGAQAGHTSEYRRQLGSAIDMHSXRRCLPPSPGLQCXPSRFTSHKANH

SEQ ID NO: 26693 - DNA, 686 bp, Zea mays
  misc_feature: Ceres CLONE 1399498-F
  misc_feature: Encodes the peptide sequence at SEQ ID NO. 26694
  misc_feature (419)..(419): n is a, c, t, g, unknown, or other
  misc_feature (439)..(439): n is a, c, t, g, unknown, or other
  misc_feature (470)..(470): n is a, c, t, g, unknown, or other
aagctggagctccccgcggtggcggccgctctatactagtggatcccccgggctgcaggaattcgcacgagaccattacctagaacatcctaatcgaaaactaccgagttttccttccccacctccccgccccacccgtcgccgaatcggagtcccgctcgcgtccacccttgccagagctcaagagctacctcctggtccggttggacagatcccttcgggcgctgcgtccaccgggattcaggcaaagtggtgtaacataagatgcaagggggaagaggtgggaggcagggtttgttcggttttggggacccttttgttggtttcggcggctttggacagccagggaacataatgtccggtttctttggtggcgcaaatccctttgatgacccttttcttcacaaaccccctttggntggcatggatgcaacctagntttctcaacccctttcagcggcatgatgcancctaacttcatgaaccccctttgtagcatgatgcaccttagcttgctgggatcaagaatgtttgcagcccatggcaattcccagggaggcccttttggaaaccgaacccttctattcaagcctggacaatgcccgggggtttatttagaaagcccttaaatcgaaagggcctaagggcaatttatcaggggtttgcttccaaagacaagaaaaaaa

SEQ ID NO: 26694 - protein, 57 aa, Zea mays
  misc_feature: Ceres CLONE 1399498-F
  misc_feature (52)..(52): Xaa is any aa, unknown, or other
MQGGRGGRQGLFGFGDPFVGFGGFGQPGNIMSGFFGGANPFDDPFLHKPPLXGMDAT

SEQ ID NO: 26695 - DNA, 646 bp, Zea mays
  misc_feature: Ceres CLONE 1399500-F
  misc_feature (224)..(224): n is a, c, t, g, unknown, or other
  misc_feature (227)..(227): n is a, c, t, g, unknown, or other
  misc_feature (241)..(241): n is a, c, t, g, unknown, or other
  misc_feature (294)..(294): n is a, c, t, g, unknown, or other
  misc_feature (310)..(310): n is a, c, t, g, unknown, or other
  misc_feature (311)..(311): n is a, c, t, g, unknown, or other
  misc_feature (317)..(317): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (347)..(347): n is a, c, t, g, unknown, or other
  misc_feature (414)..(414): n is a, c, t, g, unknown, or other
  misc_feature (646)..(646): n is a, c, t, g, unknown, or other
aagctggagctccccgcggtggcggccgctctagaatagtggatcccccgggctgcaggaattcgcacgagaccattacctagaacatcctaatcaaaaaagtcccattctcatcccaattgggtgcgccatccccgcgcacacacacacgtcgagggagacgaagggataggagggagaggcagcgattgcaaagatggctagggctgggagcatgcacgcgncgnatccaacagggcgnataagcacactgctcgcgctgcgctagctccctcgcatgctctaagcgctggnccctgctctgcccttnncagtgngcactcaacggggnnncgtcgatgtcgcgncctccacgttggggctagcgggaaagggggaggcaacgtcatccatggtttacgggtgccggccggntcgcccatggtcgccgtgggaagggagatccccacacgccgggcgcagaaaaccgggcgggaataccaactgatccccgggaaggaaaaaggtccatctcctgctattttggtccctcaacatctggaaggtgggggaattgctctgctttaccctgcgaaagcagggtggttcttgaaaaaggtttttgccttggaaggttccttggaaaagggagcgcccctttttaaan

SEQ ID NO: 26696 - DNA, 676 bp, Zea mays
  misc_feature: Ceres CLONE 1399505-F
  misc_feature: Encodes the peptide sequence at SEQ ID NO. 26697
  misc_feature (421)..(421): n is a, c, t, g, unknown, or other
  misc_feature (601)..(601): n is a, c, t, g, unknown, or other
aaagctggagctcaccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatctctaattccccataccgtccaccggtcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagncagactggtgctggggagcaccgttccccgtggcaatcttcgtggatctaaaaccccatgggattccaaaagggggggcccttgggaaaataaacccccgtttttttttcccccccgggggggggttttttttaggggggagaaaaggagaaagcccccccccaaaaatatttttttccncggggcgggcgccccccatgtttttaggggaatttttttttttttttttccccccacacacaacaataataagat

SEQ ID NO: 26697 - protein, 70 aa, Zea mays
  misc_feature: Ceres CLONE 1399505-F
  misc_feature (54)..(54): Xaa is any aa, unknown, or other
MRECISVHIGQAGIQVGNACWELYCLEHGIQPDGQVPGDKTAGHHDDAFSTFFXQTGAGEHRSPWQSSWI

SEQ ID NO: 26698 - DNA, 731 bp, Zea mays
  misc_feature: Ceres CLONE 1399506-F
  misc_feature: Encodes the peptide sequence at SEQ ID NO. 26699
aagctggagctccccgcggtggcggccgctctagaactagtggatcccccgggctgcaggaattcgcacgagaccattacctagaatatcctaatcgaaaaaacaagacagagagatacccgatcgccaccgccgaccggactcccctcaaaggcggccacagcacagcgagcatgggagaccggcatcagcatgggcctggcagcggcgtggaggacccggcgacgctgctgcggcgggtgcagacccgcgcgcccaactcgacgcaggtggtggggttcctgacgctgctcgtctctggcgccgtgctgctgctgctgacagtggtgacgctgacagacgccgtggaggcgctcgtcttcctgggccgcatcgagctgctcaccagccccatctgagggcccgtcgccgtcgtgatctccgccagtcgtcgccgacgaagcttctccggcctgcgaccttcgccggccgccgaagatcccccgtggcccccgggaagggacccgtactttcaggggccgccaccccgcgggctggccaacgtgttggaataacagggggaaagcggatttaaccaaatcccgcccggcccccccaagggaaaaacggcacgggaaaaacgggggaaaaatggggccggaaccccgcgaccaaagaaagacctcttgctccaaaaatggcaatagggacccccccacgcccccctcggggaggcatagaattatggccaa

SEQ ID NO: 26699 - protein, 74 aa, Zea mays
  misc_feature: Ceres CLONE 1399506-F
MGDRHQHGPGSGVEDPATLLRRVQTRAPNSTQVVGFLTLLVSGAVLLLLTVVTLTDAVEALVFLGRIELLTSPI

SEQ ID NO: 26700 - DNA, 731 bp, Zea mays
  misc_feature: Ceres CLONE 1399510-F
  misc_feature: Translation starting site: 389
  misc_feature: SWISSPROT Homolog: EC 2.6.1.42 Branched-chain-amino-acid transaminase
  misc_feature (406)..(406): n is a, c, t, g, unknown, or other
  misc_feature (410)..(410): n is a, c, t, g, unknown, or other
  misc_feature (458)..(458): n is a, c, t, g, unknown, or other
  misc_feature (461)..(461): n is a, c, t, g, unknown, or other
  misc_feature (493)..(493): n is a, c, t, g, unknown, or other
aagctggagctccccgcggtggcggccgctctagaactagtggatcccccgggctgcaggaattcgcacgagaccattacctagaacatcctaatcgaaaaaccgaaattaaagacggcgactctgcctgcacagcattgaccgccgccttcgctcctccacctccccgctcgctcttctgcctccgcgcgggccgcggatcccttcactcgccacagcaagcgctagaagagggaatggagcccggcctcgcatcccgcgtcgcccgttcagccgctcagccgctttccggctgcctgtcgcggcactcgctctcgccgtggctcaagatccagaaccacatttatccgatgccaagtctctgtcacaaggttcctagcacggcaaaatgccacacttctatgancacnagttacatggaaaacatcagatgtcactgatttggactgggaaaaccntgnctttggcctcatcgagactgactttatgtacngtgcaaaatgtgaaactgatggaatctttttcaaaagggggaagcctaccaatggggcctatagcactggagccctccagctggaagctaaaatatgggcaaggatttgtttaaggcctaaaagcttttgggaaaacgggggggccatcccttcatttcctccaaaggaaaatggtttaaaggggctaaccggggaaaaaagaaggggaaacccggcccaactggggaaaattccggg

SEQ ID NO: 26701 - DNA, 830 bp, Zea mays
  misc_feature: Ceres CLONE 1399513-F
  misc_feature: Encodes the peptide sequence at SEQ ID NO. 26702
  misc_feature (69)..(69): n is a, c, t, g, unknown, or other
atgcgcccaagcccttgggtacactaccctctttccccctcccaagctggaactccccgcggtggcggncggtctatactaaaggatcccccgggctgcaggaattcccacgagaccatacctaaaacatcctaatcgaaaagtctcaggttgcggtcgaaccagagccccgtcccaactccaccacctctcttctctacggcgcgagcaagggcggcgccggccgcggcgtcggcgggaaccgggcctcgctctccccatctctccgatcacttctgtcctgtgaaaatggcggatgaactacgctcaacgtctgtgggtcaaaagttccatgggcagtccgtgctgtggagcagaatctcttcctattccgccatgaacaaccctgtattcaacaatgtgtattctggttacaatgtgccccacaggtcatatcatgggatgaatgcaactgctggactctcatctgtcatggaaccatctcctgtctttgcttctgcccccaaagagacaggcttttcctggatagatgatccgactttatgatggggcggagtttcctgctgctggcgtccaagaaagctgacacctcccattggagggcgatcaggtttttgattcaaaaacaggaatgaaattgcgtcagaattgagcacgctttcttgaaccgaccacaagagtaaatgggcggaccggctttggcccgggagaatccataagatgaacgggatcttggtctcccacggggggcggagggaaaacacagcctaaacggcctatcccgattaatttatcccccacacgacggcatttggacaattttgcccgat

SEQ ID NO: 26702 - protein, 85 aa, Zea mays
  misc_feature: Ceres CLONE 1399513-F
MADELRSTSVGQKFHGQSVLWSRISSYSAMNNPVFNNVYSGYNVPHRSYHGMNATAGLSSVMEPSPVFASAPKETGFSWIDDPTL

SEQ ID NO: 26703 - DNA, 692 bp, Zea mays
  misc_feature: Ceres CLONE 1399514-F
  misc_feature: Encodes the peptide sequence at SEQ ID NO. 26704
cgctctttcctagtggatcccccgggctgcaggatttcgcacgagaccattacctagaacatcctaatcgaaaaaacgagagcacccggaccagacgcccaagtcgatcgccatggcgatgaagccggcggcggcggctccccctaccccggccgcggcgcacagcgtgttcgtctacggcagcctgatggcggacgaggtggtccgcaccatcctcaagcgcgtcccgcccgccgccccggccctcctcccaaactaccaccggttcaacatcaagggccgcatttacccggcgatcctgcccgttgagagcaagagagttgctgggagggttatcatgggtgttactgatgaagagctccagcttcttgacgcgtttgaagacgtggagtacacgagggacagagttgagatatcattggctgactcttccgagaacatgctggctgacacttacgtgtggagtgatgcagaggatctccatctttatgagaatgggactttgaggtgatatgactggtttcctgcaaccctgggggggtaaggctatggattatcaagctacggggatctattcaaagtggtgactttttttggttactgccgtcctcgggatttaaaattttgttgggaccccgccaaaggaggggagggattttcccgaaaatttaaaccccttttggccccaaaaa

SEQ ID NO: 26704 - protein, 132 aa, Zea mays
  misc_feature: Ceres CLONE 1399514-F
  misc_feature (19)..(118): Pfam Name: AIG2 Pfam Description: AIG2-like family
MAMKPAAAAPPTPAAAHSVFVYGSLMADEVVRTILKRVPPAAPALLPNYHRFNIKGRIYPAILPVESKRVAGRVIMGVTDEELQLLDAFEDVEYTRDRVEISLADSSENMLADTYVWSDAEDLHLYENGTLR

SEQ ID NO: 26705 - DNA, 631 bp, Zea mays
  misc_feature: Ceres CLONE 1399518-F
  misc_feature (417)..(417): n is a, c, t, g, unknown, or other
  misc_feature (468)..(468): n is a, c, t, g, unknown, or other
  misc_feature (478)..(478): n is a, c, t, g, unknown, or other
  misc_feature (495)..(495): n is a, c, t, g, unknown, or other
  misc_feature (562)..(562): n is a, c, t, g, unknown, or other
  misc_feature (563)..(563): n is a, c, t, g, unknown, or other
  misc_feature (596)..(596): n is a, c, t, g, unknown, or other
  misc_feature (597)..(597): n is a, c, t, g, unknown, or other
  misc_feature (599)..(599): n is a, c, t, g, unknown, or other
  misc_feature (605)..(605): n is a, c, t, g, unknown, or other
  misc_feature (613)..(613): n is a, c, t, g, unknown, or other
aagctggagctccccgcggtggcggccgctctagaactagtggatcccccgggctgcaggaattcgcacgagaccattacctagaacatcctaatcgaaaagtctgtctgtctgcctccctccgctcacctcctctgcttcttctcgctttcttccatcttggtccagcctccactcttcctgctgagccatggcggctgccgaagaagggccagagccactcaggtatcagactctggccctgagggtgagcatccactggcgagggttgcaagaagaaggtgaagaaggtgctccacagcatagaaggggtgtacaagacggacatagacacgcagcagcagaaggtggtggtcataggcaacgtctctgcagacgcgctcgtcaagaagctccctcagtccgggaagcacgcgnagccgtgggcggagcctgctccagccccaccggccgccgacagcccgcccnggcccgacgnatctccccgcagcgcanggcagaagaagaaaaagaagaagggcacaagagccccgagggcgcgaaacacagccccgcgatcggnnggcaggcccggccggggcgggggaaggaaacgnngnacccanccccccgnagcagacgacagggtgac

SEQ ID NO: 26706 - DNA, 607 bp, Zea mays
  misc_feature: Ceres CLONE 1399519-F
  misc_feature: Encodes the peptide sequence at SEQ ID NO. 26707
  misc_feature (470)..(470): n is a, c, t, g, unknown, or other
aagctggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcccgcancaacttgcaaatgaagattgcaaatttgagagggggccctttgcccccccaaaaaaaacccttttaaaaaaccctttttttggggaaaaaaaaaaaaaatattggttgggggaccccccgggtttcccccccccggg

SEQ ID NO: 26707 - protein, 147 aa, Zea mays
  misc_feature: Ceres CLONE 1399519-F
  misc_feature (102)..(102): Xaa is any aa, unknown, or other
MKMVIVLVVCLALSAASASAMQMPCPCAGLQGLYGAGAGLTTMMGAGGLYPYAEYLRQPQCSPLAAAPYYAGCGQPSAMFQPLRQQCCQQQMRMMDVQSVPXQLANEDCKFERGPFAPPKKTLLKNPFFGEKKKKYWLGDPPGFPPP

SEQ ID NO: 26708 - DNA, 808 bp, Zea mays
  misc_feature: Ceres CLONE 1399530-F
  misc_feature: Encodes the peptide sequence at SEQ ID NO. 26709
  misc_feature (422)..(422): n is a, c, t, g, unknown, or other
  misc_feature (423)..(423): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
aagctggagctccccgcggtggcggccgctctattactagtggatcccccgggctgcaggaattcgcacgagaccattacctagaacatcctaatcgaaaaatctcgcaataccaaccttccggatccagtgccgcacgcctcactccccgtccccgacacccatgacacgcaagaggcggaagcacgccgccgccgccgccgccgcctagggttccgatcccttcctcatggattcgctgccgcggaagcgcaagggcgcgcgcgccgcgtgctccctggccggatcccgccacgatgcgcctgccgcccgcaagcgcacctgccgcgagcccaagccgcggcccgagaagaagaagccctcttccgccgatgagggctccgcctccgtccgcggcgcgggtttatttataacgggcgccnncnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 26709 - protein, 64 aa, Zea mays
  misc_feature: Ceres CLONE 1399530-F
MDSLPRKRKGARAACSLAGSRHDAPAARKRTCREPKPRPEKKKPSSADEGSASVRGAGLFITGA

SEQ ID NO: 26710 - DNA, 632 bp, Zea mays
  misc_feature: Ceres CLONE 1399536-F
  misc_feature (222)..(222): n is a, c, t, g, unknown, or other
  misc_feature (235)..(235): n is a, c, t, g, unknown, or other
  misc_feature (239)..(239): n is a, c, t, g, unknown, or other
  misc_feature (244)..(244): n is a, c, t, g, unknown, or other
tggagctccccgcggtggcggccgctctagaactagtggatcccccgggctgcaggaattcgcacgagaccattacctagaacatcctaatcgaaaataccctctggcattggttgtcgatttcttcgttcgtgcttgcttgcgtaaaaatttaaataaatgaaggcaatatgggcacaaaagctcgtccaccatctgctgatgcagaaaaagggagattgncgaaatagatacnaggnctccnattttcatctgtaaagctgcagtgagttaattgggtgaggtccgcttttcatttgacaaatcagcttgaaagaaggcccaaggctccctcaaacagaggagggttttaggcaaggaaaacggatttgcccatggccccagaaggagtttaaattaatacaagggaaccgctcagttaatggttaaaacaaccaaaggaacagggttctcttttggagtaaagaaaagctaaaaaaaattgtggagggggttaaaacccccaggttgggttttgattaaaaaaagcccaaaaagtttgggccttcccggggaaagaggggggggcaaaaacccaacttccggggtttttgtagagggcgccccccaaagggagggggcttaaaaaaaaa

SEQ ID NO: 26711 - DNA, 627 bp, Zea mays
  misc_feature: Ceres CLONE 1399538-F
  misc_feature: Encodes the peptide sequence at SEQ ID NO. 26712
  misc_feature (357)..(357): n is a, c, t, g, unknown, or other
  misc_feature (395)..(395): n is a, c, t, g, unknown, or other
  misc_feature (417)..(417): n is a, c, t, g, unknown, or other
  misc_feature (472)..(472): n is a, c, t, g, unknown, or other
  misc_feature (500)..(500): n is a, c, t, g, unknown, or other
  misc_feature (544)..(544): n is a, c, t, g, unknown, or other
  misc_feature (555)..(555): n is a, c, t, g, unknown, or other
aaagctggagctccccgcggtggcggccgctctagaactagtggatcccccgggctgcaggaattcgcacgagaccattacctagaacatcctaatcgaaaaatcccaagaagagccgccctacctattccttctccccgccgtcgagctgcccaacccagagcaccagcagccctcacctccttcctctcggccggtccttccaacgagcccgctggtcttggagccgccaccgttctcgttctggacgaacgttcaaggagattgcatttgtggatgctctaatggagtcgaaaggtggcaagaagtctagtagtagtagtagtaatttcatgtacgaagctccccttggctacnagatcgaggacgttcgcccagccggaggaatcaagaangtccagactgctgcttattccnactgcgtcccgcagccatcctgatatcgcctcacatgcaattcgcggtagagtangattttaattcagttttccctctgtgtncgtagttttccgttggctctggctgccttcctctggctctgagnatcccactgtnctgccatctctccttttcctctctcatcctctctttcttgcacgtcatccagtggcgatgtcttcagcagat

SEQ ID NO: 26712 - protein, 51 aa, Zea mays
  misc_feature: Ceres CLONE 1399538-F
  misc_feature (1)..(51): Pfam Name: AdoMetDC_leader Pfam Description: S-adenosyl-l-methionine decarboxylase leader peptide
  misc_feature (25)..(25): Xaa is any aa, unknown, or other
  misc_feature (37)..(37): Xaa is any aa, unknown, or other
  misc_feature (45)..(45): Xaa is any aa, unknown, or other
MESKGGKKSSSSSSNFMYEAPLGYXIEDVRPAGGIKXVQTAAYSXCVPQPS

SEQ ID NO: 26713 - DNA, 663 bp, Zea mays
  misc_feature: Ceres CLONE 1399541-F
  misc_feature: Translation starting site: 358
  misc_feature (308)..(308): n is a, c, t, g, unknown, or other
  misc_feature (355)..(355): n is a, c, t, g, unknown, or other
  misc_feature (356)..(356): n is a, c, t, g, unknown, or other
  misc_feature (412)..(412): n is a, c, t, g, unknown, or other
  misc_feature (475)..(475): n is a, c, t, g, unknown, or other
aaagctggagctccccgcggtggcggccgctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcttgtgtggcgctgggcatgtgccgtgcccgtggctttgcttcgtcgtgctcactagtcacgagagagggaggaggctctgcttctgctgccgcttcttcttctcctgctgctcttncgagataagcagggggccgggacagctgactagctgagaggcatggnngatggacgcccggcgccgccaagctgccgtagagctacgccggccagcaggacggngggaagttggtgaagagcgtcagccgcgtgaagccgcgcaggtttcggctgggcctcgtggcnggctttcctcggcgtcacctgggcctacttctcccaccgccaggtcgacgcccatccagatcgccatgacaagccgacccgtctcagaaaatgggggttgggcggtcgaattcgcttccctggggaggtgggggcccgacgccggccaacacctaccaaggcttccagggaggggaatagattttggg

SEQ ID NO: 26714 - DNA, 834 bp, Zea mays
  misc_feature: Ceres CLONE 1399546-F
ctcccccccccttcccacctctcccctctcctacatctataatctttttaaactgctgctccaccgcggtggcgggcgctctagtactactggatcccccgggctgcaggaattcgcccgagaccattacctagaacatcctaatcgaaaagatgcaacccatcatttgtaccgcgcctcgtgagcacgttcggggccggtgcttaaggaagaaatccgagagcactcctcccccgctacgccggaccgcccatggacgcaggtagccagatatatatagacgtccaagtgagggcgtgcagatccccatcaggaggtgtgcgaaggacttgatcgaccccacgatgatggcctgcctggcgtaggccctcttcctgttggagctgagacggccccttcctcgtcatgacccggctactggggtgtatgtctccagcactacaggccgagaggttcttcactcagaatcatcgagcaacgacgcgctgatccggagatgcacttcacctgcggacctacgagcgaccctgaccgcccacttgcatgaacatgcctagtagaacaatgttgcttccttccctccccgaacgttcccgcaggaactggtcacgcggccctttcattcactcctgcttcctacgacccttgttaaaacgatgtgctttaagccacatagcttccgagggactcttgacaggacggaagacgcctccaaaacattaagtccccctcagtccgaattagagagtatgcctctaatgtacactgagtggggtcttttagggttaccctccacataaggcgcgagaacagagacaaacttggacctcgagt

SEQ ID NO: 26715 - DNA, 632 bp, Zea mays
  misc_feature: Ceres CLONE 1399549-F
  misc_feature: Encodes the peptide sequence at SEQ ID NO. 26716
  misc_feature (390)..(390): n is a, c, t, g, unknown, or other
  misc_feature (440)..(440): n is a, c, t, g, unknown, or other
  misc_feature (491)..(491): n is a, c, t, g, unknown, or other
  misc_feature (553)..(553): n is a, c, t, g, unknown, or other
  misc_feature (554)..(554): n is a, c, t, g, unknown, or other
  misc_feature (562)..(562): n is a, c, t, g, unknown, or other
  misc_feature (563)..(563): n is a, c, t, g, unknown, or other
aaagctggagctccccgcggtggcggccgctctagaactagtggatcccccgggctgcaggaattcgcacgagaccattacctagaacatcctaatcgaaaaaaggagggggtgtcgcttagactagcgaatccatccgccaagattccgtgcacctcgaccgccgccgccgctatctgtttgtccccgcccccgcgaccgcggcagcctagcaggaggggaggatccatgtctagtttctagagcagctgcttgcgtcccttgcaaatcacatcgaccgatggggataccccagcgacgacgtggtgcaaatccgccacgccgacgccgctggcgagcccaccgtcgtcaccgtcagctgccccgacaagacgggcctcggctggaccntctgccgggtcgtcctcctcttccgcctcagcgtcgtcaagggagactgnagcacggacggggcggtggtgctacatcgtgctctgggtctggccacgcgnggggcggccggtgcccgtgccatgggacctactcaaggacaggttgcttcagctctgcacgnncgcgccgnncgttcggattcgacaacgcgtacctcgcagcggttggactacagggacttgcgcctcccccacgaaagt

SEQ ID NO: 26716 - protein, 40 aa, Zea mays
  misc_feature: Ceres CLONE 1399549-F
  misc_feature (14)..(14): Xaa is any aa, unknown, or other
  misc_feature (17)..(17): Xaa is any aa, unknown, or other
MGPTQGQVASALHXRAXRSDSTTRTSQRLDYRDLRLPHES

SEQ ID NO: 26717 - DNA, 710 bp, Zea mays
  misc_feature: Ceres CLONE 1399552-F
  misc_feature: Encodes the peptide sequence at SEQ ID NO. 26718
ggagctccccgcggtggcggccgctctataactagtggatcccccgggctgcaggaattcgcacgagaccattacctagaacatcctaatcgaaaaaagggccaaggcagggcactgcactgcacgcatgcactgacctgacgacgacgcgcgccacagtccacagctccacactcagacatggcgatgggcgccgcttccatcctactgatgatggtttcgctggaggccctgcttctcgccgccgccgccggcgccggcgggaccatccgtctgcccagcgatgtcggaggcgttgctgcagaccttgtcacggagatggcgagggcgagggcaagggcaaagcatcagcttcgcgacgaggagaggccgtggggggaatgctgcgacttgaccgtatgcgacaagacgtacccgctaacttgctcgtgcttcgatcgggttgagcgctgctccgacgcctgtaaggagtgcgtggaaacggaggactcgcgccacgtctgcgtcgacaggtaccgtggcgaccccgggcccaggtgccacgactaggacgggaggagcggcggacccgctgacgacgacgctggtgggcaagcgacaccgacggtagtgatggcagatgacaataaagcaggcggaggcgacgacgacaagaagaaacgtcgtgttaatgctgcgacgtgcccatctgcacccagtcctggcctgcg

SEQ ID NO: 26718 - protein, 122 aa, Zea mays
  misc_feature: Ceres CLONE 1399552-F
MAMGAASILLMMVSLEALLLAAAAGAGGTIRLPSDVGGVAADLVTEMARARARAKHQLRDEERPWGECCDLTVCDKTYPLTCSCFDRVERCSDACKECVETEDSRHVCVDRYRGDPGPRCHD

SEQ ID NO: 26719 - DNA, 731 bp, Zea mays
  misc_feature: Ceres CLONE 1399553-F
  misc_feature: Encodes the peptide sequence at SEQ ID NO. 26720
  misc_feature (20)..(20): n is a, c, t, g, unknown, or other
cgtgctggagctccacgcgntggcggccgctctagtatctagtggatcccccgggctgcaggaattcgcacgagaccattacctagaacatcctaatcgaaaacttcttctgccttcccgactctacctgacttcgcccgctctgagaaattcactctcaccaccaccgcgccgcctccactccccccacacccccggtctgaaacccaagcttccgcttctctcatggccgacgccaccgccgccctctcagctcggagcaaggtgcaggctttcctggaggctgcgcgcgccgaccacctccaatccctcaagaacctcgccgcggcgctcgacgaagacgggacggctggcccgcccccgacagccgtactccccgccgcgaaccggtgcgagcggcaccctgtctcgttttcccgggtccacccgccacggtcgcaacagaccccccggctaacttttttttctccgatggagtatcctctcccgtccctgccctcagcgccaaccgccaagcacgatgtggttaacctctcccccgccccctgctttcctactaccgcccctgacccctcgctacacgtaccgcgccgctctcgtcccccaccacacacacggccgcggcggaatgtgttccttctccgccccccattcgtcaggatcctccacgcaataccctaacaccctgcccgtcccctgctccgcttcccgttgtctggggtagctcctcg

SEQ ID NO: 26720 - protein, 151 aa, Zea mays
  misc_feature: Ceres CLONE 1399553-F
MADATAALSARSKVQAFLEAARADHLQSLKNLAAALDEDGTAGPPPTAVLPAANRCERHPVSFSRVHPPRSQQTPRLTFFSPMEYPLPSLPSAPTAKHDVVNLSPAPCFPTTAPDPSLHVPRRSRPPPHTRPRRNVFLLRPPFVRILHAIP

SEQ ID NO: 26721 - DNA, 629 bp, Zea mays
  misc_feature: Ceres CLONE 1399554-F
  misc_feature: Encodes the peptide sequence at SEQ ID NO. 26722
  misc_feature (219)..(219): n is a, c, t, g, unknown, or other
  misc_feature (305)..(305): n is a, c, t, g, unknown, or other
aagctggagctccccgcggtggcggccgctctagaactagtggatcccccgggctgcaggaattcgcacgagaccattacctagaacatcctaatcgaaaaccatccatccatccagttagttagttagtaagttagttgagggagaagaagcagttcaggccaagcgatgagcaacatgctgttggctgcgccgacgcctgggacctcctgcagctgntgctcttcgccgctgtgctcctcgtcgtcgtcgccgacgccggcgtgacgagccagtaccgtcggtagctgcaggcgactttgtanatgccacgtggacgcgacgtcttccggcgtccggcccgggtacatggccccgcagcaggtgcacatcacgctgtgtgagcaggcaggaacggcaaatcatcctgggcatgcgccgccgtacaatgatatgggcattcgccccgtggtgtacagaggggcgtctccgcacccgtataacatggaggtccgggggcccggcatccacgggctggtagagtacttcaactacccctcggtgttcatccgcactgccccctcacaaagctcaaggataggaccagtactacttcccccgtggggtcggcccaacgggggaggacttcg

SEQ ID NO: 26722 - protein, 93 aa, Zea mays
  misc_feature: Ceres CLONE 1399554-F
MAPQQVHITLCEQAGTANHPGHAPPYNDMGIRPVVYRGASPHPYNMEVRGPGIHGLVEYFNYPSVFIRTAPSQSSRIGPVLLPPWGRPNGGGL

SEQ ID NO: 26723 - DNA, 639 bp, Zea mays
  misc_feature: Ceres CLONE 1399555-F
  misc_feature (639)..(639): n is a, c, t, g, unknown, or other
aaagctggagctcaccgcggtggcggccgctctagactagtggatcccccgggctgcaggaattcgcacgagaccattacctagaacatcctaatcaaaaaaccctcatggaagcgtggccacctctcgcccccgcggcggccactccggcctgtgccttggcgtggggagcagcagcaacggcgcagcggaaggtcgtggagcaggagtcagcggcgcaggcggtgagacgcatcgtgtagagctgcgccaactccagcggcgtggcagacgccgaggtgcaccacaacgccgtcatcccccgtggactgattctctccactccggagaggcgcctagtcaccctgctcgaggagctgaaaggagtccccccccccagaggggggggggggggcacttttaaataccagatcccactcataagacaaaaccagctcgctatagaacaaaaggcatacccgcaacgccttgagaacaactgacatccccccccccccaaaaacatgaataaagaggggcgctttgcgcatcctgggtcagtctgcgtcaacacaagaaccccctacagacaacacacacacccctcccctactgaccgcccccctcctacagtcctactaaaccccccccccccccccn

SEQ ID NO: 26724 - DNA, 618 bp, Zea mays
  misc_feature: Ceres CLONE 1399558-F
  misc_feature (190)..(190): n is a, c, t, g, unknown, or other
  misc_feature (191)..(191): n is a, c, t, g, unknown, or other
  misc_feature (244)..(244): n is a, c, t, g, unknown, or other
  misc_feature (295)..(295): n is a, c, t, g, unknown, or other
  misc_feature (307)..(307): n is a, c, t, g, unknown, or other
  misc_feature (331)..(331): n is a, c, t, g, unknown, or other
aaaagtggagctccccgcggtggcggccgctctagaactagtggatcccccgggctgcaggaattcgcacgagaccattacctagaacatcctaatcgaaaaaaccctgtccctttccccgcgccaccgccctctccgtcgccgccgttcgaccgagcgccgctcacccaccccacgagctcccgcgcgnngtcatgtccatctctccacacgaacgcaccgggagagcctattacccgcgccngcacaaccctagccctagtccccacatggcagcgacagacgccggcacggncgccgctccccntcgggatccgtctcgccacccggngccgctgcggaactagcgacggcggggtcggctcgagctccaacccgggggtccagctattggagatctattaatgctcccgaaagggtagttgatttatatatctggggaagaagatgaacatgtacacaagaggttgcaatgtttaaaatgcactcttcaaaagggggattccgtttcctgaaaatattttggctcaggtggtcatatctgagagactaaaatgggggatccttcagctgaccatttggttcggtctactgactgggaaaggaactcaaatgttg

SEQ ID NO: 26725 - DNA, 624 bp, Zea mays
  misc_feature: Ceres CLONE 1399559-F
  misc_feature (306)..(306): n is a, c, t, g, unknown, or other
  misc_feature (307)..(307): n is a, c, t, g, unknown, or other
  misc_feature (369)..(369): n is a, c, t, g, unknown, or other
  misc_feature (376)..(376): n is a, c, t, g, unknown, or other
  misc_feature (401)..(401): n is a, c, t, g, unknown, or other
  misc_feature (402)..(402): n is a, c, t, g, unknown, or other
  misc_feature (473)..(473): n is a, c, t, g, unknown, or other
aaagctggagctccccgcggtggcggccgctctagaactagtggatcccccgggctgcaggaattcgcacgagaccattacctagaacatcctaatcgaaaaatccaatccccgggccaccactacctgcctgcccgtgcccacgcttcttctcttctcctccccaagccccagccccagccccagctaccgcgccccctcctgtctgttccaccagcgtcggcctagctacctgcccgtcccctctccgagtacggtcggaagcctcagctgaaggatctggcctgggcgccctccgacgacggnnacaggttctgtttgtcttcataaagtagagcactagctagaagacatattcacacgcatcanctatcanattgcaagcttagaattgacctcannagtgggacatgcttgtcttacagaagaactgatagccttggaagttgtagcccgtcgggactgtctgctgnaccagtatggctgacactccaaacttccgcatggtgcaccctttttggcgacgtcccaaggcagactcccaagcattcccttgtattctggtaacccgaagcacctctggcatccgtacagtcaagctcggatggccatgtcgggccccaa

SEQ ID NO: 26726 - DNA, 640 bp, Zea mays
  misc_feature: Ceres CLONE 1399561-F
  misc_feature (277)..(277): n is a, c, t, g, unknown, or other
  misc_feature (335)..(335): n is a, c, t, g, unknown, or other
  misc_feature (368)..(368): n is a, c, t, g, unknown, or other
  misc_feature (419)..(419): n is a, c, t, g, unknown, or other
aaagctggagctccccgcggtggcggccgctctagaactagtggatcccccgggctgcaggaattcgcacgagaccattacctagaacatcctaatcgaaaagtgtcgtcttcctctccgccgcttctcctgtccaccctcgactgcttgcgcgtgacctgagccgccgccgcctacatccgctcatccccgcgcccgcctcaaccacgccgccaccgaccacgtataatcctgcctccccttcgcgcggtttcgaggctcgtttcctttgggatcngtcgtctgccccgaccgcgtgggcgcttcttctttcggatctcgctggaccgagcggnccagggctagggattcaggcccatgggcgtggncgcgcgtcctcacccagattgcaaggcatcgaccagcaaaagcaatctacnatgaactagttgcttcctcccctttgggtggtcttcggagtgacatcacttcagggtgcagggatagacattttacagagaggaaccagtcagttacattggtagccttgcaccgcgggtccgagactaaaatcaccaggcggacttctctgcttaagagatttacagaagtgacccagagcgtgcatacaattatttgaagccaacctcatttacttcta

SEQ ID NO: 26727 - DNA, 649 bp, Zea mays
  misc_feature: Ceres CLONE 1399565-F
  misc_feature (314)..(314): n is a, c, t, g, unknown, or other
  misc_feature (335)..(335): n is a, c, t, g, unknown, or other
  misc_feature (453)..(453): n is a, c, t, g, unknown, or other
  misc_feature (491)..(491): n is a, c, t, g, unknown, or other
aaagctggagctccccgcggtggcggccgctctagaactagtggatcccccgggctgcaggaattcgcacgagaccattcctagaacatcctaatcgaaaaccacctccaaagtccaaaagcgaagcctacgcccgccccaacggtgaaaacgtcggaaccctagatccctctcacggtcgcgcctgtgctccaaaaccttagatccgacatgcatcagcccagagcccgctacccacccgggtatggctccagcgggggaggcggtggcggtggaggcggtagtggagtaggaagaggaggcagcggcggcgnaggaaccacaactactacggncggaacacacatccacagcatcaacaccactaccagcagcagcagcagcactcgcataggaactcctcgcaccagcagcagtggctgcggcgagaccagggccccgccgttgccgggncagtgtctggaaacgctgtgcctaagacggcgcctcgncttgacgctgttgactcgagttctcaagattggaaggctcaactaaatataccagctccagacacacgctacaggacagaggatgtcactgcaacaaaagccaatgagttttgaggattatttcttgaaacgggagttgcttatgggaatttaatgaa

SEQ ID NO: 26728 - DNA, 607 bp, Zea mays
  misc_feature: Ceres CLONE 1399566-F
  misc_feature: Encodes the peptide sequence at SEQ ID NO. 26729
  misc_feature (204)..(204): n is a, c, t, g, unknown, or other
  misc_feature (271)..(271): n is a, c, t, g, unknown, or other
aaagctggagctccccgcggtggcggccgctctagaactagtggatcccccgggctgcaggaattcgcacgagaccattacctagaacatcctattgaaaaaaaccctaacaacgcatttcgctccccacagcggctcggccacaacccacagccagacggtctcgagctggatctctaccgttcgtccgttccagcagacagnagtgcgcgctctctctctccctcgtggcgacgactgggcgaccgctgccgctgcccttgtgccccgntctccgtcggtccgttcgccaggtctcctggcggctctttgtcgtcgacaagctccgccaggttgctgtgtgaagtccaaggttgtcacatggattcagcacaagatttccaacccaggacattctctataaaggtgtggccaccaactgaaagcacacggatcatgcttggtgacaggatgacaaacatctgtccacagagtccattttctctcgcaatatccgccttttgggaaagcaagaggctcatgagaatgcaaaaacgattgaagaactttgctttggcctgggtgaggagattttcagagagagccgagggggggatgcaaactcctt

SEQ ID NO: 26729 - protein, 82 aa, Zea mays
  misc_feature: Ceres CLONE 1399566-F
MDSAQDFQPRTFSIKVWPPTESTRIMLGDRMTNICPQSPFSLAISAFWESKRLMRMQKRLKNFALAWVRRFSERAEGGMQTP

SEQ ID NO: 26730 - DNA, 648 bp, Zea mays
  misc_feature: Ceres CLONE 1399569-F
  misc_feature: Encodes the peptide sequence at SEQ ID NO. 26731
  misc_feature (269)..(269): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (447)..(447): n is a, c, t, g, unknown, or other
  misc_feature (484)..(484): n is a, c, t, g, unknown, or other
  misc_feature (496)..(496): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (536)..(536): n is a, c, t, g, unknown, or other
  misc_feature (618)..(618): n is a, c, t, g, unknown, or other
  misc_feature (634)..(634): n is a, c, t, g, unknown, or other
aaagctggagctccccgcggtggcggccgctctagaacttagtggatcccccgggcttgcaggaattcgcacgagaccatttaacctaagaacattcctaaatcgaaaaaccttctcactaaccaccaccacttgccccggatccattaccagcttgcagcagcagcgcgcgcgagctagcttcggtcggtcgatagatcgatcgatcgctcggccatcatggcgcgggaggagcaggcgctgctgtcgacggagatcgtgaaccgggncgtggagccgtcgnnngcccggacgccggctcgcgggcctttctcggtgcgcgtgcgccgccgcctgccggacttcctgcagtcggtgaacctcaagtacgtgcgcctcgggtaccactacctcatcagccacggcgtgtacctggccaccatccccgtcattcgtgctggtgtgcgncgccgagctgggcagcctcagccgcgacgagctgtgncgcagggtggtnggnnnggaggccacctacgacctcgccaccgtgctcgccnttcctcgccgtcctcggcttcaccatctcggtctacatcatgtccaggcccaggcccgtgtacctcatcgacttcgcatgcntacagccgggcgacgnagctcaaggtgtcc

SEQ ID NO: 26731 - protein, 143 aa, Zea mays
  misc_feature: Ceres CLONE 1399569-F
  misc_feature: SWISSPROT Homolog: EC 2.3.1.119 Icosanoyl-CoA synthase
  misc_feature (17)..(17): Xaa is any aa, unknown, or other
  misc_feature (22)..(22): Xaa is any aa, unknown, or other
  misc_feature (89)..(89): Xaa is any aa, unknown, or other
  misc_feature (93)..(93): Xaa is any aa, unknown, or other
  misc_feature (94)..(94): Xaa is any aa, unknown, or other
  misc_feature (106)..(106): Xaa is any aa, unknown, or other
  misc_feature (139)..(139): Xaa is any aa, unknown, or other
MAREEQALLSTEIVNRXVEPSXARTPARGPFSVRVRRRLPDFLQSVNLKYVRLGYHYLISHGVYLATIPVIRAGVRRRAGQPQPRRAVXQGGXXGGHLRPRHRARXSSPSSASPSRSTSCPGPGPCTSSTSHAYSRATXLKVS

SEQ ID NO: 26732 - DNA, 651 bp, Zea mays
  misc_feature: Ceres CLONE 1399572-F
  misc_feature: Encodes the peptide sequence at SEQ ID NO. 26733
  misc_feature (342)..(342): n is a, c, t, g, unknown, or other
  misc_feature (383)..(383): n is a, c, t, g, unknown, or other
  misc_feature (384)..(384): n is a, c, t, g, unknown, or other
  misc_feature (470)..(470): n is a, c, t, g, unknown, or other
  misc_feature (504)..(504): n is a, c, t, g, unknown, or other
  misc_feature (558)..(558): n is a, c, t, g, unknown, or other
  misc_feature (559)..(559): n is a, c, t, g, unknown, or other
  misc_feature (565)..(565): n is a, c, t, g, unknown, or other
  misc_feature (637)..(637): n is a, c, t, g, unknown, or other
aagctggagctccccgcggtggcggccgctctagaactagtggatcccccgggctgcaggaattcgcacgagaccattacctagaacatcctaatcgaaaaatgactctgatccaaccgtctgcattttcaggctctgagccccggaagaggagacgcatcatcatcctcatggctgcaaggggtttccagctgaggctttcgcgctggtttcagcgatcccatgcaagtgtttcccagtcccaggacgaagacgaccgcggcggcaagaggaacggcttgatgaggagccacttggaccagatcgtgccagtcacggatttcgccggcacgtccaactccnaggcgttagccggttcgtgtggaaccagcaaagaccgtggnnggctgaaggtgtccatgcactgctatggctggcgcaaggaaggtcgagaagcaagtgaagagctgccaagggagtgtgtccatcanaagtggagctggagagcaagaggctgaccgtccntcggaacgtagcccccacgacggtcctgggaggggggggtgtaaggtgacgaannatgcgnaaaatcttgcaggctccctagcatgatcgggcttttcaggtcaggccagttatgatgatgatgatgatgcanctggggtgaatcaa

SEQ ID NO: 26733 - protein, 131 aa, Zea mays
  misc_feature: Ceres CLONE 1399572-F
  misc_feature (81)..(81): Xaa is any aa, unknown, or other
  misc_feature (95)..(95): Xaa is any aa, unknown, or other
  misc_feature (123)..(123): Xaa is any aa, unknown, or other
MTLIQPSAFSGSEPRKRRRIIILMAARGFQLRLSRWFQRSHASVSQSQDEDDRGGKRNGLMRSHLDQIVPVTDFAGTSNSXALAGSCGTSKDRGXLKVSMHCYGWRKEGREASEELPRECVHXKWSWRARG

SEQ ID NO: 26734 - DNA, 655 bp, Zea mays
  misc_feature: Ceres CLONE 1399574-F
  misc_feature (201)..(201): n is a, c, t, g, unknown, or other
  misc_feature (202)..(202): n is a, c, t, g, unknown, or other
  misc_feature (204)..(204): n is a, c, t, g, unknown, or other
  misc_feature (205)..(205): n is a, c, t, g, unknown, or other
  misc_feature (231)..(231): n is a, c, t, g, unknown, or other
  misc_feature (234)..(234): n is a, c, t, g, unknown, or other
  misc_feature (235)..(235): n is a, c, t, g, unknown, or other
  misc_feature (243)..(243): n is a, c, t, g, unknown, or other
  misc_feature (244)..(244): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (303)..(303): n is a, c, t, g, unknown, or other
aagctggagctcaccgcggtggcggccgctctagaactagtggatcccccgggctgcaggaattcgcacgagaccattacctagaacatcctaatcgaaaacttgtgaacatcgcagtgctgtagcctccttcgtcttgagcgagcatggagatgtcagccatggaggaagccctccccaaggcgatggagaggaggaagnnanncctcatcaccatcccgctcatcatgntannggggagtnngagagggtgtcctcgnnngggatgttaacccacaaggaggggggaccgaagcgaggggnatctgctgaccactccctgtgcacccgtcgtcctctacttctggcctgctcttccccaactcccgccccccacaacgcgccgcggtccgccgactgccgtttcatcccctccccgcccttccccccttcgtctcctccttcatcctctcccggctcgtgtagcaatgcccccacacccacctcatcgcaattgtattcccctcccccccacgttcacttcgcccttcaccccaccgccaccccgccgcttcagcccctcccctgaccccatcggcctccgccccccccgcggtctgctctcacccgcacccccgtgctatccttccctcgccaacccccgcacccacaaccg

SEQ ID NO: 26735 - DNA, 638 bp, Zea mays
  misc_feature: Ceres CLONE 1399576-F
  misc_feature: Encodes the peptide sequence at SEQ ID NO. 26736
  misc_feature (416)..(416): n is a, c, t, g, unknown, or other
  misc_feature (489)..(489): n is a, c, t, g, unknown, or other
  misc_feature (629)..(629): n is a, c, t, g, unknown, or other
aagctggagctccccgcggtggcggccgctctagaactagtggatcccccgggctgcaggaattcgcacgagaccattacctagaacatcctaatcgaaaagtccgaaagtgtgtggagaacctgcccgattcctcccgccgcctccgacctcaccgtcggcgggctcagcttgttcctggggtctgatcagccatgttcaagaaacctgttgatgtgaaaaccatacagcgcttgtctggggcagacaaaaagaagctaagaagactgccaagggaaggtttccacaggcttctgatgctgaccttgatgccattcttcctcccaaggctgagataacagttgctaagtacccgaaccatgttcttgtatatggataagagggagagttcccaatgattttcaacactgacgcangaggtcatgaactgtttcctacagtttatgggcttttggaaggtcccccatctgttgccagctttacgctagngggggggggaggtttcaacgtttcgggatgggtggcgcttgatctgatggttcctggtatcagcatacctccccgaagggttcccatctttttgaggctgggcaaccatggggcagtaaaaaggttcctggtaccctgcntgaaaattg

SEQ ID NO: 26736 - protein, 81 aa, Zea mays
  misc_feature: Ceres CLONE 1399576-F
  misc_feature (8)..(8): Xaa is any aa, unknown, or other
  misc_feature (32)..(32): Xaa is any aa, unknown, or other
  misc_feature (79)..(79): Xaa is any aa, unknown, or other
MIFNTDAXGHELFPTVYGLLEGPPSVASFTLXGGGGFNVSGWVALDLMVPGISIPPRRVPIFLRLGNHGAVKRFLVPCXKI

SEQ ID NO: 26737 - DNA, 646 bp, Zea mays
  misc_feature: Ceres CLONE 1399578-F
  misc_feature: Encodes the peptide sequence at SEQ ID NO. 26738
  misc_feature (447)..(447): n is a, c, t, g, unknown, or other
aagctggagctccccgcggtggcggccgctctagaactagtggatcccccgggctgcaggaattcgcacgagaccattacctagaacatcctaatcgaaaaaccacaaagcggtgaaggagaaccaaggtaatcgaacccggaagcgaccttcttgagcccgaagcaaaaggcactgctcatcgatccgccactacgccacaaaatcctctcctactccggcagttctgctcgccgccgcctccacgatgacggaagacgtgcagatgaacgactcggagccccagcctgcggcctcagctcccgccgtcggggcgccggcgctctccacactacaccatctgaaggagatcgcgtccgtgatcgaggccggttctctgtccaaggaggtccgccggatctcccgcgccttccgcctcaccgtcgcgctccgtcgccgcctcgccgngcgagacgtctccgccttcctcgccttcgcgctacccgcgtcctccgaagcctacggacgctcactgcctggtggcccagaagatgatattggaaatggatgttgatgctgcagctccagcaactcagatttcaatcaacatgtcctccctgagattgaaattattgctacttgctcgtactgatttttcttaatgata

SEQ ID NO: 26738 - protein, 101 aa, Zea mays
  misc_feature: Ceres CLONE 1399578-F
  misc_feature (67)..(67): Xaa is any aa, unknown, or other
MTEDVQMNDSEPQPAASAPAVGAPALSTLHHLKEIASVIEAGSLSKEVRRISRAFRLTVALRRRLAXRDVSAFLAFALPASSEAYGRSLPGGPEDDIGNGC

SEQ ID NO: 26739 - DNA, 728 bp, Zea mays
  misc_feature: Ceres CLONE 1399579-F
  misc_feature (20)..(20): n is a, c, t, g, unknown, or other
cccgctggagctcaccgcgntggcggccgctctagaactagtggatcccccgggctgcaggaattcgcacgagaccattacctagaacatcctaatcaaaaagcttctcgccctaccatcgcctgaccgacgcgcccgttttctcctgaaaacagaaggctccggcctccggcatccgccaaaaaggggaacaaaggagagataacacacacacacacaaaccccaatccccctgcggcggcgatggacccgccatcgacggcctccggaggaaactccctccccgcccgccgccccaacgcgcacaaccgccccgaggcccaattacaacagacagcaacgcccacgaccaccacccacgcaccagcccccttcgctacgcaccctcacggccgcataagggagggaccgcatcgccgtgtgtgtgcccatatcaaattcaaaacccacaaaacccccagcgtccccccctctttaatccgggcccccggcgtaagtttaaccccccgcacgcctcctaccctcgacctgctctaacccgcggcccccccgcacgcctaccgtcctactccattacctgtcaagcacccatgacccccgatatttcccgaacataaacaccataaaacaaccgatctttacctcccctccccccaagcgaaggtgacgtccctccaacccaccacctccccaaacactcctagacagacaacccattcaccgccata

SEQ ID NO: 26740 - DNA, 612 bp, Zea mays
  misc_feature: Ceres CLONE 1399587-F
  misc_feature: Encodes the peptide sequence at SEQ ID NO. 26741
aaagctggagctccccgcggtggcggccgctctagaactagtggatcccccgggctgcaggaattcgcacgagaccattacctagaacatcctaatcgaaaacctcactctgtctcttcctcagtcccggcatcagcgctcaaaccctaacacgccacgcgatcccgatgcgcaggggtctgggcagggaggcatcgttgcgccggcggcgcgggccggcgcggctttgggtggcagtggcggcgctggtggtcgccaccgtgtgcctcttctcctcctcttcggtcggcctgttgggcgcctcttacagggtccaggatgttgatgtaaataagttgtggagaactgcagattcaaatggtgggagagcatcttctgcacgacgtacctactgcactcacccaccatctgaatctgacagtaatgcctacttgcgcgaccggtgccatggtgccttgaacccaaaacgcaccgccagatgtaacggagctgctgctgcaccgactcggaatgccaccctggtgccttgagaaatagacctccatgcctgctgcaatgatgaaggggcttgtgcaggtattcatgaggttcccctggtccccgcgacaggga

SEQ ID NO: 26741 - protein, 120 aa, Zea mays
  misc_feature: Ceres CLONE 1399587-F
MRRGLGREASLRRRRGPARLWVAVAALVVATVCLFSSSSVGLLGASYRVQDVDVNKLWRTADSNGGRASSARRTYCTHPPSESDSNAYLRDRCHGALNPKRTARCNGAAAAPTRNATLVP

SEQ ID NO: 26742 - DNA, 661 bp, Zea mays
  misc_feature: Ceres CLONE 1399588-F
  misc_feature (20)..(20): n is a, c, t, g, unknown, or other
  misc_feature (23)..(23): n is a, c, t, g, unknown, or other
ccgggtggagcttcctgcgntgncggccgctctagaactagtggatcccccgggctgcaggaattcgcacgagaccattacctagaacatcctaatcgaaaaacaaaccgaaaaaggccgcgacgagccgacgatctctactgcccccttccggccttcggagaccgtgacgagcaacgacgacgacggggacgatggtcgcttcctgcctctgctacgggcacttgcccgctgtttcgcctcgcgccagtcacatcgtccctgcctcgcatccccgttccgcaaacctctcgggggttttgggaaggtatcggtactgtcaagcctcgggcaaagtcagaagcgtcccacccgaaacaccccctccgttgctccccgcgcacgccacccgagcatcgggggcgagtgctcaccacgcaccccctcctgttcgtattcctccgacgcgaccaaacatctccccgccgcattggttagaaccccctcaccttagcccgtccccgcgatcgttttcttctcgcactgtcccctctccctccacccccccctcttccacgccccacacccgccagtccctcttgcacccccccccgactgtcccatcccctgcaccatccgcatgctgtccccacccccccatccttcggccctccgcgcctcc

SEQ ID NO: 26743 - DNA, 629 bp, Zea mays
  misc_feature: Ceres CLONE 1399593-F
  misc_feature: Encodes the peptide sequence at SEQ ID NO. 26744
  misc_feature (262)..(262): n is a, c, t, g, unknown, or other
  misc_feature (374)..(374): n is a, c, t, g, unknown, or other
  misc_feature (382)..(382): n is a, c, t, g, unknown, or other
  misc_feature (559)..(559): n is a, c, t, g, unknown, or other
  misc_feature (560)..(560): n is a, c, t, g, unknown, or other
aagctggagctccccgcggtggcggccgctctagaactagtggatcccccgggctgcaggaattcgcacgagaccattacctagaacatcctaatcaaaaaaacaaggggtagggccgccgccgccgccagcgccgccgtgcagatcgcggccggatctacggcgctggggcacgggggtccccggatcgacgacgcctccgccgagggttcggatggctatgcgaaaagaaaccctgtgcttaatgcttgtcaagcatccnatggccggatcacgcgagctcaagctgctgcaaatcgtcgaagctttggagctttcccttctgttccattgcctgcaaaaaccgaacgaaaacagactggcacaagggaagncaaaacgnaggttcttcatatgacaacaccagtgcaagcgttgcactttcaggcccccagcctaaaagcgcacagtacctcagggatgtgaccaatttgagcaatgctactctaaacaaaagttttgctgctgcaccgaagcttcagacaagccctctctaaggactggaaagaacgtgagcaannagcagccgtgcggaaaaaagattcctaaaaacaccaccagtggggtaatgaagggcatggactaatgtt

SEQ ID NO: 26744 - protein, 60 aa, Zea mays
  misc_feature: Ceres CLONE 1399593-F
  misc_feature (54)..(54): Xaa is any aa, unknown, or other
MAMRKETLCLMLVKHPMAGSRELKLLQIVEALELSLLFHCLQKPNENRLAQGKXKRRFFI

SEQ ID NO: 26745 - DNA, 663 bp, Zea mays
  misc_feature: Ceres CLONE 1399594-F
  misc_feature: Encodes the peptide sequence at SEQ ID NO. 26746
  misc_feature (463)..(463): n is a, c, t, g, unknown, or other
aagctggagctccccgcggtggcggccgctctagaactagtggatcccccgggctgcaggaattcgcacgagaccattacctagaacatcctaatcgaaaaatgtaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgggggggcctcgcggtcccatcctgctggaggactaccacctgattcgagaaggtggcgcacttcgcgcgcgagcgcatccccggagcgcgtggtgcacgcgcgcggggcctccgccaagggcttcttcgagtgcacccacgacgtgacgtcgctgacgtgcgccgacttcctgcgcgcgcccggcgtgcgnacgccccgtgatcgtgcgctcctcgacggtgatccacggagcggggttccccggagacgatccgcgacccgcgcggggtttcgccgggagttctacaccgggggggcaactgggaacctgcttggcaacaatttccccgtcttcttcctccgggacgggatcaaggttccccgaagggatccacgggttcaagcccaacc

SEQ ID NO: 26746 - protein, 163 aa, Zea mays
  misc_feature: Ceres CLONE 1399594-F
  misc_feature: SWISSPROT Homolog: EC 1.11.1.6 Catalase
MDPTKFRPSSSHDTTVTTTNAGAPVWNDNEALTGGASRSHPAGGLPPDSRRWRTSRASASPERVVHARGASAKGFFECTHDVTSLTCADFLRAPGVRTPRDRALLDGDPRSGVPRRRSATRAGFRREFYTGGATGNLLGNNFPVFFLRDGIKVPRRDPRVQAQ

SEQ ID NO: 26747 - DNA, 594 bp, Zea mays
  misc_feature: Ceres CLONE 1399599-F
  misc_feature: Encodes the peptide sequence at SEQ ID NO. 26748
  misc_feature (160)..(160): n is a, c, t, g, unknown, or other
  misc_feature (188)..(188): n is a, c, t, g, unknown, or other
  misc_feature (207)..(207): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (429)..(429): n is a, c, t, g, unknown, or other
tggagctcaccgcggtggcggccgctctagaactagtggatcccccgggctgcaggaattcgcacgagaccattacctagaacatcctaatcgaaaaagcagtccgatagccaggaagcccgtgcacgtcgaccgacgtacgccaccatggcggggctcnacataggcgacaccgtccccaacctggnagctggacctcaccacggnaggatcggatcaccgattacttggggaagggtacgttttatctttctctacccagcaatttcagccctggggaccaaagaaaatggggggaagtgggggtaaccccagggattccaaaaaaaggggggggaaaatttttggggaatttctggggaaaacggggggggccacaggggggggaacaagagagggggggggttcccgggggaaaaccccnnnncnctcttttaaacaacaaaaggggggttctccaatttttgggcccccggggggggaacctctccccgggtttaaagtggggggcccccccaaaaaaaaacccggggggggaaaaatattttcccccccgttttctattttttgggcccccaaaaagggcgggaattt

SEQ ID NO: 26748 - protein, 53 aa, Zea mays
  misc_feature: Ceres CLONE 1399599-F
  misc_feature: SWISSPROT Homolog: EC 1.11.1.15 Peroxiredoxin
  misc_feature (5)..(5): Xaa is any aa, unknown, or other
  misc_feature (14)..(14): Xaa is any aa, unknown, or other
MAGLXIGDTVPNLXAGPHHGRIGSPITWGRVRFIFLYPAISALGTKENGGKWG

SEQ ID NO: 26749 - DNA, 640 bp, Zea mays
  misc_feature: Ceres CLONE 1399602-F
  misc_feature: Translation starting site: 451
  misc_feature: SWISSPROT Homolog: EC 5.2.1.8 Peptidylprolyl isomerase
aagctggagctccccgcggtggcggccgctctagaactagtggatcccccgggctgcaggaattcgcacgagaccattacctagaacatcctaatcgaaaaaataatattatctcaaagctaaccaacaatggagttcccagaggtgttcttccacataaacatcatacggccaggaagtgggaaggatcgtgatgtaggtgtagaccgataagaccccgaagacgccatgagaatttcgtagctctgtgccatggacagaacgcagtgggtcgtaagggaaagcccctccacttcaagggatcttgcttccaacgactgatccccagtctaatgtgacagccacgtgctttcaccgcgtgaaacgggacaggaggtgacttcatctacggtgataagtgtcgaggacgagaactttgagaggaagcacacgagtcctgtgaacctttccatgtcgaacgccggacccaacaccaacgcatctcagctcttcatctgcaccgcaaaaaccgattcgattgacgctgggcacgcggagatctgtgatgtgtggaaagccctagacgcagtgaaggcgatatataaggcgggatcgtcgtctgcaataccgtcgcaggcagtgtatatcgccgattgtggac

SEQ ID NO: 26750 - DNA, 623 bp, Zea mays
  misc_feature: Ceres CLONE 1399604-F
  misc_feature: Encodes the peptide sequence at SEQ ID NO. 26751
  misc_feature (462)..(462): n is a, c, t, g, unknown, or other
  misc_feature (500)..(500): n is a, c, t, g, unknown, or other
aaagctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccgccatcgcgntggcgctcatggcggccgggttcgtcacctccggcggnctcggcgtccctgcgctgtccgtgttctcctggatggacaagtacctgacgggcaagcaaccgccgggcgccgaccagctggaccacgcaagggggaggcgggggtccaagggccgcgaaatc

SEQ ID NO: 26751 - protein, 142 aa, Zea mays
  misc_feature: Ceres CLONE 1399604-F
  misc_feature (36)..(142): Pfam Name: Oleosin Pfam Description: Oleosin
  misc_feature (89)..(89): Xaa is any aa, unknown, or other
MADHHRGATGGGGGYGDLQRGGGMHGEAQQQQKQGAMMTALKAATAATFGGSMLVLSGLILAGTVIALTVATPVLVIFSPVLVPAAIAXALMAAGFVTSGGLGVPALSVFSWMDKYLTGKQPPGADQLDHARGRRGSKGREI

SEQ ID NO: 26752 - DNA, 643 bp, Zea mays
  misc_feature: Ceres CLONE 1399605-F
  misc_feature: Encodes the peptide sequence at SEQ ID NO. 26753
aagctggagctccccgcggtggcggccgctctagaactagtggatcccccgggctgcaggaattcgcacgagaccattacctagaacatcctaatcgaaaaatcgcttcggttcggagtattcacgagcgccggggcagactctcgcccgagtgcgacagatcttcaaatccccattccgcccaccgatggagcttcacgccagtctcggtctcatccgaatgcgtcacgagcgggtgtatgagaggagaggaggaatatgacggagagcatctccgtccacatcgggcaggacggaatcgaagtcgatgacgcgtgatggcaactttactgactcgagcacggcatccagtgctgatggtcaagtggctggacataagaccgcgggacatcacgatgatggcttcagcaccttcttcagccagactggtgctggaaagaacgtatccccgagaaagcttcgttgatctacaagccactgcgatcgatgaggtgcgtactggcacgtaccgtgaggtcttccaccctgaacgactcatcagtgcgaagcatgatgccgctaacaatttccgccgtgggcactacacaagtgcgaaggatatagttgctgtgcgccttgaccgcatccgcaagcttgctgacag

SEQ ID NO: 26753 - protein, 108 aa, Zea mays
  misc_feature: Ceres CLONE 1399605-F
MATLLTRARHPVLMVKWLDIRPRDITMMASAPSSARLVLERTYPRESFVDLQATAIDEVRTGTYREVFHPERLISAKHDAANNFRRGHYTSAKDIVAVRLDRIRKLAD

SEQ ID NO: 26754 - DNA, 617 bp, Zea mays
  misc_feature: Ceres CLONE 1399608-F
aaagctggagctcaccgcggtggcggccgctctagaactagtggatcccccgggctgcaggaattcgcacgagaccattacctagaacatcctaatccaaaaatctctctctctcctctcatctccatcctctcctccggctagggagctcacacctgccgcgaggaagcttctgccctccccggcgtcgcgctctggacgactacggccgggaagatgggctggcggcttcaaggtacttcatgtggtcacgccctttctggatttcttgccagaggcgcagagcgtgtataggaagataccattcaaagaagaaggtatctacacgggtatttctctcttcatttttctgaggagcagccagctcccactctatgtgattcatacgacgagtgcagctgatcctttctactggatgggtgttatctttgcatcacactgtgcactgtgatgtagtagcgaatactccaattgggacctctgcgatgtgatgacactactggcgcatcgaaatcataaagtggacaacgcgtcaaaaggaccgcgcccttcaaatggggaaaaaagcgttgggatcctgagggaatggggaattgggcatattccggctgggaggt

SEQ ID NO: 26755 - DNA, 614 bp, Zea mays
  misc_feature: Ceres CLONE 1399609-F
  misc_feature: Encodes the peptide sequence at SEQ ID NO. 26756
aaagctggagctccccgcggtggcggccgctctagaactagtggatcccccgggctgcaggaattcgcacgagaccattacctagaacatcctaatcggaaaaatcgccaccactgggtcttcagaccattagctttatctactccagagcgcagaataacccgatcgacaccatgagggtgttgctcgatgccctcgctctcctggctctcgctgcgagcgccacctccacgcatactagcggcggctgcggctgccagccaccggcgccggatcatctaccgccgccggtgcatctgccacctccggatcacctgccacctccggtgcatctcccaccgccggtccacctgccgccgccggtccacctgccaccgccggtccatgtgccgccgacggatcatctgccggcgccaccatgccactaccctactcaaccggcccggcctcagcctcatccccagccacacccatgcccgtgccgacagacgcatccaagcccgtgccagctgcagggaacctgcggcgatggcagcaccccgatcctgggccagagcgtcgagcttctgacgcatcagagcagcccgacggcgacgccctactgctcgcctcgg

SEQ ID NO: 26756 - protein, 147 aa, Zea mays
  misc_feature: Ceres CLONE 1399609-F
MRVLLDALALLALAASATSTHTSGGCGCQPPAPDHLPPPVHLPPPDHLPPPVHLPPPVHLPPPVHLPPPVHVPPTDHLPAPPCHYPTQPARPQPHPQPHPCPCRQTHPSPCQLQGTCGDGSTPILGQSVELLTHQSSPTATPYCSPR

SEQ ID NO: 26757 - DNA, 670 bp, Zea mays
  misc_feature: Ceres CLONE 1399611-F
  misc_feature: SWISSPROT Homolog: EC 2.7.1.4 Fructokinase
  misc_feature (546)..(546): n is a, c, t, g, unknown, or other
aaagctggagctccccgcggtggcggccgctctagatctagtggatcccccgggctgcaggaattcgcacgagaccattacctagaacatcctaatcgaaaaatttatgttgtggcagggtgaccctcctcggccgctactaccggcatccgtcccctttgcatctagggagatctgagttatacggccggatccgactcgtgcccgtgctacagtgtgcgtgtgcgcatcacaatcgcctcgccttcccttccgcaccaacccgagtgtctcttctcgctgactctctctctcgcaggcgcgttcacctcgcagtatgatgcacgcgctactgtatgacgcctgtatgacaccgctgagattctgccccggcggcgaacaatcgcctggcgatgtctttcggagagatgctgatcgacttcgtccccgacgtgtgcggactgtccctggtcgagtggcggcgcctatcgtcaggggaccgggggtccgcacctgcaccggcaactgcgacatgccctgagctcggagggagccctccgccttcgnaggggaggtccagggaataaccatggccgcccccctgtctgggtgggggttcatggaaccccaacaaaagttcatcggcagtcgggggggccctgtctcccaaaatggaccgacccgtctcggt

SEQ ID NO: 26758 - DNA, 637 bp, Zea mays
  misc_feature: Ceres CLONE 1399612-F
  misc_feature: Encodes the peptide sequence at SEQ ID NO. 26759
  misc_feature (554)..(554): n is a, c, t, g, unknown, or other
aagctggagctccccgcggtggcggccgctctagaactagtggatcccccgggctgcaggaattcgcacgagaccattacctagaacatcctaatcgaaaatctaaatccataatacaggagctgggagcaaagctgcagtcaagggaaaaggcaggtgatgaactatcaacaaaagttaagatgctcgaggatttgtgccatgcacaactttctcagccagaacctaataaagacagatcatttgaagcatcttcctcaacaattgggacagatatatctgatattgaagatgcaggaccagtgggaaagacaacatcagtttcatctgtttctacagctgcacatgctagaacaatgcggaaggggtcagcggatcatcttgttgtcaacattggttcagagtcagaacgattgattgctgcgcaagattcacatgactaggagcgtataaaatcgctccatacatctgacttcattccagctcagggaaagcacatcgctgatagggtcgatgccttctgcgtctcagagaggcacattctgatgaaccgnccacgagcaagggctaggcttatgttgtactggctggctgtgcacctatggttgctgcgcagcatcttgtgacaccgcatctc

SEQ ID NO: 26759 - protein, 146 aa, Zea mays
  misc_feature: Ceres CLONE 1399612-F
AGAPRGGGRSRTSGSPGLQEFARDHYLEHPNRKSKSIIQELGAKLQSREKAGDELSTKVKMLEDLCHAQLSQPEPNKDRSFEASSSTIGTDISDIEDAGPVGKTTSVSSVSTAAHARTMRKGSADHLVVNIGSESERLIAAQDSHD

SEQ ID NO: 26760 - DNA, 687 bp, Zea mays
  misc_feature: Ceres CLONE 1399622-F
  misc_feature: Encodes the peptide sequence at SEQ ID NO. 26761
tggagctccccgcggtggcggccgctctagaactagtggatcccccgggctgcaggaattcgcacgagaccattacctagaacatcctaatcgaaaaacgcacctcccgacttctccggttctcccttcttcatagcagccacccacgcatctcagcgccgaggcgagcgaggacctcgtggttcgtgccctgctcacctcgtgaggatgtggatcgcgagtcggctcttcctcgcggcgggggcgctgctgatggctgtgcttctgctcgtccgggggccggtggcggcgcaggacgcggcggtggagggcgtggccccgcctgggaaggagatcgcggcggaacgcaaggcccaaggaggcggcgggttctggggggggggaggtagtggaaccttcagggcaaaaattttcccgcttaaaaccttcccattggccaagcaaaacctgggagtttcagaccccagaagggggggcatccggaaaccctggaccatcacttgcccaggggaaaagcccccaaagaaattgggtacctattgccaaaaaatgaaagaatattttcccccccgggagcccaaagagggtctttttaatctcctcacccgggaaaccggcaaaaaaaaggcgccccacggcccgggtggttctttttggggcgccctaaaaaaaaggccaccccccaag

SEQ ID NO: 26761 - protein, 160 aa, Zea mays
  misc_feature: Ceres CLONE 1399622-F
MWIASRLFLAAGALLMAVLLLVRGPVAAQDAAVEGVAPPGKEIAAERKAQGGGGFWGGGGSGTFRAKIFPLKTFPLAKQNLGVSDPRRGGIRKPWTITCPGEKPPKKLGTYCQKMKEYFPPREPKEGLFNLLTRETGKKKAPHGPGGSFWGALKKRPPPK

SEQ ID NO: 26762 - DNA, 642 bp, Zea mays
  misc_feature: Ceres CLONE 1399625-F
  misc_feature: Translation starting site: 435
  misc_feature (631)..(631): n is a, c, t, g, unknown, or other
aaagctggagctccccgcggtggcggccgctctagaactagtggatcccccgggctgcaggaattcgcacgagaccattacctagaacatcctaatcgaaaaatgtttcgatcgccgccacccccagaccccgatccgaagctgaggctcagaccatttcgatgcaacggcggcgaactcgaacttgctcatggcacatcactggcgcttctggtccgaacaccaaacagcgccgcggcgtgtggtccatcatggccccgaacggcgtcaccttccccaaggccgacaagggcgccaccgccgcggacacccgaggtctaccctggcgaagaccgccacgcccgcgttcacggcaaccggaggcctaagcctaccacagctcaggtcgaggatcacgcctggcaggctgctgatcctcctcgacaggctgttacatgcggaatagagtgagtgaatctcatgcagctgcaggtctggtctgctccttatcgctggggctttctagatctgtgcagcaacgattcgccgcgtgaaccacacctatgtcattgctacatcaaccaaagttgacatctctgccgatgatgtcaccaagttcgatgagaagtactttgccagtgcaaagaagcanaagctgaataa

SEQ ID NO: 26763 - DNA, 651 bp, Zea mays
  misc_feature: Ceres CLONE 1399627-F
  misc_feature: Encodes the peptide sequence at SEQ ID NO. 26764
aagctggagctccccgcggtggcggccgctctagaactagtggatcccccgggctgcaggaattcgcacgagaccattacctagaacatcctaatcgaaaaatatatacagaggcgcccgcgctactgctttacttccatgtgccgctcacaacataattttctggagtcttcgactcgaacagtgttcatatggatctggagtgcttcatcctggcatacgtaccagtcgccgtgagctgcggtgcatgaaggtgaacaactcccggtgcttccccatgtgcgacgacagatcgtcgcgctcacaaccttgttcctagcctgcctaggcagtgagatacccttctccgacttccagatactctatctctactggaatcaggacgagagactgatgtgcaactctgataattctactcgcaaagagcttattggcttcgagagagctatgtctaaagctcatagaaacggcactgttcctgattcctgatgcttccttgattggtgcattaatcatactgcaagaggaccaaggatattaatggttacgtagagaacgataagcgtctctggcaataatatatctattgtgtgttaacgtgactgttgtctgctccagatcttcaaaatgattgtaccgatatcgagcttt

SEQ ID NO: 26764 - protein, 31 aa, Zea mays
  misc_feature: Ceres CLONE 1399627-F
MCNSDNSTRKELIGFERAMSKAHRNGTVPDS

SEQ ID NO: 26765 - DNA, 617 bp, Zea mays
  misc_feature: Ceres CLONE 1399632-F
  misc_feature: Translation starting site: 167
  misc_feature (335)..(335): n is a, c, t, g, unknown, or other
  misc_feature (394)..(394): n is a, c, t, g, unknown, or other
  misc_feature (599)..(599): n is a, c, t, g, unknown, or other
  misc_feature (609)..(609): n is a, c, t, g, unknown, or other
aaagctggagctccccgcggtggcggccgctctagaactagtggatcccccgggctgcaggaattcgcacgagaccattacctagaacatcctaatcgaaaaatttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcaaggccaagaacggcggcgccttccccaaggccgacaaggccgccgccgccgtggaacccaagttctaccctgccgacgacgtcnagccccgcgttcccagcacccgcaagcctaagcctaccaagctcaggtcgagcatcacngcctgggacggtgctgatcctcctcgcagggcgcttcatgggggaagagagtggtgtttctcaagcagctcaagtctggcctgctccttatctctgggcctttcaagatcaatggagtaccgatccgccgtgtgaaccagacctatgtcattgctactcaaccaagtgacatctcgggggtgtgatgtcgcccagtttgatgacnagtactttgncagggaga

SEQ ID NO: 26766 - DNA, 641 bp, Zea mays
  misc_feature: Ceres CLONE 1399635-F
ggagctccccgcggtggcggccgctctagaactagtggatcccccgggctgcaggaattcgcacgagaccattacctagaacatcctaatcgaaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggaaaccctagcgacggcggcgtgctaccggtgacattgtccccctcggcccctccatccctgacgcagcggcgccagcctgcaggaagccagcccctattcgagacaaggtcgatctttgctgccttggcgagcttcagccgaatcaaggtcgagcatggcggcaggccagtaaatagagcaaccacaaacccttcaaattaatggagacctctgcagcaacccccgacccggccgccaccacagggcggccacttccccatcgccatccgccctccgtcgtcgctgaggctggggaggcccagcggcgcaaccgcaacatgcgcaaatcgggggtccccatctgac

SEQ ID NO: 26767 - DNA, 629 bp, Zea mays
  misc_feature: Ceres CLONE 1399637-F
  misc_feature (532)..(532): n is a, c, t, g, unknown, or other
aagctggagctccccgcggtggcggccgctctagaactagtggatcccccgggctgcaggaattcgcacgagaccattacctagaacatcctaatcgaaaaatttttttactgctgctgctcctagaccctgatgagaacttgtgtctcgcactatttggatgcaatggcgactacggcgaatttgtccacgggcgtcaagtgcgattctgggacgcacacgtaccatcgccgtgtggtgagcgccatctaggccaagaacggcgtctacttccccaaggaagacgagggcgccgacgccgcggaacccgagttctaccctgccgagctacgagagtcccgcgttaccggtacccgcaagcctaagtctaccaagatcaggtcgaggatcacgcctgagactgcgctgatcctcctcgcacgtcgcttcatgcgcaacagatcgatgcttctcaccgacgtcaggtctggcgctgctccttacttgagggcctttcaagatcagtggagtaccgatccgccgtgtgacccgnagctatggcattgctacatccatcaaagccgacatctctggcgatgatgtctccaagtatgatgacgagaactttgtcagtgagaagaagacaatgt

SEQ ID NO: 26768 - DNA, 625 bp, Zea mays
  misc_feature: Ceres CLONE 1399642-F
  misc_feature: Encodes the peptide sequence at SEQ ID NO. 26769
tggagctccccgcggtggcggccgctctagaactagtggatcccccgggctgcaggaattcgcacgagaccattacctagaacatcctaatcgaaaaatcggtttactgctcctcctcctctcccctgacgattacttgtctctcccgctaaatggatggacaggctactgcgccgaatttctccacagccggttccttcggtcacgcgaccgcgacgctcggaaaactccgtggagagcgaaagaggggaaccgagggggacgtactccccgacggagaaggaaagcgccgatgcgccgtgacccgcgattaccctgtctagctccgagaggccaacagcagcggcggtcgtcctcgtggatctatcttcatgatgtcgaggatccggcttcaagcttcgcggatcccacacgacacctccgagctcgctcgacagagtgatgcgtctcaccgacgtcgagcgtgcgccggtcgtacttgagtgctccgtcggacgtgtggagtagcaatacggcatctagcttgtgatgatggatacgggaaatccttagagccggacgttccggggtggatcttctgagaactggggaaggaaacgtgctccattggaagaagacaatctac

SEQ ID NO: 26769 - protein, 48 aa, Zea mays
  misc_feature: Ceres CLONE 1399642-F
MDRLLRRISPQPVPSVTRPRRSENSVESERGEPRGTYSPTEKESADAP

SEQ ID NO: 26770 - DNA, 856 bp, Zea mays
  misc_feature: Ceres CLONE 1399643-F
  misc_feature (12)..(12): n is a, c, t, g, unknown, or other
  misc_feature (17)..(17): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
tttttcctgttnggggnggggtgcgcccgggggggggggggggcgagacgtggcggcggggcccgggtgaagagnnnnnnccaaactgggactccccgcggtggcggccgctctattactagtggatcccccgggctgcaggaattcgcacgagaccattacctagaacatcctaatcgaaaaatcgatttccggctcctgttcctctcccctgacgatttcttctctctcccgctatttggatgcacacgctgctgcgccggatttctccacggccgggtcgttcgctcccgcgaccgcgcgctcttccaactctgtggatagtgcaagaggcgaaccaaggggggaggtctccccgaaggagaaggtgtctggcgatgccggcgggatccgatgatgtcacttgttcgcggtacggcgcaggcgaggaggctaccggggggggcgcccgcccctgcgtcctgacccgggggggggggggggggggattcgagagatttatgaggattgacgcttcgatcccccacccccgaaaaaggctcgaatacccctttggcctccccccgacttgcggggttggttgtttttttcaaccgcccccgccggagggccccccccccccgcgttcggacacccttggaggtgggtcttcgtccaaggaacgggaggggggccgccccgcgaggccccgggcacgacgtggcctccagtgcccccaactggcgacgttcgggggaagatcacatttcgaaacccctgggagcgcagtatcggggcgcccccgagcgggtcgggcgagaccactggtgaaaaaggccgaacgcggtttcccccgatcccccgcccgggttccccc

SEQ ID NO: 26771 - DNA, 636 bp, Zea mays
  misc_feature: Ceres CLONE 1399648-F
  misc_feature: Encodes the peptide sequence at SEQ ID NO. 26772
  misc_feature (608)..(608): n is a, c, t, g, unknown, or other
aagctggagctccccgcggtggcggccgctctagaactagtggatcccccgggctgcaggaattcgcacgagaccattacctagaacatcctaatcgaaaaattttgttgagacctagatacgggcccttgctctcctcggcccaccgatccacgccccgcacgcacacgacccgcagaccgcaccctgtcggcgagctcgctcccgttcccgaccgctgctctccgctcgacgccgtcgtcttccgcgcagctagtgtctacactcccggcgacgatggcggaggacttggttttggacacggagatccgagactgggtcctgatcccgctctccgtggttatggtcctcatcggcgtgctccgctactttgtctccaagctcatgcgctccccggagacctctccgtctcccgaccccaagctcgttaaggaagggcaggtggtcatcaggacgaggaacctgaggaccaacgcacagttcatcccggccaagactttcaaggcacgcaaggtttattacaccaacgaggaacatggattacttcatgttccaaaggaagacgcgcacaaggctcaggcagccatgttttctgatccaaacatggncatggacatgatgaagaagaactatccc

SEQ ID NO: 26772 - protein, 120 aa, Zea mays
  misc_feature: Ceres CLONE 1399648-F
  misc_feature (2)..(119): Pfam Name: DUF850 Pfam Description: Eukaryotic protein of unknown function (DUF850)
  misc_feature (111)..(111): Xaa is any aa, unknown, or other
MAEDLVLDTEIRDWVLIPLSVVMVLIGVLRYFVSKLMRSPETSPSPDPKLVKEGQVVIRTRNLRTNAQFIPAKTFKARKVYYTNEEHGLLHVPKEDAHKAQAAMFSDPNMXMDMMKKNYP

SEQ ID NO: 26773 - DNA, 786 bp, Zea mays
  misc_feature: Ceres CLONE 1399650-F
  misc_feature: Encodes the peptide sequence at SEQ ID NO. 26774
  misc_feature (65)..(65): n is a, c, t, g, unknown, or other
  misc_feature (72)..(72): n is a, c, t, g, unknown, or other
  misc_feature (73)..(73): n is a, c, t, g, unknown, or other
  misc_feature (784)..(784): n is a, c, t, g, unknown, or other
cccttccccccgccccgccccccccccgctccccctccttcactaccacttccttaagccccccngcccccnncaaaatggagctccaccgcggtggcggccgctctatacctagtggatccccggggctgcaggaattcgcacgagaccattacctagaacatcctaatcgaaaatttttttggttggatctagcgtgacggcaaagacggtgtatcgaagggccgacaatggttacgacgatcggtagtccatagcagcggcgggcgcaacttcgacccggttttcttcccatatatctgtcaaatccttctccggttgccctccatcggcagcaatttccgccatagataccggcgatcgagggcctcggacaacccaatcgacggagcagcgcggcggcaggagagggcaaacccttttcttctcagtactctacttgccccgcccctggtccgcctccgcaggaagataagacatgggtccagccactcggcttgattcaagtggatccatcgaccagtacccataaggaaactttttgggaagttttgaagaggcccctacaacccggaatgccccctccttgcccagggtgcataagggaaagcaaattggctggggtatttggtcccttggcgtggaggcaaccagctttgattggcccggctggcgcaaacccaaggccaaacgggataaacggccttccggcacaaggattggggggcaaatctgggggccaaaaatcggtgggccccctttgcccgaaaaaaaaggcaatttntg

SEQ ID NO: 26774 - protein, 40 aa, Zea mays
  misc_feature: Ceres CLONE 1399650-F
MELHRGGGRSIPSGSPGLQEFARDHYLEHPNRKFFWLDLA

SEQ ID NO: 26775 - DNA, 634 bp, Zea mays
  misc_feature: Ceres CLONE 1399651-F
aagctggagctccccgcggtggcggccgctctagaactagtggatcccccgggctgcaggaattcgcacgagaccattacctagaacatcctaatcgaaaaattggtgtcgggaacaacaagaggatggccagccatcccgtgcgagtcacttactctctcctccccatctgattcagcggcacacgaatccgcaaggtaatccatggatctctacccaggaggaagcggaggcggtggcaacggccccgcccgaggcggcggaggagaatgacaaggacaagctggctgctctgctgcagaggctgtgcaggccgctcttcttcggtcgcgaggacttccagaaacggatgcggtacctgtctcaaggatgaggcatgcgtgcacgcgcggatgcgccgacgaacacagttctcgcgccgcgccgagagaaacctcatcgtactctacgtcctcgccgaggtgtaaggtgttgcttatggcctcctgacgacaagaaatgaggatctaacttgagacaagaagccaatacgagtgctacgtatgttgattcttcctgctggatcctctgacgtataatcaacagctgaaaaatttcacaaggatgtttgagaagacacaccagaacacccttg

SEQ ID NO: 26776 - DNA, 604 bp, Zea mays
  misc_feature: Ceres CLONE 1399652-F
tggagctccccgcggtggcggccgctctagaactagtggatcccccgggctgcaggaattcgcacgagaccattacctagaacatcctaatcgaaaactttttgctcggctgacaccaggtagccgcccctcctctatccaccccttcacttgcttggtcttccactcacccctctctcgttattcacccggtctcctctcctgcaaagaggtacgtaactgcactttcctgctcagtcttttgatcggtttcagtgatgcactgatgctgtagagtttcgtttctgttagtactctaatcaacggacaacggtttctgttagtattcttgggttcatggctgtctgcagattgtcgcccttgctctgcctgctctattcgggctcagttcattctgtcgtaaacctcacctcgtaactgaaataagccatatgcgccgcgcgtcgaagcttagtgtctgatcgatacgctatccctacaattttctgagctgttgaactcctgcgcccgtctcctcgtcgaggacaggaagatgagctcgctacacgccacacgagcggagcttggcctggttgtcctgtacctgaacaaagccgaggcccgg

SEQ ID NO: 26777 - DNA, 651 bp, Zea mays
  misc_feature: Ceres CLONE 1399666-F
tccccgcggtggcggccgctctagaactagtggatcccccgggctgcaggaattcgcacgagaccattacctagaacatcctaatcgaaaaacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacaagctccgccaggttgctgtgtgaagtccaaggttgtcacatggattcagcacaagatttccaacccaggacattctctataaagttgtggccaccaagtgaaaagcacacggaatcatggctttggtggaccggggttggcacaaaaaaattttggcccaaaaaaccattttcctccaaaaaacccctttttgaaaaaaaaagtccttgaaaagcaaaaactttgaaaaatttttttttccccggggggggaaactctcaaaaaagcccccaggggggggggggttctccttcccccctatttttcggggaaaacccccccaaattgggggttgggttttttaaaaaaaaacccccgcactctctcttaaaaaaaagggggccccccg

SEQ ID NO: 26778 - DNA, 736 bp, Zea mays
  misc_feature: Ceres CLONE 1399667-F
  misc_feature: Encodes the peptide sequence at SEQ ID NO. 26779
tccccgcggtggcggccgctctagaactagtggatcccccgggctgcaggaattcgcacgagaccattacctagaacatcctaatcgaaaaatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcagggcccaccgtcacctccacgagcccgaccaacaatcagggcatcgcagaggtcgtggaggcgtccgtgcacgactaccaggagggcatgcgcgcctgcttcgatgccgccaagacatggatggcgattcctgctccaaagcgaggagagatcgctaggcaaatcggtgatgcactgagagcaaagctccatcaccttggcaggcttgtgtcacttgagatggcgaaaattcttcctgaagggatcggtgaggttcaggaaatcatcgacatgtgtgattatgctgtggggctaagtcgccaactaaatggatccattataccatctgaacgaccaaaccatatgatgatggacgtgtggaatccccttggagctgtgggtgttataacggcatttaatttcccttgtgctgtgcttggttggaatgcttgcattgctttggtctgtggtaattgtgtcgtctggaaaggtgctccacaactccactga

SEQ ID NO: 26779 - protein, 195 aa, Zea mays
  misc_feature: Ceres CLONE 1399667-F
  misc_feature: SWISSPROT Homolog: EC 1.2.1.3 Aldehyde dehydrogenase (NAD(+))
MGAFAKEEHQFLAELGLAQRNPGAFACGAWGGSGPTVTSTSPTNNQGIAEVVEASVHDYQEGMRACFDAAKTWMAIPAPKRGEIARQIGDALRAKLHHLGRLVSLEMAKILPEGIGEVQEIIDMCDYAVGLSRQLNGSIIPSERPNHMMMDVWNPLGAVGVITAFNFPCAVLGWNACIALVCGNCVVWKGAPQLH

SEQ ID NO: 26780 - DNA, 709 bp, Zea mays
  misc_feature: Ceres CLONE 1399672-F
  misc_feature: Encodes the peptide sequence at SEQ ID NO. 26781
  misc_feature (625)..(625): n is a, c, t, g, unknown, or other
  misc_feature (642)..(642): n is a, c, t, g, unknown, or other
  misc_feature (693)..(693): n is a, c, t, g, unknown, or other
ggagctccccgcggtggcggccgctctagaactagtggatcccccgggctgcaggaattcgcacgagaccattacctagaacatcctaatcgaaaacaacgcaagcgccgggcagtgcacgcacatggctgcgcgcgtgggcctgctcccgcacgcgatcctcgtctcctcccgagctctacccacgccccgagctcgcgtcccttatcctcttccacccgtcccttcctacctccgccacgcctcctcctccgccttccgctcctgccgcgcgtcgccgcgttttgtcgcagtccgcgccatggcttcggggaacccctacgccgccgagctcgccgccgcctagaagggcgtcaccctcgccgccaaactctgccagacagttcaacaggatattatgcattctggcgctcaggctaaggcagacaacagtcctgctacagtggctgactatggatctcacatattggacggattttacttacagatggatgtatcatctggatcattttcattggtaggctgagacgactcagatgacttgaggaaagatggcgctgaaaaattcttggagaattacgtgacctgtcaatgaaacatctttgatgatgggtcatatacattnccattacaaagcaaggnatactccctgcattcgatgatgggcaggctgacggagggtcattctggacnacatggggggcttgaa

SEQ ID NO: 26781 - protein, 42 aa, Zea mays
  misc_feature: Ceres CLONE 1399672-F
  misc_feature: SWISSPROT Homolog: EC 3.1.3.7 3'(2'),5'-bisphosphate nucleotidase
MHSGAQAKADNSPATVADYGSHILDGFYLQMDVSSGSFSLVG

SEQ ID NO: 26782 - DNA, 646 bp, Zea mays
  misc_feature: Ceres CLONE 1399676-F
  misc_feature: Encodes the peptide sequence at SEQ ID NO. 26783
  misc_feature (293)..(293): n is a, c, t, g, unknown, or other
  misc_feature (322)..(322): n is a, c, t, g, unknown, or other
ccaccgcggtggcggccgctctagaactagtggatcccccgggctgcaggaattcgcacgagaccattacctagaacatcctaatcgaaaaactagtcccaactcccaaccaccgccagccgtccgctctccgcaagcgcgaccttccggccagatccgccgcgtcgcgccgacgagcggtccttctgcctagtttctccgcccagcgagcggcgggttcctcggagattcccgctggccgcggggatccatttgtgactgctcgcgttgcgcctggatctggtttgggacgnaggagtgaaacgcgacggtgatcgtgcgnagtgggacgccatcagtgctctggtctgggggtcggtctcctcttcggctgagatctggaaggggttcccgggatccgtcgctacgatctgtgccaggcagagcacctggtcatctccgggtcgggggcatggagactctgctcatctctgaggggagcaaacaccaggtccccacttctcgggtccccgggaaaaaagggttataaagggtccccccaggcactctcagtatcatgtggggaattggcgggggggtccactcccgggattaccggcgggaatactgggggttccgccccgggagaaagggggggccctgtcca

SEQ ID NO: 26783 - protein, 30 aa, Zea mays
  misc_feature: Ceres CLONE 1399676-F
MWGIGGGVHSRDYRREYWGFRPGRKGGPCP

SEQ ID NO: 26784 - DNA, 663 bp, Zea mays
  misc_feature: Ceres CLONE 1399677-F
aaagctggagctccccgcggtggcggccgctctagaactagtggatcccccgggctgcaggaattcgcacgagaccattacctagaacatcctaatcgaaaactctcttcttccaccaccacctcctactccgctgcaaccccaaatctctccttcctcgcatacgcgcgcagcggaggagctgagaccaacgaagaagaagaagaacaaccgagcaagcacaagcttagctagcgtgtaggtgtccaaggcgacgacggccgccgcgccaggctagccaaccagctgctcatcgctcctagctgcggagccgatatggctggcgccgacgtcgacgacgggacggacctccctctcggcctgccgcgaggaggcgccgaccgcgcccggcttggcagagggtctccgagcacaccctcgaggaagagctgaagctccccccagcccccctggaggactctgtggcagatgcctgccgacgccgagttgcaggaatcgtcgtgcctgaatgcgcaagaagggaagatccgctgcccgctcctgcgttgggaacgccgcctccagggttataggtgccattagcatccccgctggggtgacccgccatgaatgaaggacgaaggttccggttaaagaagagacctgacagctcctttcctgcgg

SEQ ID NO: 26785 - DNA, 640 bp, Zea mays
  misc_feature: Ceres CLONE 1399679-F
aaagctggagctccccgcggtggcggccgctctataactagtggatcccccgggctgcaggaattcgcacgagaccattacctagaacatcctaatcgaaaaagggaggggaatcttcgtagagcactaggcagcgacggagtcagcgcagcttcgtctccttccttccttcccctttcgctggccgctggccgtcggcaccatcacctacggccacgggcgcagcgcggcgccgctccgtaccgggtccgcgggcctctcgccagggggacccgataagcctccgctgctctgctcggctgctcttaccgtctctcccgtccacggtccacttagctagaaacacacaacaaacaaggagaaatcgcaaggaggagcagcgcctgccgccgcgccgtatccagcgaggcagcccccccgccccgatctgccggcccgacacgctgggatcttcctttccttagccgaccggtcaacgccgcagatattctccttccctgcggctctggaggtttccgtaaacccgtcaccccccctccttctattccttgcaggtatcgacgatcagacggagcagttgcttcaatctcgacttcgacctccatctgcgttgaacccatttgggattttggagaggggg

SEQ ID NO: 26786 - DNA, 653 bp, Zea mays
  misc_feature: Ceres CLONE 1399682-F
  misc_feature: Encodes the peptide sequence at SEQ ID NO. 26787
  misc_feature (495)..(495): n is a, c, t, g, unknown, or other
  misc_feature (579)..(579): n is a, c, t, g, unknown, or other
  misc_feature (603)..(603): n is a, c, t, g, unknown, or other
  misc_feature (605)..(605): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
cgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacgggcttcgtgtggctccggcagcgccgccaggtggaccactacttcgccaaggccggccgccacgtgtcctacggcgccgaggtggtcggcggtggcccgacaagggccggctcaagaagatcacgggcgtcaaggccaaggagatggctgctgtgggtcaccctcacgagatcntgcgtcgacgacccgccccacgggtaagctccactgcagggccatccggcggcctgtccgcagcttcccccgtcgagggcctcnaaggcccgagaagcgcgcgccggnancccggggggtgctcccccgggaccgcgggggggnnnnnngggggnnnn

SEQ ID NO: 26787 - protein, 120 aa, Zea mays
  misc_feature: Ceres CLONE 1399682-F
  misc_feature (2)..(117): Pfam Name: DUF538 Pfam Description: Protein of unknown function, DUF538
MTLTIPDEVRAKAEVYVGDAAGQEKTRLLLQETGLPSGLLPLRDIIECGYVEETGFVWLRQRRQVDHYFAKAGRHVSYGAEVVGGGPTRAGSRRSRASRPRRWLLWVTLTRSCVDDPPHG

SEQ ID NO: 26788 - DNA, 664 bp, Zea mays
  misc_feature: Ceres CLONE 1399686-F
  misc_feature: Encodes the peptide sequence at SEQ ID NO. 26789
  misc_feature (268)..(268): n is a, c, t, g, unknown, or other
  misc_feature (503)..(503): n is a, c, t, g, unknown, or other
  misc_feature (531)..(531): n is a, c, t, g, unknown, or other
  misc_feature (552)..(552): n is a, c, t, g, unknown, or other
aaagctggagctccccgcggtggcggccgctctagaactagtggatcccccgggctgcaggaattcgcacgagaccattacctagaacatcctaatcgaaaagtccgccccccgccaccaccgcactcccatccagatgggagtgcgcaagaggagctttcggcattccggtctcgctcgaccaaccggatccccgtgagagtccccacccacaccccgagggcggcgtcgggtcgtcggggacagctgatttcacaagacgagccgngcgagccggccggcatttcgtcgtcggatggcgccggcctcctcctcgtccgccggcgtcgcgtgcctcgtcctgctcctgctcctgctcctcgccggcgcctccgcggcgcacggctcgttccaggctaggcgtgctctgtcagatgaccatgggagcggtatagtggcgcgatggcggaggttgctcgccgacgctgcgactccagcgaacaactctcttgtgctggctgcgncgaggactcaccggagcgaccccttcgncaccttaccgcgtacagcggncggctgaaacattagcgacgagcactactggggctttcgggacgtaccccgggggggcccctcttcctcatggccggggttgggggttcgtcggtttccgggggccgcatgt

SEQ ID NO: 26789 - protein, 87 aa, Zea mays
  misc_feature: Ceres CLONE 1399686-F
  misc_feature (70)..(70): Xaa is any aa, unknown, or other
  misc_feature (79)..(79): Xaa is any aa, unknown, or other
  misc_feature (86)..(86): Xaa is any aa, unknown, or other
MAPASSSSAGVACLVLLLLLLLAGASAAHGSFQARRALSDDHGSGIVARWRRLLADAATPANNSLVLAAXRTHRSDPFXTLPRTAXG

SEQ ID NO: 26790 - DNA, 674 bp, Zea mays
  misc_feature: Ceres CLONE 1399698-F
  misc_feature: Encodes the peptide sequence at SEQ ID NO. 26791
  misc_feature (337)..(337): n is a, c, t, g, unknown, or other
  misc_feature (374)..(374): n is a, c, t, g, unknown, or other
  misc_feature (375)..(375): n is a, c, t, g, unknown, or other
tccccgcggtggcggccgctctagaactagtggatcccccgggctgcaggaattcgcacgagaccattacctagaacatcctaatcgaaaagatccgatggcccgcgccgccgctcgcctcctccccatcttcctcccatggcggcgtcctcccccgccctgcctcctccgccggggcttcctaaaccctagcagccccagaacctccgcgcgcgtcgacaccctcgttctccctggagacgagcgcttgcccttcccctcgcccccacgcctcccgaaccagctgcgtcctgactacgggagtggcggcggaggcggcgctccctcgaccatcgcnggcatcgtcacctcactcggcggaggccctgcagcgnntggggatcgtgcggatctccgccccgatgccgtcgccgtcgccgaacgcgttttccgccaggcgggaccagaagggggtccaacgcgtggaaccggccagccactttgttgaaaacggactccgctcgacggggcggagggtttttgggccggggtttggggggggcaatgctccccccgggggccaacgcggggggggaggttgggggagctcggggcccgggaaaagattcctggtgggccccggggttaaggttttgtttggaaaaaggaacacaatctgtgggatccggggggaa

SEQ ID NO: 26791 - protein, 129 aa, Zea mays
  misc_feature: Ceres CLONE 1399698-F
  misc_feature (93)..(93): Xaa is any aa, unknown, or other
MARAAARLLPIFLPWRRPPPPCLLRRGFLNPSSPRTSARVDTLVLPGDERLPFPSPPRLPNQLRPDYGSGGGGGAPSTIAGIVTSLGGGPAAXGDRADLRPDAVAVAERVFRQAGPEGGPTRGTGQPLC

SEQ ID NO: 26792 - DNA, 496 bp, Zea mays
  misc_feature: Ceres CLONE 1399703-F
  misc_feature: Encodes the peptide sequence at SEQ ID NO. 26793
  misc_feature (394)..(394): n is a, c, t, g, unknown, or other
aaactggactccccgcggtggcggccgctcttaactagtggatcccccgggctgcggattcgcacgagaccattacctagaacatcctatcgaaaagctggtgcttctacggggcctggcgatttgaattcagtggtgcgtgtatagagcgtgagagagagaaaagagagtggctcttgcgctctgcagtcagtctgatcagactgcgatcgtgctcgctgacgccattggccggacctgaaccccttgtaacggggaggttggaaacccgggaaaaggaacttttaccccccccccccccccctagggggcctttttttgtgccccaaacttgggggccacggttccccccctttcccccgggggtcccccccccccccggggggcgcccccnaaattgttcccccccccggggtttccccccccccccccccagggggggggggggggggggccccccccccccgccgcggaaaaaattcttcttccccccccc

SEQ ID NO: 26793 - protein, 48 aa, Zea mays
  misc_feature: Ceres CLONE 1399703-F
KLDSPRWRPLLTSGSPGLRIRTRPLPRTSYRKAGASTGPGDLNSVVRV

SEQ ID NO: 26794 - DNA, 765 bp, Zea mays
  misc_feature: Ceres CLONE 1399706-F
  misc_feature: Encodes the peptide sequence at SEQ ID NO. 26795
  misc_feature (26)..(26): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
gtttttcctcttttttttttattaanaaacaaacacaataatggcacggccgcgcgcgcaactccccgcggtggcggccgctctagaactagtggatcccccgggctgcaggaattcgcacgagaccattacctagaacatcctaatcaaaaaattgtccagccatcctcaggcagcttcgagttccacgacgagagcaccggcagccgcacacgcgtttgtctcctcgccggaccttcccggcaccgccgccggctctccctcacggtccactacactccacagcaccgccgtcgcacaacgacatggcctcctccgctacctatctcatgctcgccagcgcccacgctcccctcgctcctctcataaggccaccgccgatggcccttgtcgcgagaaccgcccgcaacctccatcactaggcgcgaaagagccagtggccctctgttagtcaacccccgctgcgtgccggccgggactgcggggcccggggctgggcccatatctggcaaagatccgccctcccgggccccttcgggggccgaatctccctggtccagggccagaggatttgaaaaaaaagcgagggggggcaaaaggtgggcttcggatggccggagccttgggggaattaagacggggggaggggggctttttgaagggggaatatattgcatgaggannnnnnnnnccaacacccaccccccccctaaccaccgcccgcccagcgacaacagcccaccctcaccacccacgcccccaccc

SEQ ID NO: 26795 - protein, 38 aa, Zea mays
  misc_feature: Ceres CLONE 1399706-F
MASSATYLMLASAHAPLAPLIRPPPMALVARTARNLHH

SEQ ID NO: 26796 - DNA, 714 bp, Zea mays
  misc_feature: Ceres CLONE 1399709-F
  misc_feature (714)..(714): n is a, c, t, g, unknown, or other
tcaccgcggtggcggccgctctagaactagtggatcccccgggctgcaggaattcgcacgagaccattacctagaacatcctaatcgaaaaaggtctcagtatcaccacctctgcccagggttcatacacgctggaggaccagcgagcgagagataacttcgcttctcgcgcatagagcgatcgatcgctcgggcataatgaggcaggagaagcacgctctgctgtcgacagacatcgagaaccgcggcgtggagccacctggtgcggacgccggctaggcggtcttctgggggcgcgtgcgacgtcgcctgtcggacttcctgtatccagtgaatctcaaggacgagcggctcgagtatcactacctcataaggcaaggagtgtatctgggcaccgttcccgtcttagtgttggtgtgcggcgccgagctggacactctacaaacgcgaccatgctgtggcgcaaggagtgagcttaggacacctacgaactcgacactgagctcgacttcatcgccgtccactgcttcaccgtctgcgtatacatcatgtccagacacaggcccgaggacctcatcgactgagcatgatactgtgccgaacgacgagctcaaagtgtccaaggtggatgtaatagacctgtcgcgcaagctcgggaagatccataagcgacacctggagctccagtcgcgactgctgttcgagtacggcgtn

SEQ ID NO: 26797 - DNA, 727 bp, Zea mays
  misc_feature: Ceres CLONE 1399710-F
  misc_feature: Encodes the peptide sequence at SEQ ID NO. 26798
  misc_feature (468)..(468): n is a, c, t, g, unknown, or other
  misc_feature (480)..(480): n is a, c, t, g, unknown, or other
aaagtggagctccccgcggtggcggccgctctatcctagtggatcccccgggctgcaggaattcgcacgagaccattacctagaacatcctaatcgaaaaaacctctctcttctcctcaccactccaagatggtcaggccgaagctcactagcagcggccgagcaacgatggctacccacagattatccctccttgcgcttcttgcggttttggtgggagcaacgaatgggtgcattattccacaacgctcacttgctcgtagctccattagtcgacggttccgaagaccagtaatttcaatgcccttcgaacatccagatgctagagcctatatgctccgactagggattgcagtgcatgtgttacgcccaccacctgtccggatgccagaaccatctttgggacatctaaatataccaactatcgcaacgctatagccgcagcagttcctacccacgcgtgagccncctagccaaggngaaccctgacctctacttgcaatagaggctgcttgaattacccctacttggtctaaaaaaacaaagtgggaattgcgagacaagaacaactggcgacagtcttctgaaccacgacttagtcaagttagccattggggaaaccctgggcagcccaacgcttacaaaagccaacccactgcctctttgattcgaaggcccgactcggtctggtggaacaaatggccccctcacgctaacccttggagaa

SEQ ID NO: 26798 - protein, 89 aa, Zea mays
  misc_feature: Ceres CLONE 1399710-F
MATHRLSLLALLAVLVGATNGCIIPQRSLARSSISRRFRRPVISMPFEHPDARAYMLRLGIAVHVLRPPPVRMPEPSLGHLNIPTIATL

SEQ ID NO: 26799 - DNA, 1010 bp, Zea mays
  misc_feature: Ceres CLONE 1399710-R
  misc_feature: SWISSPROT Homolog: EC 3.1.26.11 Ribonuclease Z
caaattgggtaccgggccccccctcgaagtcgacggtatcgataagcttttttttttttttttttactttaacaaattaatcggttcctgatgttaacatacattcagtaaataagggctagaaagagaaacacaagctgttctacttatatacacttatctataatcagatttgaagccttctgttagagcaacaacctttgaatttagcttaggttgtagcctggaaacagcctggcgaatatcctcaagactatatcgatttgagaaatgagtgagtacgattgtttcgttcctgaaccactggaaatgctccattatctcagaaagatgcatgtggccatgttccctagcatgctcaacatcaacatgggcatttaggaacgttgcctcagttatgagaaaccctccccctcaaggcatcttgaatttctttgggtccaagaataaaatccagacttttgtaatctcctgtgaaaggcaacttcctggggtaaagtaagggtatcccgaaaatctcgagtttcctgaattgcttccaatttttaattaattttgacctaaccctttcaaaaagggagaatttccgtggtttttttcacaacttgttctctcggaaatcatgagtttagtatagaaccttaaacccccctggacttgggggtattaacgggggggggcgacagcttttggaaaaatagagcccctgggccaaaccaaaaaatcaatctaccggctattttccccaataggctgcctccccctcccaaaaatctttgtgtgtgcttgcaaatatttcaatactttatttagacacccccattttggatagtccgggcgatgcaagaaatgggcctctgcaaaaggcaagaaatacctagtaaactaacattcacccttgcatagacaggtggggggttacacaaaacacccgggtatcggacgggcgctctcaaacgtttttatcacgagcacaccagggggtatacatatgagattcaactcgaggg

SEQ ID NO: 26800 - DNA, 530 bp, Zea mays
  misc_feature: Ceres CLONE 1399714-F
  misc_feature (85)..(85): n is a, c, t, g, unknown, or other
  misc_feature (101)..(101): n is a, c, t, g, unknown, or other
  misc_feature (272)..(272): n is a, c, t, g, unknown, or other
  misc_feature (292)..(292): n is a, c, t, g, unknown, or other
tcaccgcggtggcggccgctctagaactagtggatcccccgggctgcaggaattcgcacgagaccattacctagaacatcctaantcgaaaaaggcaacancagcaatcagcagaaaaacattctccttggccttccatccatatgatccatccctccaggctccagctaactccaaactaccctctggttcgactcgcgttcgcatcgcaagcagcagcgtaccatcgaggcatggcggtgatggccgagtagtgtcgaccacggggcggngctcggagcccggcacgcancacccggggggggggggcgcgggaaaggcaccgaccctgaaagctcccgttcatgagggaatgccccccacggggacccccggaaaaaaccggggttggggaaatccccccccccggaagggggaacccggaaacctcccccagagggggggggccccccggggtataaagaaccgcccccctccgcgcgcgggggggccgggggggaaaaaaagagcccccgcccccccccccccgg

SEQ ID NO: 26801 - DNA, 742 bp, Zea mays
  misc_feature: Ceres CLONE 1399715-F
  misc_feature: Encodes the peptide sequence at SEQ ID NO. 26802
  misc_feature (507)..(507): n is a, c, t, g, unknown, or other
  misc_feature (508)..(508): n is a, c, t, g, unknown, or other
  misc_feature (518)..(518): n is a, c, t, g, unknown, or other
  misc_feature (565)..(565): n is a, c, t, g, unknown, or other
  misc_feature (691)..(691): n is a, c, t, g, unknown, or other
aagctggagctccccgcggtggcggccgctctagaactagtggatcccccgggctgcaggaattcgcacgagaccattacctagaacatcctaatcgaaaaagccagcaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggcggaatctcccgggacgcctctccgtccgcgcctccgcgacggtggtagcggcaccgcggcgggagacggatcccaagaagcgggtggtgatcacggcgatgcggctggtctccgttttcgggaacgatgtagacgcttactacgaccgcctgctagtcggggagagcggcatcgggcccatcgaccgcttcgacgcttctaagtccccacccgctttnngcgtcagatncggggcttctcctccgaggatacatcgacggaaaagacgaccgccgncttgatgattgcctcgatactgcatcctcagtggcaagaaggctctcaagccctcggtatcggccacggtttccagcccatgaaaaaaatgacaaaccccgggccggtgggcttggggcaactggnaatgggggccccacggggtttttcgggaagggtgccgactcccattggaaa

SEQ ID NO: 26802 - protein, 112 aa, Zea mays
  misc_feature: Ceres CLONE 1399715-F
  misc_feature: SWISSPROT Homolog: EC 2.3.1.41 Beta-ketoacyl-acyl-carrier-protein synthase I
  misc_feature (93)..(93): Xaa is any aa, unknown, or other
  misc_feature (94)..(94): Xaa is any aa, unknown, or other
  misc_feature (97)..(97): Xaa is any aa, unknown, or other
MQSLLLPTAAVAPVAPPCGRRNLPGRLSVRASATVVAAPRRETDPKKRVVITAMRLVSVFGNDVDAYYDRLLVGESGIGPIDRFDASKSPPAXXVRXGASPPRIHRRKRRPP

SEQ ID NO: 26803 - DNA, 524 bp, Zea mays
  misc_feature: Ceres CLONE 1399720-F
  misc_feature (1)..(1): n is a, c, t, g, unknown, or other
  misc_feature (34)..(34): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (66)..(66): n is a, c, t, g, unknown, or other
  misc_feature (67)..(67): n is a, c, t, g, unknown, or other
  misc_feature (85)..(85): n is a, c, t, g, unknown, or other
  misc_feature (279)..(279): n is a, c, t, g, unknown, or other
nttcctttcctccccccctgttatggaagaaggngggcacaaaatcaccttgggnnnctccaaatnntcaaactgggactccccncgggtggcggccgctctagaactagtggatcccccgggctgcaggaattcgcacgagaccattacctagaacatcctaatcgaaaaatcgatccgccaccacgccacaaaatcctctcctactccggcagttctgctcgccgccgcctccacgatgacggaagacgtgcagatgaacgactcgggagccccagncctggcggcctcagcttcccgcccgtccgggggcgccggcgcttctcccacaactaacaccatcctgaagggagatcggcggtccggtgaatccgagggccgggttcctcctgtccaaagggaggtcccggccgggatttttcccgggggccttttccggccttcaacggttggggggtttccggtcggcccccccccccgcccggggggggggaaaggtttcccccccccttttcccttcggcg

SEQ ID NO: 26804 - DNA, 679 bp, Zea mays
  misc_feature: Ceres CLONE 1399723-F
  misc_feature (421)..(421): n is a, c, t, g, unknown, or other
  misc_feature (425)..(425): n is a, c, t, g, unknown, or other
  misc_feature (426)..(426): n is a, c, t, g, unknown, or other
  misc_feature (605)..(605): n is a, c, t, g, unknown, or other
  misc_feature (611)..(611): n is a, c, t, g, unknown, or other
  misc_feature (618)..(618): n is a, c, t, g, unknown, or other
  misc_feature (619)..(619): n is a, c, t, g, unknown, or other
  misc_feature (623)..(623): n is a, c, t, g, unknown, or other
  misc_feature (650)..(650): n is a, c, t, g, unknown, or other
ggagctccccgcggtggcggccgctctagaactagtggatcccccgggctgcaggaattcgcacgagaccattacctagaacatcctaatcgaaaaatcttcaaaaactacccacggcccgtctcctcgacctccccgaaaccccacttctcggatcgagactagggttagggtttcgtcactcccgccccgattcgaaccaatccgcctaggcccccgccgcgccatggccgccggttccattgtggtggacttcccctccatgggcgccgccctctgcttccccaacctcgaatcactcctccgagactccgcctcgggtttcctctccgccgtctccgccgccccggcccccggcgccgccgacctcaccaacttccaccgcgtcttctcgcgcgtcctcagcacctactcagacccnccgnnctcgaggtcgtctggttcttctccgcgctctccttccacgaccgccctgacgacctccgctcactgctccagctcctctccgccttcgccgcttccctcgcctggggccgccaagccgctcgcctccccggcccccgtcggtctccgagcttttccactcaaaaaagccgcgcaggggnaccccnaggccgnncccnccggaggctgtcctcagctacatcagnaaatctgcagcagtcgcccccgccctcct

SEQ ID NO: 26805 - DNA, 717 bp, Zea mays
  misc_feature: Ceres CLONE 1399724-F
  misc_feature (664)..(664): n is a, c, t, g, unknown, or other
  misc_feature (705)..(705): n is a, c, t, g, unknown, or other
tccccgcggtggcggccgctctagaactagtggatcccccgggctgcaggaattcgcacgagaccattacctagaacatcctaatcgaaaaattcttttctgctgctgcgaccgtaggatcggcgtccagcagcctcgccgcgtcggtatggttttcccttggcccacacatcctagctcttccgcattcttgaatttcgtggtcgaggattagggggtttctcgtgcgctggtccaatttcgcgctaatcgtcctgttcctgcctcggattactcgccttctcgtggtccccatctgttcttggcgttcgcacgcttgccgtgcggcgggcagggctgcagcagcagccggcagcgcgtgcatcttgcgaccccctttccaagaaccagctgcaagctttggccttttccgcctgccgtacccgaaatcccgcaagaaactccacccaagaaaaaagcggcgcccttttggctggctggctgccattcctcacgccccacgagtttggtgaggctttgaaacgagcacagttcacaagacagtgaggctgcggtgcgtgtttcctcgtcggagatggagggaaatttgcccgcgcaagcatggtcccagtcggaggacccttcgatctggggcagccgtatcacttcgtcgtctacctcaggngctccaggttacccagatgtcttcgctgcccccgccgcgangcagatgccgca

SEQ ID NO: 26806 - DNA, 707 bp, Zea mays
  misc_feature: Ceres CLONE 1399727-F
  misc_feature: Encodes the peptide sequence at SEQ ID NO. 26807
ggagctccccgcggtggcggccgctctagaactagtggatcccccgggctgcaggaattcgcacgagaccattacctagaacatccttatcgaaaacactggcactcaccaaacaacctgcatctttcttctccggagtttccttttctcccaagaaccatcattaaagaaaaaaaaacttttagcaccttaccatctgggccggctgatatgaacgaacggacttccggtactcaccaatccctgtcccattctcgccgtgcagacccgctgtcgctggtccgggactaccgcgtcaaggagcagctggcggacgagggcatcgacgtgcagtccttcaatgccgatctgctgtacgagccgtgggaggtcctcgacgaagaccgccgccccttcaccatggtcgcgccattctggaacaggtgcctgtgcatgccggaccccgccgcaccgctgctgccgcccaagaggatcaattcaggtgacctgtccaggagcccgtgggacgagctggtctttgaggacgagtccgagaggggcagcaacgcgctgctcgcgcgggcgtgggcaccagggtggcagaacgccgacaaggcgctgacggccttcctcaacggcccgctgatggactactccgtgaaccgcaagaaggccgacagcgccagcacgtcgctgctgtctacgtacctgcacttcggcgagctcag

SEQ ID NO: 26807 - protein, 165 aa, Zea mays
  misc_feature: Ceres CLONE 1399727-F
  misc_feature: SWISSPROT Homolog: EC 4.1.99.3 Deoxyribodipyrimidine photo-lyase
MNERTSGTHQSLSHSRRADPLSLVRDYRVKEQLADEGIDVQSFNADLLYEPWEVLDEDRRPFTMVAPFWNRCLCMPDPAAPLLPPKRINSGDLSRSPWDELVFEDESERGSNALLARAWAPGWQNADKALTAFLNGPLMDYSVNRKKADSASTSLLSTYLHFGEL

SEQ ID NO: 26808 - DNA, 671 bp, Zea mays
  misc_feature: Ceres CLONE 1399728-F
  misc_feature: Encodes the peptide sequence at SEQ ID NO. 26809
tggagctcaccgcggtggcggccgctctataactagtggatcccccgggctgcaggaattcgcacgagaccattacctagaacatcctaatcgaaaacttttattcctccttggcaaggccatgccaccgtcgagcccaggaggcggaagtcaacgtaaccaagcgaacccatccatggcctccgctgctgccgtcgtctccctcaacgtcggcggcgagatcttccagaccaccaccgccacactttcccgcgccggcgcctcctccccgcttgcctccctcggtccctcctccccgtctgctccgcacttcctcgacggcgacccgcgcctctttgcccaactcctatccttcctccgccatggccgcctccttgctccgtcctatccctcagccacgctcctcgctgaggcgcgccacttcgcgctcgatggcgccctcctcgcttctctctccccggcctccgcctttgccccgctctcgctgcgcccttccgcgctcctcccgctcaccggccgcgtcgcgccctccgccgtagcgctgtgcccctcgccgcctcacccggtctccctcgtcgcgcaacacgggtggggtcgtcacctgcttcgacgccgcgctcgcctcccccaccagcgtcctcacgcgctggccgccgtacttttttttcccc

SEQ ID NO: 26809 - protein, 183 aa, Zea mays
  misc_feature: Ceres CLONE 1399728-F
  misc_feature (26)..(111): Pfam Name: K_tetra Pfam Description: K+ channel tetramerisation domain
MPPSSPGGGSQRNQANPSMASAAAVVSLNVGGEIFQTTTATLSRAGASSPLASLGPSSPSAPHFLDGDPRLFAQLLSFLRHGRLLAPSYPSATLLAEARHFALDGALLASLSPASAFAPLSLRPSALLPLTGRVAPSAVALCPSPPHPVSLVAQHGWGRHLLRRRARLPHQRPHALAAVLFFP

SEQ ID NO: 26810 - DNA, 683 bp, Zea mays
  misc_feature: Ceres CLONE 1399731-F
  misc_feature: Translation starting site: 228
  misc_feature (500)..(500): n is a, c, t, g, unknown, or other
cgcggtggcggccgctctagaactagtggatcccccgggctgcaggaattcgcacgagaccattacctagaacatcctaatcgaaaaaggcaacacagcaatcagcagaaaaacatctccttggccttccatccatatgatccatccctccaggctccagctaactccaaactaccctctggttcgactcgcgttcgcatcgcaagcagcagcgtaccatcgaggcaatggcggtgatggccgaagtagtgtcgaccaccggcgcggcgctccggagcccggccacgcagcagccggcggcggcgggcgcggcgaagggcaccgacgctgagaagctccagttcatcgaggacatgacctccaacgtggacgccgtgcaggagcgcgtggctgggggagatcctcgcccgcaacgcggacaccgagtacctctccagcaggtgcggcctcgccggcgctacggaccgcgccaccttccgcgccaaggtgccggatggcgnacgtacgaggacctgcagccgtacatccggcgccatcggccgacggcgaccgtcgcccaattcctgtcgggggcaccggggggcctccgagttcctcacaggctcccgggaacggtccggggcgggggagcgggaagctcatgccccacacattcgaggaacgagctcaaccgccggccagct

SEQ ID NO: 26811 - DNA, 729 bp, Zea mays
  misc_feature: Ceres CLONE 1399732-F
  misc_feature: Encodes the peptide sequence at SEQ ID NO. 26812
cacccgcggtggcggccgctctagcactagtggatcccccgggctgcaggaattcgcacgagaccattacctagaacttcctaatcgaaaaaccagaccgccgtcgctcgctcgcctgcacaacctctccatccaggccacagctcgagaccaacgaccgacgcctagacgcggctgggcggtcggcctcacctcgttcccccgcctcccttcttcctgctccgcgtctcgatctcgactcccccgccgcgtcgcgcgacccggccagatctcgcccaccctgcgccgcggccatggataacttgatcaccctcgtcaacaagctgcagagggcttgcacggctctcggagaccacggagaggagagcgccctcccgacgctctgggactcgctgccggctatcgccgtcgttggaggacagagctctggtaaatcatctgtgttggagagcgtggttgggaaggatttcctaccgaggggttcaggcattgtaacccggcggcctctggtgctgcagctccacagaattgatggtgacaggcaatatgcagagtccctgcatcttccgagaaagagatttaagattttgctgctgcgagaaaggagatagctgatgaaactgacggagaaacgggccgtcaaagccaaatcaactgcccctaaccatttaagctaatttccccccaggggggcaacctcacctctattgagctcccggggctaattaa

SEQ ID NO: 26812 - protein, 105 aa, Zea mays
  misc_feature: Ceres CLONE 1399732-F
  misc_feature: SWISSPROT Homolog: EC 3.6.5.5 Dynamin GTPase
MDNLITLVNKLQRACTALGDHGEESALPTLWDSLPAIAVVGGQSSGKSSVLESVVGKDFLPRGSGIVTRRPLVLQLHRIDGDRQYAESLHLPRKRFKILLLRERR

SEQ ID NO: 26813 - DNA, 664 bp, Zea mays
  misc_feature: Ceres CLONE 1399750-F
  misc_feature: Encodes the peptide sequence at SEQ ID NO. 26814
  misc_feature (311)..(311): n is a, c, t, g, unknown, or other
  misc_feature (330)..(330): n is a, c, t, g, unknown, or other
cgcggtggcggccgctctagaactagtggatcccccgggctgcaggaattcgcacgagaccattacctagaacatcctaatcgaaaatagggtttctcgcgcggcgctccgctccccgccctcctccgctccgcgcccgatcgcctcttcatctacctcctcaaagcttcgactgttccacacccccacccatatcaacccctttcccctttagctccttcccaccgatacgcccgccgcgtgaagcattcgttagccgagccgccgcaaccatgtcgtcgttctggggtgtggaagtgaagcccggaagncctacactctcaccatggngacttcggcggcggctgcgcctcacccagggaagctaggggttgatgtccgccaggggaaaaagggtacggcggggaaaggggggggctaagggaaggccaaaaaaaaaacccgttttttttggggcccttggccgaaaaccggaaaacccccggggaaaaaatttgggggaaacccctcttcggtggggggggaggaaccccccccggaaaaataatgggggggggggggaaaaaaaagggggggttttttgggggctccccccaaaaaaaagagaggggtttttctttggggagaacaaaaaaaactatttttttttaatcacaagggagag

SEQ ID NO: 26814 - protein, 31 aa, Zea mays
  misc_feature: Ceres CLONE 1399750-F
  misc_feature (13)..(13): Xaa is any aa, unknown, or other
  misc_feature (20)..(20): Xaa is any aa, unknown, or other
MSSFWGVEVKPGXPTLSPWXLRRRLRLTQGS

SEQ ID NO: 26815 - DNA, 687 bp, Zea mays
  misc_feature: Ceres CLONE 1399752-F
  misc_feature: Encodes the peptide sequence at SEQ ID NO. 26816
  misc_feature (596)..(596): n is a, c, t, g, unknown, or other
  misc_feature (611)..(611): n is a, c, t, g, unknown, or other
  misc_feature (612)..(612): n is a, c, t, g, unknown, or other
gctctagaactagtggatcccccgggctgcaggaattcgcacgagaccattacctagaacatcctaatcgaaaaaatgtcaaatctctcgcgagcgaggcagacccacgggccgcggccatctcacggtggaagcagccaagcagccggcctggcgcccctccccttccgtcccgccgctgctgccgtgcctcgtgcctgccagcggcggatgccgccccgccccgctgctgaccaccgccgctgctgagcatggccgccgctcccgcgggcgctcagaaccgctgcgtcttcgttggcaacataccatatgatgcgacggaggagcagctcgtgcagatttgcgaagaagtcggcccagtcgtatccttcagattggtgattgacaaagagaccggcaagccaaaaggttatggcttttgcgagtacaaggatgaggaaactgctttaagtgcacgccggaaccttcagggttacgagattaatggtcgtcagttacgtgttgattttgctgaaagtgggaggaacactgatagaaatagagaaaaggtcgtggagggaccaggatggcatctaatgttgatagtcaaaaacggntagctgggacttctnngtgtgaaagacaaactttcatcagcctggtgtctcccaccggcaaacatgctgcatctgtgatggttggtgccct

SEQ ID NO: 26816 - protein, 115 aa, Zea mays
  misc_feature: Ceres CLONE 1399752-F
  misc_feature (13)..(84): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAAPAGAQNRCVFVGNIPYDATEEQLVQICEEVGPVVSFRLVIDKETGKPKGYGFCEYKDEETALSARRNLQGYEINGRQLRVDFAESGRNTDRNREKVVEGPGWHLMLIVKNG

SEQ ID NO: 26817 - DNA, 630 bp, Zea mays
  misc_feature: Ceres CLONE 1399753-F
  misc_feature: Encodes the peptide sequence at SEQ ID NO. 26818
  misc_feature (270)..(270): n is a, c, t, g, unknown, or other
  misc_feature (562)..(562): n is a, c, t, g, unknown, or other
aaagctggagctccccgcggtggcggccgctctagaactagtggatcccccgggctgcaggaattcgcacgagaccattacctagaacatcctaatcaaaaacagccgaaggggaaagggagcgagatgggggcggaccggttcctgagcgtggcggagggcggcctcggcggcgaggcgctctacttcgcggtgatcctatggctgtccgtcatgtcgtggatcatcttcacctgggtcggcgacggcgggaggaacacgggaggcggnggaggaagcgccggggcagccgcggcagcccggtgttcgtcggcgcgtcggggatctgcgacggcaccgggcccgagtgcagcggcgggtacggcatctgcggcacctgcctcgactagcctgctctgctactagtaagtttgtgtgagcgtcaaaagcgcggccatgtttgtagctgtagcgtctacatgtcgtcgtcgtcgtcgtcgtcgtcgatgcgtggcctcgatggagaagctggcgttgctctggtgatatgatgagagcagagcagctcccctgtgtgaagacnataaagaggaggagcctactcatcagcctacttccatcttgcttattaggctgctcaaactgagttgt

SEQ ID NO: 26818 - protein, 92 aa, Zea mays
  misc_feature: Ceres CLONE 1399753-F
MGADRFLSVAEGGLGGEALYFAVILWLSVMSWIIFTWVGDGGRNTGGGGGSAGAAAAARCSSARRGSATAPGPSAAAGTASAAPASTSLLCY

SEQ ID NO: 26819 - DNA, 497 bp, Zea mays
  misc_feature: Ceres CLONE 1399754-F
  misc_feature (11)..(11): n is a, c, t, g, unknown, or other
  misc_feature (179)..(179): n is a, c, t, g, unknown, or other
  misc_feature (224)..(224): n is a, c, t, g, unknown, or other
  misc_feature (298)..(298): n is a, c, t, g, unknown, or other
tccaccggcgngtggggcggccgctctatcactagtggatcccccgggctgcaggaattcgcacgagaccattacctagaacatcctaatcgaaaaagttcgttcgcgttgcccgcgactctctccgtcctcctactgcccacccgactcacacgcttggacgcgcgtgcttcacccgntcgtcggctctctctcggctgcctgattgatttgggtgccccggntccagcaatggcgggtcccaggcgccattattccccccccccttaaccccccgggaggtcccccttttcctcgntaaaggggggcggccggagggcaaaccgttttgggcggccacccaatggaactcttcctcctcctcgggcccaaaaaaaagggggttttggggggcccccaaaaaaggggttccggggtcccccccccccccccctttttttgggggactttccccccgagggggaaaataaaaaccgggggggggggagggaaggggg

SEQ ID NO: 26820 - DNA, 678 bp, Zea mays
  misc_feature: Ceres CLONE 1399756-F
  misc_feature: Encodes the peptide sequence at SEQ ID NO. 26821
aaagctggagctccccgcggtggcggccgctctataactagtggatcccccgggctgcaggaattcgcacgagaccattacctagaacatcctaatcgaaaaaacactcccccgatctccgccactccaaaatgtggcgccgccaccacctcctccggctacttccacctccggccaccgccgccaccgccgcggccccttctcatttcctgcgccacctctctacctcaagcaccccgaccccggccgcctccctggcctcgtccctcgcgtcggcgctcaccgcgctctccacgaccccgccccccgccaccaccccggacgcttacttctccctccacttctccgacgtgcggcctaccaacgcgctcctcgctgaggcgctcgcgctctccccgcccgccacctcccgcgccgctgccgatctcttccgcttcctcgtccgccgccgctcgctccacccctccgacggcgcgctcgcgcccatcgttcgccacctcgcccgccgccgcgacttccccgccgtgcgcgcgctcatccaggagtttccaaccgctctcgggcccgccacgctcgacgcctatctccagcagctcaccagagccgggcgccaaacgacgcttggtcaaggtgttcgacgaattgccggagcagctccgtaaccgcgaggtcctcact

SEQ ID NO: 26821 - protein, 176 aa, Zea mays
  misc_feature: Ceres CLONE 1399756-F
MWRRHHLLRLLPPPATAATAAAPSHFLRHLSTSSTPTPAASLASSLASALTALSTTPPPATTPDAYFSLHFSDVRPTNALLAEALALSPPATSRAAADLFRFLVRRRSLHPSDGALAPIVRHLARRRDFPAVRALIQEFPTALGPATLDAYLQQLTRAGRQTTLGQGVRRIAGAAP

SEQ ID NO: 26822 - DNA, 626 bp, Zea mays
  misc_feature: Ceres CLONE 1399761-F
  misc_feature: Encodes the peptide sequence at SEQ ID NO. 26823
  misc_feature (420)..(420): n is a, c, t, g, unknown, or other
  misc_feature (550)..(550): n is a, c, t, g, unknown, or other
aaagctggagctccccgcggtggcggccgctctagaactagtggatcccccgggctgcaggaattcgcacgagaccattacctagaacatcctaatcgaaaaaaccccgaccgcccatgtccgccatcgcggcctcctcggccgccgccgccgcggcgtcgaactccgatgaggaagaaaactataaggagtacatcccagtcgccaagcgccgggccatggaggccgagcgcctccgccagctccgcctctccaagtcggcgccggcctctgccgtctcatcactcccgatgccacctcccccgcctcttttaccagcgcagacctccgttcccgacgccgccgcgaagcccagccttctcgtcaaggccacgcagcttaagcgcggcggccccggaggtgaccgccacgggagcagcngcatccagcaggagaaaggaagtgattggaaatctctcagaacacaatcgctcaggtcagtccgcgagatcgccagggcatcatctacccggaacgatccagaccggtgggagccgcccctccggctcgncggatggcggtctgcaaagcaacgagtccgggggcagggggcatccacggccaccgggaccaattaccgcgcctgc

SEQ ID NO: 26823 - protein, 170 aa, Zea mays
  misc_feature: Ceres CLONE 1399761-F
  misc_feature (102)..(102): Xaa is any aa, unknown, or other
  misc_feature (145)..(145): Xaa is any aa, unknown, or other
MSAIAASSAAAAAASNSDEEENYKEYIPVAKRRAMEAERLRQLRLSKSAPASAVSSLPMPPPPPLLPAQTSVPDAAAKPSLLVKATQLKRGGPGGDRHGSSXIQQEKGSDWKSLRTQSLRSVREIARASSTRNDPDRWEPPLRLXGWRSAKQRVRGQGASTATGTNYRAC

SEQ ID NO: 26824 - DNA, 582 bp, Zea mays
  misc_feature: Ceres CLONE 1399762-F
  misc_feature: Encodes the peptide sequence at SEQ ID NO. 26825
aagctggagctccccgcggtggcggccgctctagaactagtggatcccccgggctgcaggaattcgcacgagaccattacctagaacatcctaatcaaaaactcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcggggttaccatttacttctttaacccccgggggggactgggcccatccccgtattggttggggggggggcccaattggaaactccaccccaaaaatttggggcaagggggggggggggggcccctaaaacccccccccggggtgtcttttccggggggggccgcctcccccctccccgaaaaaaattggcgaaaacccagcccgggggccctttttt

SEQ ID NO: 26825 - protein, 124 aa, Zea mays
  misc_feature: Ceres CLONE 1399762-F
MAREEQALLSTEIVNRGVEPSGPDAGSPAFSVRVRRRLPDFLQSVNLKYVRLGVTIYFFNPRGGLGPSPYWLGGGPNWKLHPKNLGQGGGGGPLKPPPGVSFPGGAASPLPEKNWRKPSPGALF

SEQ ID NO: 26826 - DNA, 691 bp, Zea mays
  misc_feature: Ceres CLONE 1399764-F
  misc_feature: Pfam Name: EXTL2 Pfam Description: EXTL2, alpha-1,4-N-acetylhexosaminyltransferase
  misc_feature (461)..(461): n is a, c, t, g, unknown, or other
  misc_feature (691)..(691): n is a, c, t, g, unknown, or other
aaagctggagctccccgcggtggcggccgctctagaactagtggatcccccgggctgcaggaattcgcacgagaccattacctagaacatcctaatcgaaaaattcgcaccaccgccgcgacgcccaaagcctatccgcctccgccgacgccgccgtgatggtcgccgtctgccgcccgctcgtctccgtgaaggccctatagggagatgtgataaccgacgcccccggaatctggctatacacgaccgtcttcgggttgtctcatcccgccgcgacgtgatgaggcttagccatctagttgatgtcctgcaacgagtgccagccctatccagtctcccgccgagccggacaccagaggtgggacgagactgtgagaaccggacgcgtcgtgtctcgtatcacccgcgtccccggcggcggttaccaccgagccggtcattcctctgtctgaatcatggtnacgcggcgtattcaatatcctcaatcgtctcatcaatcttaggcgtctgcggaaaccctaccacacctgctcgggtacttgagcacttataccacaatctgacccggtactcgcttggcaccgcttccatctctcttatccagcaatcgtctagcaggctcaacgccaggttcctccctcgcccttcgtagacactcgtgctgttttgatatgcgatgatgacgtggagn

SEQ ID NO: 26827 - DNA, 685 bp, Zea mays
  misc_feature: Ceres CLONE 1399765-F
  misc_feature: Encodes the peptide sequence at SEQ ID NO. 26828
  misc_feature (566)..(566): n is a, c, t, g, unknown, or other
  misc_feature (567)..(567): n is a, c, t, g, unknown, or other
  misc_feature (597)..(597): n is a, c, t, g, unknown, or other
aaagctggagctccccgcggtggcggccgctctagaactagtggatcccccgggctgcaggaattcgcacgagaccattacctagaacatcctaatcgaaaactcgtgttcttgttcgtctccgcctcaggcaactccacacggtcacacctcgctcgctctcgctcccgtatcgcggtttccttttcgaagccttgctaggtttagctggggcctctgtctatcctgtcaatggccccttaggcggctgtacttcagacttcagaggtgacgtgaggcgtggggacgcgcgtagctgattggttcgaggaggcggggatggacccggacttctcgccggcgagtgggggcccgagctttgagttcgccttcaactcggtcaacttctctgaccgggtgttgcagatcgagatcgtcgctggggatgacgccctcggggccaagggcgcaccgggcgaggggtgctcatctcttgccgactgggcgtgccaccgcaagcgacgacgggaggagctccgacgcgacaaagaatctagaaaatacatgccagatccagcaaactgcannagttgaagctgaagaatgtgatgccctacnaggaaggcaatgagcctgtagctatgatagaagaatctccgcctgatattgaggcagaaaggggtgaaggatggaaaaagcagcgctc

SEQ ID NO: 26828 - protein, 84 aa, Zea mays
  misc_feature: Ceres CLONE 1399765-F
  misc_feature (83)..(83): Xaa is any aa, unknown, or other
MDPDFSPASGGPSFEFAFNSVNFSDRVLQIEIVAGDDALGAKGAPGEGCSSLADWACHRKRRREELRRDKESRKYMPDPANCXS

SEQ ID NO: 26829 - DNA, 678 bp, Zea mays
  misc_feature: Ceres CLONE 1399766-F
  misc_feature: Encodes the peptide sequence at SEQ ID NO. 26830
tggcggccgctctagaactagtggatcccccgggctgcaggaattcgcacgagaccattacctagaacatcctaatcgaaaaaagaagctttacagtgaacgagtgagtatgtgcggcatacttgctgtgctcgggtgcgccgacgaggccaagggcagcagcaagaggtcccgggtgctggagctgtcgcggcggctgaagcaccggggccccgactggagcggcctccggcaggtgggcgactgctacctctctcaccagcgcctcgccatcatcgacccggcctctggcgaccagcccctctacaacgaggaccagtcggtggtcgtcgccgtcaacggcgagatctacaaccacctggacctcaggagccgcctccgccggcgcaggccacagcttcaggaccggcagcggactgcgaggtcatcgcgcacctgtacgaggagcatgggagaaagagttcgtggacatgcctgggacggcgcttttctcctttcgtgctgctggacactcgccatgggggaccgcgcgggcagcagcttccttcatggctgctccgaaggcccatccggtgtgacgccccttactcgggatgggaaaatcccagggggccccggggggttttttcccccggaaaaagaaggccccggcccacgacagggggagcccccttccca

SEQ ID NO: 26830 - protein, 189 aa, Zea mays
  misc_feature: Ceres CLONE 1399766-F
  misc_feature (2)..(152): Pfam Name: GATase_2 Pfam Description: Glutamine amidotransferases class-II
  misc_feature: SWISSPROT Homolog: EC 6.3.5.4 Asparagine synthase (glutamine-hydrolyzing)
MCGILAVLGCADEAKGSSKRSRVLELSRRLKHRGPDWSGLRQVGDCYLSHQRLAIIDPASGDQPLYNEDQSVVVAVNGEIYNHLDLRSRLRRRRPQLQDRQRTARSSRTCTRSMGERVRGHAWDGAFLLSCCWTLAMGDRAGSSFLHGCSEGPSGVTPLTRDGKIPGGPGGFFPPEKEGPGPRQGEPPS

SEQ ID NO: 26831 - DNA, 751 bp, Zea mays
  misc_feature: Ceres CLONE 1399768-F
  misc_feature: Encodes the peptide sequence at SEQ ID NO. 26832
  misc_feature (621)..(621): n is a, c, t, g, unknown, or other
ggagctccccgcggtggcggccgctctagaactagtggatcccccgggctgcaggaattcgcacgagaccattacctagaacatcctaatcgaaaaattcagcgtgccgctcctcgactcctctccgcctccgcgcgacgggcgacagcgccagtcgtgaatcagcgccggcgagcccccatcctggccggcagactccctaggcggctgggccagctctccgcctccgcatccccagtctccgcgctgactgccccgccccatctcctgccacgccggcgccgcatcccctttcccctcaccgccgtctccagtcacgccggcacgtccccagcccccgcatcgtccgcttaccaggcaaggagcctggtcgctacacctacatgaggctcaacaaggtggaagtgaaccttataaggctgctggaggctgctccccggctgcgaaatcaggctaaactactctattatgtaaccacagcccgggagcttttggagcagctaggatctgagactactccagaagggatatcaagcatttcaaaagctaagctttctgagtattcagaacagattgaagcactagcttccaggcttgctgcttcactgcctgaatatgaanagccaattactgaaagcagagatgtaatctcttactacgaatcccagggagaaagtccgatatctttatcatcatgactaccaaggagatcgacagcccatgctgaggttggaccaagtcatcatgagac

SEQ ID NO: 26832 - protein, 104 aa, Zea mays
  misc_feature: Ceres CLONE 1399768-F
  misc_feature (80)..(80): Xaa is any aa, unknown, or other
MRLNKVEVNLIRLLEAAPRLRNQAKLLYYVTTARELLEQLGSETTPEGISSISKAKLSEYSEQIEALASRLAASLPEYEXPITESRDVISYYESQGESPISLSS

SEQ ID NO: 26833 - DNA, 688 bp, Zea mays
  misc_feature: Ceres CLONE 1399770-F
  misc_feature: Translation starting site: 267
  misc_feature (556)..(556): n is a, c, t, g, unknown, or other
aaagctggagctccccgcggtggcggccgctctagaactagtggatcccccgggctgcaggaattcgcacgagaccattacctagaacatcctaatcaaaaaaatgagctcgctctcctgctcctacaggctgcagttgcgctgtgcctgtgcttccagttccatcgctttcccctcctccccagtccccactcccagatgcgatttccctctccaccgccacagcgcctagcttagccagccagccggcggccatcgccgccgcaatggcgaccgcgtcggaggacgaggccgcctcggaccgctgcagcggcagctacagccccagcgccgacgtcagcgagtccgaaacctccagtgactgctccgcgcccaccacgcgccgcttcgcctcctcctcctcggcctccgccaccgtctcccgcctcgcgtcctcctcctcgtcgctccccaccccggcatcggccaccgccttctacctctccaagccaacccccgaccctctccgagatcgacatggatgaaggagcgcttcgcgaagctcctgctcggcgangacatggtcggcagcggggaagggcgtctgcaccgcgctcgccatctccaatgccatcaccaactctcccgccaccgtgtttcgcgaagcctgtggaggctggaccgctcggcccgcaaggaaaagcatggg

SEQ ID NO: 26834 - DNA, 726 bp, Zea mays
  misc_feature: Ceres CLONE 1399774-F
  misc_feature: Encodes the peptide sequence at SEQ ID NO. 26835
  misc_feature (479)..(479): n is a, c, t, g, unknown, or other
  misc_feature (693)..(693): n is a, c, t, g, unknown, or other
  misc_feature (697)..(697): n is a, c, t, g, unknown, or other
cgctcttaactagtggatcccccgggctgcaggaattcgcacgagaccattacctagaacatcctaatcgaaaaatattctcccaaaaaacccaacactccagtggcggcaaagacctaacatttcaaaatcaatggccaagaaccccaaggcgcccgacacccgcagtggccgttctcccaccagaaggccccgaccacgccgcgccaaggcggtgccagaagcctcctccgcagctgatatcgaagacctggctccctcagtgcctggggccgctgcccctggcgctgccgcacccacggccctgcgcgcacagctgctccggtggtatgacgcgcaccgtagggacctgccgtggcgatgcgtaagcggcagcgaggaagagagggcgtacgcggtgtgggtgtccgaggtgatgctgcagcagacgcgggtgcccgtggtcgtcgcttactacgagcggtggatggcgcggtggncgaccgtacgaagcctcgccgccgctacgcaggaggaggtgaacgagatgtgggcgggtcttggctactaccgtagggctcgatttctgctggagggagcaaagcagatcatcgaaaaggggttgtttccttgcacggcgttagcccttcgtgaggttcgtggcattggggattacacagctggagcaatcgctttcattgcctttcacgaggnccgncccaattgtggatggaaatgtgataccag

SEQ ID NO: 26835 - protein, 197 aa, Zea mays
  misc_feature: Ceres CLONE 1399774-F
  misc_feature (91)..(189): Pfam Name: HhH-GPD Pfam Description: HhH-GPD superfamily base excision DNA repair protein
  misc_feature (116)..(116): Xaa is any aa, unknown, or other
  misc_feature (187)..(187): Xaa is any aa, unknown, or other
MAKNPKAPDTRSGRSPTRRPRPRRAKAVPEASSAADIEDLAPSVPGAAAPGAAAPTALRAQLLRWYDAHRRDLPWRCVSGSEEERAYAVWVSEVMLQQTRVPVVVAYYERWMARWXTVRSLAAATQEEVNEMWAGLGYYRRARFLLEGAKQIIEKGLFPCTALALREVRGIGDYTAGAIAFIAFHEXRPNCGWKCDT

SEQ ID NO: 26836 - DNA, 752 bp, Zea mays
  misc_feature: Ceres CLONE 1399775-F
  misc_feature: Encodes the peptide sequence at SEQ ID NO. 26837
ggagctccccgcggtggcggccgctctagaactagtggatcccccgggctgcaggaattcacactagagcattacctaaaagatcctaatcgaaaaatattctccatgaaaacccaacactccagtggcggaaaagacctaaaatttcagaatgaatgttcaataaccccattgtgcccgacacccgcattggtcgttctcccaccagaaggtcccgacaacgcacgcgtcgaggcgatgacagaagactcctccgcagctgatatactaatacatgcctccctcagtgcctggggacgctgcccctggtgatgtcgcacccaactatctgcgcgctcagatgctccggaggtatgacgcttatcgtaaggacatgccttgctcgatgcgttcgctgaaacaagtaacataggacgtacgatccgtgagtgatcaaggtgattatgtacaagacgatgctgtccgagagacgatgtttactatctaatactgaatgctgcgtgtctctatcgaaccaagcatccctcctctactgatgactatgatgatcagatgtgcactgtgacttggctactacagataaccatcgattgctgctggagtcactagagcagacatccattagcttgtgcttccttgtaatgacactgacctttctgagcatcctggcattgcacagtacaccattgtagcaatgaaatcaataggcttcaacatctggaccgactagctgatgcaatgagatacgagat

SEQ ID NO: 26837 - protein, 45 aa, Zea mays
  misc_feature: Ceres CLONE 1399775-F
MPPSVPGDAAPGDVAPNYLRAQMLRRYDAYRKDMPCSMRSLKQVT

SEQ ID NO: 26838 - DNA, 704 bp, Zea mays
  misc_feature: Ceres CLONE 1399777-F
  misc_feature: Encodes the peptide sequence at SEQ ID NO. 26839
tccccgcggtggcggccgctctacaactagtggatcccccgggctgcaggaattcgcacgagaccattacctagaacatcctaatcgaaaaaacccccctttcccgccacaccatctcctcgccgcttcccgccacctctctcccatggcggcgccgtcggcggccacgcgcaggaaactgcagcgcaagttccgcctacgaggcttcaccctcaaggtggacgccctcgaggaggccgccgccttcctcgaccgcttccccgacgccgaggacgacgcgctcgatctcctcctcgacgagctcgacaaggaaccgctgcagtcgtcgatactggaccgggacgcggtcaggcgcgtggtggcgctgcttgtcgaggccgaggaggcgctcgatgtggcgtcgccagcggccacaagcgcaaggtctgcgctgcgggtggtggacgcgttcctcgtgccgcggttccactacgatccaatcaagaaagtattttacgagcacacaggcagattagctgtccatggagaagctggagataaagcttccctttatagggataggtatcaagtgctgctgcagagactgtctcgtgataaatatttctctaagccggcttttgacacagttgcgaccgaacactgtaattgcgagaaaacttcctggacaccccccaattgggggcccccggggggaaaaaattatt

SEQ ID NO: 26839 - protein, 186 aa, Zea mays
  misc_feature: Ceres CLONE 1399777-F
  misc_feature: SWISSPROT Homolog: EC 2.7.7.7 DNA-directed DNA polymerase
MAAPSAATRRKLQRKFRLRGFTLKVDALEEAAAFLDRFPDAEDDALDLLLDELDKEPLQSSILDRDAVRRVVALLVEAEEALDVASPAATSARSALRVVDAFLVPRFHYDPIKKVFYEHTGRLAVHGEAGDKASLYRDRYQVLLQRLSRDKYFSKPAFDTVATEHCNCEKTSWTPPNWGPPGGKNY

SEQ ID NO: 26840 - DNA, 693 bp, Zea mays
  misc_feature: Ceres CLONE 1399779-F
  misc_feature: Encodes the peptide sequence at SEQ ID NO. 26841
  misc_feature (308)..(308): n is a, c, t, g, unknown, or other
  misc_feature (393)..(393): n is a, c, t, g, unknown, or other
  misc_feature (407)..(407): n is a, c, t, g, unknown, or other
  misc_feature (423)..(423): n is a, c, t, g, unknown, or other
  misc_feature (446)..(446): n is a, c, t, g, unknown, or other
cgcggtggcggccgctctagaactagtggatcccccgggctgcaggaattcgcacgagaccattacctagaacatcctaatcgaaaaatccgactaaaaagggccagggccagggccttcgcttgcttactactcctgcttaccacactctaccttgtctcttcacgtgcacacgacgcctcccccaatggctgcggtggcggaggaggaggtgatcgtcgtcggcgcggggcagtcggggctagcggtggcggcgtgcctgtccctgcgcggcgtgcgggcgctggtcctggagcgcgacgactgcngtggggtcgctggtggcggaagcgcgcctacgaccgcctccacctccacctcaccaagaagtactgcgcgctgccgcacgcgccngcacccggccgagngcccccgcgtacctgncaccgcgacgaacttcgcgcggntacctgggacggtaacgcgccgcgccggtttcgcccgtccgcccgcgcctcccggcggggaggtccgtgtcgggcgcggtacgaccccgcgagcgcgctggtgggtaggtggaagttcgttggacctctgggacggggcagggtcgagcgtcaacgcggtgaagcattcctgcttggtcgcgttaggtttagaacgtcttataatgttatgtcttagcttacttcacattgaatcctccccccagaa

SEQ ID NO: 26841 - protein, 168 aa, Zea mays
  misc_feature: Ceres CLONE 1399779-F
  misc_feature (41)..(41): Xaa is any aa, unknown, or other
  misc_feature (69)..(69): Xaa is any aa, unknown, or other
  misc_feature (74)..(74): Xaa is any aa, unknown, or other
  misc_feature (79)..(79): Xaa is any aa, unknown, or other
  misc_feature (87)..(87): Xaa is any aa, unknown, or other
MAAVAEEEVIVVGAGQSGLAVAACLSLRGVRALVLERDDCXGVAGGGSAPTTASTSTSPRSTARCRTRXHPAEXPRVPXTATNFARXPGTVTRRAGFARPPAPPGGEVRVGRGTTPRARWWVGGSSLDLWDGAGSSVNAVKHSCLVALGLERLIMLCLSLLHIESSPQ

SEQ ID NO: 26842 - DNA, 750 bp, Zea mays
  misc_feature: Ceres CLONE 1399781-F
  misc_feature (710)..(710): n is a, c, t, g, unknown, or other
aagctggagctccccgcggtggcggccgctctagaactagtggatcccccgggctgcaggaattcgcacgagaccattacctagaacatcctaatcgaaaaaaaaccctcacagcgaaggacacaaaaacacaggtagggttaggcgacgcggcggcgagagcgcgagagtaggaggaggcgtcggccatgacggggaaggcgaagccgaataagcacacggcgaaggagatcgccgcgaagatcgacgcggcgacgacaaaccggggcggcggcaaggtcgggcaggcggatcggctagggcaggcacaagggcggacacgcgaagctggagtgcccgctctgccgcaccccggcgcccgacatcaagtccattcagatccaccacgaggcgcgccatcccaagctccctttcgagccggagaagctcgtcaacctgcactcctccacccccgccgtcgccgaggccaccacctctctagcccaagccctgggtccgcggcagcctcaagaagtagctggctggcttgcctgactgactgcctgggctaattcccttcgatttcgatcccatccgccgacgcgatctacaatcaatcaaagtaccgcccgccctccgagactgcggtggactgctagcctggtgctgcttcttattgttgtcatattgctgatacatgacacgcgcgatagatgtgcatctatctatcnagtctcgcctatcgcaacactggcatgcttcaacatgagt

SEQ ID NO: 26843 - DNA, 630 bp, Zea mays
  misc_feature: Ceres CLONE 1399783-F
  misc_feature: Encodes the peptide sequence at SEQ ID NO. 26844
  misc_feature (421)..(421): n is a, c, t, g, unknown, or other
  misc_feature (490)..(490): n is a, c, t, g, unknown, or other
  misc_feature (549)..(549): n is a, c, t, g, unknown, or other
  misc_feature (593)..(593): n is a, c, t, g, unknown, or other
aaagctggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatctctaattccccataccgtccaccggtcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagncagactggtgctgggaagcacgttccccgtgcaatcttcgttgatctagaacccactgtgatcgatgangtgcgcactggcacgtaccgccagctcttccaccctgagcagctcatcagtggcaaggnaggatgccgctaacaatttcggcccgtggccactaacccatggncaaggaggattgtgatctggggcttggaacgtatccg

SEQ ID NO: 26844 - protein, 100 aa, Zea mays
  misc_feature: Ceres CLONE 1399783-F
  misc_feature (54)..(54): Xaa is any aa, unknown, or other
  misc_feature (77)..(77): Xaa is any aa, unknown, or other
  misc_feature (97)..(97): Xaa is any aa, unknown, or other
MRECISVHIGQAGIQVGNACWELYCLEHGIQPDGQVPGDKTAGHHDDAFSTFFXQTGAGKHVPRAIFVDLEPTVIDXVRTGTYRQLFHPEQLISGKXGCR

SEQ ID NO: 26845 - DNA, 664 bp, Zea mays
  misc_feature: Ceres CLONE 1399784-F
  misc_feature: Encodes the peptide sequence at SEQ ID NO. 26846
  misc_feature (607)..(607): n is a, c, t, g, unknown, or other
  misc_feature (608)..(608): n is a, c, t, g, unknown, or other
aagctggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggccaagggcggtgagggggaatcggggaaggaggaggtgagggagtatgagagcgacatgaggaagctggaggagctgctttctaagctgaacccctcgggcggaggagtccgtgccgcagtcccgccgccgcgtgggacggcggcgctccccgcctttcggccgacgcgccccgtgttcgtgtcgcccggcgatcgactactacgcgcgccaccaccagctcccgccgccgcagcttctgcagcagcagcagccgatgcacgggcttgganntttgggggtgccgtccgggggggtttggaagggtgggggggccggggggaatggac

SEQ ID NO: 26846 - protein, 141 aa, Zea mays
  misc_feature: Ceres CLONE 1399784-F
  misc_feature (123)..(123): Xaa is any aa, unknown, or other
MVAVAVDGLIRGADAVPAAEREAVRAAAAEAAAKGGEGESGKEEVREYESDMRKLEELLSKLNPSGGGVRAAVPPPRGTAALPAFRPTRPVFVSPGDRLLRAPPPAPAAAASAAAAADARAWXFGGAVRGGLEGWGGRGEW

SEQ ID NO: 26847 - DNA, 566 bp, Zea mays
  misc_feature: Ceres CLONE 1399785-F
  misc_feature: Encodes the peptide sequence at SEQ ID NO. 26848
tggagctccccgcggtggcggccgctctagaactagtggatcccccgggctgcaggaattcgcacgagaccattacctagaacatcctaatcgaaaaactccacccacgcctccactacaccacacagagccgcagcagactcgcaagggaaaggagatggatcgtctgcccgagtcgacccggagcatgaggaagtacgcgtcggaggccggcgggcttcgcgcggcgcggcagggcccccacgggcggtcgctgacggcgcgcacgacgcacagcatgtccacgacggcgctgcgcaccaagtccaagtcggccgcgtcgctgctgcgcagggtgccctttcggggcggttcggcccggttctcgccaactgtagaggggtctccgaccaagtgccggtattcccgcggggcgttgccattgcgcccatgggggccttggccaggggggggggttacctttaacaaatggggctcttccccccgggggggggggggggttttctcccccaagaaaaatatccggaataaaacccccgccccccccggggggggggcccccctac

SEQ ID NO: 26848 - protein, 136 aa, Zea mays
  misc_feature: Ceres CLONE 1399785-F
MDRLPESTRSMRKYASEAGGLRAARQGPHGRSLTARTTHSMSTTALRTKSKSAASLLRRVPFRGGSARFSPTVEGSPTKCRYSRGALPLRPWGPWPGGGVTFNKWGSSPRGGGGVFSPKKNIRNKTPAPPGGGAPL

SEQ ID NO: 26849 - DNA, 714 bp, Zea mays
  misc_feature: Ceres CLONE 1399789-F
  misc_feature: Encodes the peptide sequence at SEQ ID NO. 26850
  misc_feature (375)..(375): n is a, c, t, g, unknown, or other
  misc_feature (376)..(376): n is a, c, t, g, unknown, or other
  misc_feature (472)..(472): n is a, c, t, g, unknown, or other
  misc_feature (523)..(523): n is a, c, t, g, unknown, or other
  misc_feature (532)..(532): n is a, c, t, g, unknown, or other
  misc_feature (547)..(547): n is a, c, t, g, unknown, or other
  misc_feature (558)..(558): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
acccgcggtggcggccgctctagaactagtggatcccccgggctgcaggaattcgcacgagaccattacctagaacatcctaatcgaaaaacatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgaacgccctccacgggtccgggtgcacgctcaatgttcnncgcgggccgtggccccgcccgcgcggactttcctgctgacgtgcgaccccggcggccgtccagcacctgcctggcgccaaaccacgggggctacgnacaggggccgagacttttgtgcggagatgttcgacctcctgggcgacgggnctgctgggntgcggagcccccccncccccgggggncgcgcccagcgggcacgtccgccgcccaccgtcttcggnnncccggggggggtcccggggcccctttcgtcctgtggcaccatgggcgcgccaaaaagggggcgggtttggcttcgtgcccgtttccctgggactgccgccggccgcgggaaatag

SEQ ID NO: 26850 - protein, 188 aa, Zea mays
  misc_feature: Ceres CLONE 1399789-F
  misc_feature (77)..(77): Xaa is any aa, unknown, or other
  misc_feature (109)..(109): Xaa is any aa, unknown, or other
  misc_feature (126)..(126): Xaa is any aa, unknown, or other
  misc_feature (129)..(129): Xaa is any aa, unknown, or other
  misc_feature (134)..(134): Xaa is any aa, unknown, or other
  misc_feature (151)..(151): Xaa is any aa, unknown, or other
MGALRSLAISYPEFLVAGLCFVSLSALRHAMRERRQRAPLSWPVVGMLPFVLANLGRLYDAITERPPRVRVHAQCSXRAVAPPARTFLLTCDPGGRPAPAWRQTTGATXRGRDFCAEMFDLLGDGXAGXRSPPXPGGRAQRARPPPTVFGXPGGVPGPLSSCGTMGAPKRGRVWLRARFPGTAAGRGK

SEQ ID NO: 26851 - DNA, 671 bp, Zea mays
  misc_feature: Ceres CLONE 1399795-F
  misc_feature: Encodes the peptide sequence at SEQ ID NO. 26852
ggagctccccgcggtggcggccgctctacaactagtggatcccccgggctgcaggaattcgcacgagaccattacctagaacatcctaatcgaaaaagtaccgcaccaccaccaagcaccgcaaccggagccggagccagaggagggcgagaggccgaggggagaggagcgaaggaggccgccgaccgaccgtgcgtccggccccgcggcggcgtcggcaggtcgtagacggcagacgaggagcagcagcagcacgaggcggccgggcccggcccacgccatgccggagaaggaggcgcaggccgccgcgttctgcggcgaggcggtgatcgccgagttcgagtccctcacgcgggacgccgccgccgtgcagcgcgacacgctgcgccggatcctggcagacaacgcctgcgccgagtacctccgctgccggggcctcgcgggccgcaccgacgccgccagcttcctcgcctgcgtgccgctcgccacgcacgccgacatcgagccctacattgcgcgtatcgccgacggcgacacgtcccccgtgctcaccgcctagcccatcacctccatctccctcagctccgggacgacgtatgtgaaccgcaagtacctgcccttcaaccaggtgttcgccaagttcatgatgcagatataccgcacttcctact

SEQ ID NO: 26852 - protein, 92 aa, Zea mays
  misc_feature: Ceres CLONE 1399795-F
MPEKEAQAAAFCGEAVIAEFESLTRDAAAVQRDTLRRILADNACAEYLRCRGLAGRTDAASFLACVPLATHADIEPYIARIADGDTSPVLTA

SEQ ID NO: 26853 - DNA, 612 bp, Zea mays
  misc_feature: Ceres CLONE 1399797-F
  misc_feature (184)..(184): n is a, c, t, g, unknown, or other
  misc_feature (185)..(185): n is a, c, t, g, unknown, or other
  misc_feature (208)..(208): n is a, c, t, g, unknown, or other
  misc_feature (282)..(282): n is a, c, t, g, unknown, or other
  misc_feature (324)..(324): n is a, c, t, g, unknown, or other
  misc_feature (334)..(334): n is a, c, t, g, unknown, or other
  misc_feature (345)..(345): n is a, c, t, g, unknown, or other
tggagctccccgcggtggcggccgctctagaactagtggatcccccgggctgcaggaattcgcacgagaccattacctagaacatcctaatcgaaaaactcgcaccacgccaccgctgctgcctgctcctcacagtcctccccgcgctcgcattgcgatttgcgacctagcgcgagggtaccgnnggggtggtgcgcgcgcgtgcttncgtgatccggaaagcgcgcgagatggacggggtgggaaggccgcgtgccgcgcccaaaaacgacgacttcacgncgcaccccgtcaaggacagttccctgggggtcttctactggnatcacagccntcccccgtggnctgaaagcgttccttcttgggttccacattaactggcctggtttgggacccctggggaactatccactgcacctgggccccaaattggggggaaaaaatgtggcccaaagcgggggggttttccaacattgtggtttctttgggaggattacaaccccccctgggaaaatttttttgggacagtgtggcccccccagattcccgggggcaaaaacccctttgttttggcccacaaattttaaaaaaacctggtgggggcgaaatttg

SEQ ID NO: 26854 - DNA, 682 bp, Zea mays
  misc_feature: Ceres CLONE 1399798-F
  misc_feature: Translation starting site: 155
  misc_feature (553)..(553): n is a, c, t, g, unknown, or other
aaagctggagctccccgcggtggcggccgctctagaactagtggatcccccgggctgcaggaattcgcacgagaccattacctagaacatcctaatcgaaaacctctcccccgttgcgcaacgcgctttcccccacttcacccgcctcggcgccatggctaagctcgcgctggcgctcctcctcctgctggccgtggcggcgtccgcgtcggccagcagcgggagccacctggatctcgacctgggcttcctctcctctggggaacgccggagggagtgccgcggcacggtggccgagtgcctcgccgaggagtcggatgaggagggccttgacctggctggatcccaccgccgcgcgctctacggcggcgggtacatcagctaacggcgcgctgcggcgggacaacgtgccctgctcccgccgcggcgccagctactacaactgcccgcccgggcggccaggccaacccctaccaaccgcggctgctcccgcatcaccccgctgccgcggctgaagcgggcgccggatccgcaaactgccgagggaaaaggncctggtccaggtcccggccctttcgccgaaaataatttctttccgcccttgttcgttcagccgctaccgccaccggccaccgctgtttactatagcacagaactaccgatttgaatggtgggaagggga

SEQ ID NO: 26855 - DNA, 679 bp, Zea mays
  misc_feature: Ceres CLONE 1399799-F
  misc_feature: Encodes the peptide sequence at SEQ ID NO. 26856
  misc_feature (299)..(299): n is a, c, t, g, unknown, or other
  misc_feature (464)..(464): n is a, c, t, g, unknown, or other
  misc_feature (465)..(465): n is a, c, t, g, unknown, or other
tacccgcggtggcggccgctctagaactagtggatcccccgggctgcaggaattcgcacgagaccattacctagaacatcctaatcgaaaaacgccacccagttgcttctctgtgtactctccaactcatcaccggctccatccttgtcctacactgacctcgtccccatcccgcaaccgcaagcaaccaccgatccagcccgttcggcctttcggcgaatggtgacgaaccaggacgcggaggcggcatcggcggcagccccggggccaggggcgacggtggacccgatgcgcctagncgtcgcggtggcggtcccagacggagtgggaccgcgcggtgccggagctggaggctgagccggagccgtccgagctcaacaccgtcaacagttcgggacccttctccgtcgtctctacggacaagttgtccgtgaaatacctcggcagccatcaccacggcacgnnacggtcggtgtcgtgcaggccgaccgccccgctcccacgcgccgggccgtgtacaaacttcgagatggccgtccaggaacgcggggatacaaggggcaacaattccatagggttcacgagcgagagcttcaagatgagggacaacccggggttgggagtcaaaacagttgtggatacctggggtgacgacggcacccctttccgggggtcctag

SEQ ID NO: 26856 - protein, 49 aa, Zea mays
  misc_feature: Ceres CLONE 1399799-F
MAVQERGDTRGNNSIGFTSESFKMRDNPGLGVKTVVDTWGDDGTPFRGS

SEQ ID NO: 26857 - DNA, 698 bp, Zea mays
  misc_feature: Ceres CLONE 1399801-F
  misc_feature: Encodes the peptide sequence at SEQ ID NO. 26858
aagctggagctccccgcggtggcggccgctctagtacagtggatcccccgggctgcaggaattcgcacgagaccattacctagaacatcctaatcgaaaaatctatcgcactcgtagtcgtagctcaagcatcagcgccaggagctctgggcagcgtgcgcacgtggggtacctagctcgctctgctagcctaccatggctgatcaccaccggggtgcgacgggaggtggcgggggctacggcgacctccagcgcgcgggcggcatgcacggcgaggcgcatcagcaccagaagcagggcgccatgatgacggcgctcaaggccgcgacggccgcgaccttcggcgggtcgatgctggtgctgtccgggctgatcctggccggcaccgtgatcgcgctcacggtggccacccccgagctggtgatcttcagcccggtgctggtgccggccgccatcgcgatggcgctcatggcggacgggttcggcacctccggaggacccggggaacctggtgcggcccctggtttcctggcaggacagtaaattggcctccccaccccccctccggggccgcccaaccaccctggcaccccccccccatgccccacccttttgcgtctcacagagttcccccgccgattcctccccgccttatattctccacttcctccaccccgttattttttttcccccgcgtt

SEQ ID NO: 26858 - protein, 115 aa, Zea mays
  misc_feature: Ceres CLONE 1399801-F
  misc_feature (36)..(116): Pfam Name: Oleosin Pfam Description: Oleosin
MADHHRGATGGGGGYGDLQRAGGMHGEAHQHQKQGAMMTALKAATAATFGGSMLVLSGLILAGTVIALTVATPELVIFSPVLVPAAIAMALMADGFGTSGGPGEPGAAPGFLAGQ

SEQ ID NO: 26859 - DNA, 663 bp, Zea mays
  misc_feature: Ceres CLONE 1399813-F
  misc_feature: Encodes the peptide sequence at SEQ ID NO. 26860
  misc_feature (559)..(559): n is a, c, t, g, unknown, or other
  misc_feature (560)..(560): n is a, c, t, g, unknown, or other
tccccgcggtggcggccgctctagaactagtggatcccccgggctgcaggaattcgcacgagaccattacctagaacatcctaatcgaaaaacacaatacgcacacttcgcaaagcgtcttcctccgaccccatcgcctctgtggcttcctggctgtctgactgcgtctgcctggtcgtacgcgagcgcgtgcgtcccttcaccgtcacgagcggcgcacaccgtcaccgccacgctccgtcgccttccagaaaatctaaaccccagcggagccggccacggccagtcagccctcacacggactccgacgcgctgcccgctcgcctgccaaacccccaccccctcgccggcgatgctgccgcgtcgctttagcaaccacccgggctcctcctcacccctcccgttcctcgtcgtctgcggcctgctcctcgctgcggccgtagcattttccccggccgctgccgccgaggccgctggccgcggcggcggcggcggcggcgctgggcacgagggccgcgcggggaagccggaggtcgaggcggaggcggaggcgcgcggnngatggggtggccgtggcggaggccggcggcgaggtgatggctcagggcaatgccacggaggccaaggagggcagcctcgccgacatgatcgaccgcgcgctgg

SEQ ID NO: 26860 - protein, 103 aa, Zea mays
  misc_feature: Ceres CLONE 1399813-F
  misc_feature (70)..(70): Xaa is any aa, unknown, or other
MLPRRFSNHPGSSSPLPFLVVCGLLLAAAVAFSPAAAAEAAGRGGGGGGAGHEGRAGKPEVEAEAEARGXWGGRGGGRRRGDGSGQCHGGQGGQPRRHDRPRA

SEQ ID NO: 26861 - DNA, 678 bp, Zea mays
  misc_feature: Ceres CLONE 1399814-F
  misc_feature: Translation starting site: 296
aaagctggagctccccgcggtggcggccgctctagaactagtggatcccccgggctgcaggaattcgcacgagaccattacctagaacatcctaatcgaaaaaaaaccgaaaaggaggacaaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgatctccggcgaggtgccggacgagccggtcgtgtcgaagaagtcggggctactcttcgagcggcggctcatcgagcgctacattgaggaccatggcaagtgtcccgccaccaaggaggacctcaccatggatgatatcgtgccggtcaagaccaacacgatcgtgaagcccaggcctttgcaggctgcaagcattccaggaactccttgggatttttcagaacgagtgggatgctctcatgctttctaattttgctttggagcagcagcttcacacagcaagacaagaacttagtcatgcactctaccagcatgacgctgcctggccgtggtatagccagattaaagaaaggaaagagaatgacgctagag

SEQ ID NO: 26862 - DNA, 614 bp, Zea mays
  misc_feature: Ceres CLONE 1399817-F
aaagctggagctccccgcggtggcggccgctttagaactagtggatcccccgggctgcaggaattcgcacgagaccattacctagaacatcctaatcgaaaaattcggatttccttccgccttccgacagcggctgtctcggcgacccaaccccagcctgaccccacctcccgccgccgccgccgccgccgccgcgccttcgtcgtcaggagaagggtcccggtggctgcgtctctctcccctgcccccctgctccacactcggttcacgcgtcggctcgctaccgcaggccctcgactcgtacgcccgtccccggcggcgatccggccggcaccgtaccctaggactccgacggacaggaatgatgagtcatgaacaacaaattgtccctcctagtaagggtctgtgaatgggttcccccatagaaactggaaaggagggcagtggaacgcaagtagaataatttggtgaggcatcctctggtggtttactaattcagggcatggaagccattcccaggaccgctaatctatgttctaacacaacttattgggcattccttgggggacgggcatgtgaataacggtccttaacccctgggaattttccaggga

SEQ ID NO: 26863 - DNA, 676 bp, Zea mays
  misc_feature: Ceres CLONE 1399818-F
  misc_feature: Encodes the peptide sequence at SEQ ID NO. 26864
agtggatcccccgggctgcaggaattcgcacgagaccattacctagaacatcctaatcgaaaaatgtgatgtgagcctggcagcctgctgcctgcccgcgtccccgggactagttcagttgcttcactgtggcggtggcctggccctgcgtgccgcgtgcgcgctgcagcagtgcggtagcgggcagatggccgactccacggccatgaccgtcgacttcctccgtgcgcggctgctctccgagcggtccgtctcccgcgccgccaaggagcgtgcggacgagctcgccaagagggtcgcggagctggaggagcaggtccgggcggtgacggcgcagaggcggcaggcggagtgggcgaccgccagggtgctcgcagttctggagtcccagggctttggcgaccatctctcggatggggccgacgactccgacggctctgaagccaggacgggcgagtaggaggacgtcaagagtcgcgtcgacacggacggtgccgcccgctgcaggttcgcatacaactcaccatcacctcgccccgggcccgacgctgagggatcttcccttgccgcgacacccactcccctcacccccgcggcggatcgtccggggctcaactgtcccctaggcgggaaactcacatgcgatgggtcagcgttagccctccttgtctcggcg

SEQ ID NO: 26864 - protein, 90 aa, Zea mays
  misc_feature: Ceres CLONE 1399818-F
MADSTAMTVDFLRARLLSERSVSRAAKERADELAKRVAELEEQVRAVTAQRRQAEWATARVLAVLESQGFGDHLSDGADDSDGSEARTGE

SEQ ID NO: 26865 - DNA, 666 bp, Zea mays
  misc_feature: Ceres CLONE 1399821-F
  misc_feature: Encodes the peptide sequence at SEQ ID NO. 26866
aagctggagctcctcgcggtggcggccgctctagcactagtggatcccccgggctgcaggaattcgcacgaaaccattacctagaacatcctaatcaaaatccaattctattttcgtgaaattaaatgacgtgcctagatgtttgggtgtgataaatcgagtctaaactctttgtcccttgcaggtgcagtttctactagcagcaatatcatggattctgaggtagtgcatgtggtagagtcgtcgtttgtagtgccgagcgagccgacaccgtcggaggggctctcgctctctccgctggacctcgttctgcccagcagaggccacaccccaacagtctacctgtacagccccagcgatgttgccgccgccgatggtttcttcgacgtggccaggctcaaggaggctatggccaagaccttggtggccttctaccccctcgctggccgcctcggcgtcaacaacgatggcagggtagagatcacctgcaccggcgagggcgcactctttgtggtcgctcatgctgacctcagtgttggtgacatcgaggacgacttcaggccgtcgccggagctgaggaggctgtttgttccatgcgttgagccagcatccatcatattggccatacaggtgactttcctcaagttcggaggtgtggtgctaggg

SEQ ID NO: 26866 - protein, 176 aa, Zea mays
  misc_feature: Ceres CLONE 1399821-F
  misc_feature: SWISSPROT Homolog: EC 2.3.1.144 Anthranilate N-benzoyltransferase
MFGCDKSSLNSLSLAGAVSTSSNIMDSEVVHVVESSFVVPSEPTPSEGLSLSPLDLVLPSRGHTPTVYLYSPSDVAAADGFFDVARLKEAMAKTLVAFYPLAGRLGVNNDGRVEITCTGEGALFVVAHADLSVGDIEDDFRPSPELRRLFVPCVEPASIILAIQVTFLKFGGVVLG

SEQ ID NO: 26867 - DNA, 648 bp, Zea mays
  misc_feature: Ceres CLONE 1399822-F
  misc_feature: Encodes the peptide sequence at SEQ ID NO. 26868
  misc_feature (559)..(559): n is a, c, t, g, unknown, or other
  misc_feature (615)..(615): n is a, c, t, g, unknown, or other
tccccgcggtggcggccgctctagaactagtggatcccccgggctgcaggaattcgcacgagaccattacctaaaacatcctaatcgaaaagttcctcatacatattttggttccaaatcgaataacccaatgccgccgtagccgtctgcctcctcgctttcctttcgtccgtacgccgccggctcgcaccgccgacagtcctcagtccagaactccagatcgaacctccctcttcccagatcgggtcctaggctacagcagccgccgcatccgtcaccttcacaccgcgtgcgtgctctctcttccccccttcccctgtccttgcgacgactgggtgggctaccgccgccttacgcaaggtgccgagagcttcgccgatatctgcgccggagaagagcgcccaccagatcaggcgctgagaaggcgcgctggccggtggatgacgatggcgggtggcgggggactgaaccggtcttcatcgagggggcagctgccgccgcaagagctgcttgacgatctctgcagccggttcccttctgaatgtgcccaaggagggancctgggagtcgttcgaaagcggatcctggtccttgctggaggagggcgcaactggnttctatgaaggaacaaattcccgttggaccaca

SEQ ID NO: 26868 - protein, 60 aa, Zea mays
  misc_feature: Ceres CLONE 1399822-F
  misc_feature (40)..(40): Xaa is any aa, unknown, or other
  misc_feature (59)..(59): Xaa is any aa, unknown, or other
MTMAGGGGLNRSSSRGQLPPQELLDDLCSRFPSECAQGGXLGVVRKRILVLAGGGRNWXL

SEQ ID NO: 26869 - DNA, 659 bp, Zea mays
  misc_feature: Ceres CLONE 1399824-F
  misc_feature: Encodes the peptide sequence at SEQ ID NO. 26870
  misc_feature (426)..(426): n is a, c, t, g, unknown, or other
  misc_feature (531)..(531): n is a, c, t, g, unknown, or other
  misc_feature (552)..(552): n is a, c, t, g, unknown, or other
  misc_feature (640)..(640): n is a, c, t, g, unknown, or other
cgcggtggcggccgctctagaactagtggatcccccgggctgcaggaattcgcacgagaccattacctagaacatcctaatcgaaaaacacgcccagtctcctcaatcctcacatcctattggccacggcaactgccatcgccatggccgggaggcgtccggcaccggcggccctcctcctcctcgccgtagccttcgctcccatctcctccgccgttcgcccagtctccgatgcgcacagatccgctgccgaggagctcttcgctccctccgccgacggttccttcggcgatttggagagtacgtatgaggcagtgaaaacgttccagatactcgggctggagaaatataatagtttatctgggaaggcgtgcaagtttgccgcggagaacctggcttccaccgattccaccgcgaaagatctgnttccacgcagtccggatcagtggcgcgctgggatgtggcgttgatgccgggtgtatagaaagggtggttgtggcgagactcaaggcagtgattaaggataccganttccctgttggaatctacatnctggtggggggaggtttgcttagcatcaaggaaaaggcccataaaagggtggtcctggctggaggcagaaaggaacatttcaaggccnattaaggcacttagccaag

SEQ ID NO: 26870 - protein, 108 aa, Zea mays
  misc_feature: Ceres CLONE 1399824-F
  misc_feature (95)..(95): Xaa is any aa, unknown, or other
MAGRRPAPAALLLLAVAFAPISSAVRPVSDAHRSAAEELFAPSADGSFGDLESTYEAVKTFQILGLEKYNSLSGKACKFAAENLASTDSTAKDLXPRSPDQWRAGMWR

SEQ ID NO: 26871 - DNA, 701 bp, Zea mays
  misc_feature: Ceres CLONE 1399826-F
  misc_feature: Encodes the peptide sequence at SEQ ID NO. 26872
  misc_feature (626)..(626): n is a, c, t, g, unknown, or other
aaagctggagctccccgcggtggcggccgctctagaactagtggatcccccgggctgcaggaattcgcacgagaccattacctagaacatcctaatcgaaaactttcgtcaactccacttctcttctccgcgtcacctcctcttcgccgccgccgacgcttcaccgggcagccagccatggatgaggagtacgacgtgatcgtactaggcacggggctcaaggagtgcatcctcagcggtctcctctctgtggacggcctcaaggttttgcatatggacagaaatgactactatggaggagattccacctcgctcaaccttaatcagctctggaagaggtttagaggggaagacaagcccccagcacatctaggtgcaagcagagactacaatgtggacatggtgccaaagtttatgatggcaaatgggacattggttcgaaccctcatccacaccgacgtgacaaagtacttgtcattcaaagctgttgatgggagctatgttttcagtaaagggaagatttacaaggtccctgccactgatatggaaggctctgaagtcccctttgatgggcctattcgagaagcgcagagcaaggaacttcttcatttatgtccaagattacnatgaagctgatccaaggacacatcaaggattggacctttactagggtgacaactagagaattatagcaaaattat

SEQ ID NO: 26872 - protein, 149 aa, Zea mays
  misc_feature: Ceres CLONE 1399826-F
  misc_feature (1)..(150): Pfam Name: GDI Pfam Description: GDP dissociation inhibitor
MDEEYDVIVLGTGLKECILSGLLSVDGLKVLHMDRNDYYGGDSTSLNLNQLWKRFRGEDKPPAHLGASRDYNVDMVPKFMMANGTLVRTLIHTDVTKYLSFKAVDGSYVFSKGKIYKVPATDMEGSEVPFDGPIREAQSKELLHLCPRL

SEQ ID NO: 26873 - DNA, 706 bp, Zea mays
  misc_feature: Ceres CLONE 1399830-F
  misc_feature: Translation starting site: 370
  misc_feature (571)..(571): n is a, c, t, g, unknown, or other
  misc_feature (636)..(636): n is a, c, t, g, unknown, or other
  misc_feature (658)..(658): n is a, c, t, g, unknown, or other
  misc_feature (659)..(659): n is a, c, t, g, unknown, or other
aaaactggagctccccgcggtggcggccgctctagaactagtggatcccccgggctgcaggaattcgcacgagaccatttacctagaacatcctaatcgaaaaccaattccccgcttttctcggttctctcaccgcgaacccttaaccctagtccaccccgcttccatggacgaagatgctggcggcgcctccgccgccgccggtgccacttggcttcacgtgctcttttcttcagcaacccaccaccgctgctctttttgcattcgggacattggcggcgtcccccaccagcttcgcgcttccgtgacggagacggtgaacggcttcccaccgctttcgtgatccagggcttctcgcttgccaagggcatgggcgtggggaagcacattcgccagcgagaacctttttccgtgggcggataccagtgggcggtcttacttcttccccgacgggaagaaccccgaagacaacttcctcttagtcttcctctttattcccctcgcttccatgggcacccgacgtgcgtgccctttttcagcttacgcttccttgatcagagcggcaagggcnaagcacaaggtccacttcccacttttaccgcttccatttggagtccgggccgtacaccctcaagntaccgcggattccctatggtgnngttacaaaacgatttcttttcggcgaacttgccctttgaattattct

SEQ ID NO: 26874 - DNA, 692 bp, Zea mays
  misc_feature: Ceres CLONE 1399831-F
  misc_feature: Translation starting site: 146
  misc_feature (544)..(544): n is a, c, t, g, unknown, or other
aaagctggagctccccgcggtggcggccgctctacaatagtggatcccccgggctgcaggaattcgcacgagaccattacctagaacatcctaatcgaaaaattcgcaccaccgccgcgccgcccaaatcacagccaccgccgccatggccgcctccagccgccctctcgtctccgtgaaggccctggagggcgacatggtcacggacgcccccggcatcgccttgccgcccgtcttcggtgcgccgatccgcccggacgtggtccgcttcacccacaagctgctgtcctgcaacaagcgccagccttacgcagtctcccgccgcgctggccaccagacgtcggccgagtcctggggtacgggccgcgctgtgtcccgtatcccccgcgtccccggcggcggcacccaccgcgccggccagggagcattcggcaacatgtggccgcggcggacgcatgttcgcgcccaccaagatctggcgcaagtggcaccgccgcgtcaacgtcaacctccgccccgcgtcgccgtcgcctcggcgctcgcngccaccgccgtcccggccctcgtccaggcgcgcggccaccgcatcgagaccgtcccagagatgcccctggtcatctctgaactcggcggagtccatcgagaagacctcccaggcgctcaaaatcctcaagcaggtcggcgcctacacc

SEQ ID NO: 26875 - DNA, 692 bp, Zea mays
  misc_feature: Ceres CLONE 1399833-F
  misc_feature: Translation starting site: 245
  misc_feature (356)..(356): n is a, c, t, g, unknown, or other
  misc_feature (513)..(513): n is a, c, t, g, unknown, or other
  misc_feature (514)..(514): n is a, c, t, g, unknown, or other
  misc_feature (535)..(535): n is a, c, t, g, unknown, or other
  misc_feature (543)..(543): n is a, c, t, g, unknown, or other
  misc_feature (586)..(586): n is a, c, t, g, unknown, or other
  misc_feature (602)..(602): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (620)..(620): n is a, c, t, g, unknown, or other
  misc_feature (621)..(621): n is a, c, t, g, unknown, or other
  misc_feature (630)..(630): n is a, c, t, g, unknown, or other
  misc_feature (631)..(631): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (692)..(692): n is a, c, t, g, unknown, or other
cgcggtggcggccgctctagaactagtggatcccccgggctgcaggaattcgcacgagaccattacctagaacatcctaatcgaaaagacaaccccagcgcacgaactccaaaatagcgagccgaagggggccacgagtcctccacctccctctccgccgcgtcgctcgcgcttgacgcgcgccgagagccgaatcggagccacgaggcagccgccccgggcggatcgatcctagggccagggcatgggcggaggggacgccgacgccggcggcgagcccgcggacgcgcaggccacgctccacatccggtgcaccaacgcctccaagttcaccgtgcgggccgacctgggcgccnaccgtcggggcgtttaaaggcgatcgtcgccgacagctgcgacgtgccggcgccgcagcagcggtggatctacaaggggccggaatccttgaaggacgagcaaaccctagccaggctacgggtggtggagacagaccataaatcccattggggaacnngggggtggctggtgccatcanccaacatnctactggcacctgggcagccaaccaagaacctaccactgtggnctcctgccgtccgggnaaannnaaannnnnnngnnggggggttnntgnnnnaaaaatggtggggaactacaggcgtgtgtaacagagaaaggggaggaattttttn

SEQ ID NO: 26876 - DNA, 657 bp, Zea mays
  misc_feature: Ceres CLONE 1399839-F
  misc_feature: Encodes the peptide sequence at SEQ ID NO. 26877
cgctcatgaactagtggatcccccgggctgcaggaattcgcacgagaccattacctagaacatcctaatcgaaaaaagtccggagcaagagcaaccaaccaaccacctcctcccctctccgtctcccagtccggcctcgctcgccactcggagtctcggagtcaaccgccagcgcctcgatccggcgaagccagcccagcccatggcctccggcgccgtaccaccgcagagggtcgccctgctggcgctcgccgccgccctctccgtcgtctcattcccgcacctgtccctcctcgcctcgtcccatccgctcccgcaggaagctgctgctgctgctgcgggtgcggcggtggcaggcgaggcgtccgagcctcacggtaccgccgccgatggtgccgccgtggcgcgccgcgcgtgcacgtacacggtgcagatcaagacgagctgcgcgtccccgcggagctccgcggacgcggtgagcctcgcgctcggggacgcgtatcgcaacgaggtgtacgcggcgacggtgacgccgcagggcggtgattgagggctgcgccacggaaccgttccgggttgccggggcctgtggctacggggtctgctacctctacctgcgccggacgggtagcgaggccgaacggacgcccgagtggc

SEQ ID NO: 26877 - protein, 115 aa, Zea mays
  misc_feature: Ceres CLONE 1399839-F
  misc_feature (53)..(112): Pfam Name: ATS3 Pfam Description: Embryo-specific protein 3, (ATS3)
MASGAVPPQRVALLALAAALSVVSFPHLSLLASSHPLPQEAAAAAAGAAVAGEASEPHGTAADGAAVARRACTYTVQIKTSCASPRSSADAVSLALGDAYRNEVYAATVTPQGGD

SEQ ID NO: 26878 - DNA, 660 bp, Zea mays
  misc_feature: Ceres CLONE 1399842-F
  misc_feature: Encodes the peptide sequence at SEQ ID NO. 26879
cgcggtggcggccgctctataactagtggatcccccgggctgcaggaattcgcacgagaccattacctagaacatcctaatcgaaaaacctaccgctgacttgtcaattcctgtctgtgcgcgcgcgcgcgcgtggcgccggccgagcggccgttgacccgatgaccggcgcggcggccgtcgatcccccggcgcctcggccgcggcggctgacggtcctcccgctcatcgcgctcatcttctacgacgtctcgggaggccccttcggcatcgaggactcggtccgcacgggcggcggcgcgctgctcccgatcctcggcttcatcgtcctcccagtcctctggtcgctcccggaggcgctggtcacggccgagctcgcatcggctttccccaccaaggccgggtacgtgggcctgggtgtccgccgccttcggccccggccgtggcgttccctcgtcgggttctccaagttgcgcgtcggggacgctcgacaacgcgctctacccggtgctgttcctcgactacctccgctccggcgcgggtctggagctgcctgcgccgcaccgttcgctggtgttcctcgtgctctcgcatgcgctccaccactccactagcgcggcctccccctccccgccctctccccgctgttgttcccccctg

SEQ ID NO: 26879 - protein, 150 aa, Zea mays
  misc_feature: Ceres CLONE 1399842-F
MTGAAAVDPPAPRPRRLTVLPLIALIFYDVSGGPFGIEDSVRTGGGALLPILGFIVLPVLWSLPEALVTAELASAFPTKAGYVGLGVRRLRPRPWRSLVGFSKLRVGDARQRALPGAVPRLPPLRRGSGAACAAPFAGVPRALACAPPLH

SEQ ID NO: 26880 - DNA, 667 bp, Zea mays
  misc_feature: Ceres CLONE 1399848-F
  misc_feature: Encodes the peptide sequence at SEQ ID NO. 26881
caaagctggagctcaccgcggtggcggccgctctagaactagtggatcccccgggctgcaggaattcgcacgagaccattacctagaacatcctaatccaaaagaaataaaggactatctcagcgatttccgaaccctccccacccccacacccacccgatccaaccgagtcccggcggcgatggcggcggcggcgacgaacgccgatgtggaggtggtcgacttcgacctcgatgacgacgacctcatggacgaggacgccgggccggatccagcaccgccccccgcctcccgcctccgctccaccatcgcgggcgacgacgcgccgcgtaggaccaagggccgcggcttccgcgaggaccctaactcctccgcgacccgcgactcgcgctttggcgcggggggacgcgccgacctcgactcgcttggcggccctggacccatccagtgtacgtctacccttctctttcaatttttttctcaaagatttgcttgaaccgattattattttcttttggcaacgtagtactgaggctgaggcaagtaatacttcgttttgggtgactgaatgcctatgtagttagtatttgtgctgcctagacatattgccttctctgtgtgatttgcggatatggggtattccaacaactgaacaacctaaagattt

SEQ ID NO: 26881 - protein, 104 aa, Zea mays
  misc_feature: Ceres CLONE 1399848-F
MAAAATNADVEVVDFDLDDDDLMDEDAGPDPAPPPASRLRSTIAGDDAPRRTKGRGFREDPNSSATRDSRFGAGGRADLDSLGGPGPIQCTSTLLFQFFSQRFA

SEQ ID NO: 26882 - DNA, 701 bp, Zea mays
  misc_feature: Ceres CLONE 1399852-F
  misc_feature: Encodes the peptide sequence at SEQ ID NO. 26883
ggagctccccgcggtggcggccgctcttcactagtggatcccccgggctgcaggaattcgcacgagaccattacctagaacatcctaatcgaaaaacatagtcgaagggtacgagaactcgccggcactcagcagaaaattcccaaggcgtcccttttccccatctcttttgtgacccatttgatcgattcctgatggagcccaaggccgagaagaagcccgcggataacaagtcgacgtaggagaaggccgagaacaagccaaggtgcggataatcgcgagccgagcaaggaaggcgccgacaacaagggaaagaagaacgtcacaagaacgtcgagaggtaccagatctacgtctttaaggtgctcaagcaggtgcaaccggatattggcatctcgcgcaaggccatgcacatcatgaactccttcgtcaacgacatcttcaagaagctcgcccgcgaggccgccaagttcggccgctacaacaagaagcccagcatcacctccccgggagatccagaactctggatcgtctcgatccccccgggggagttcccccaggaccccgaatccccaagggaactagggtggttcaccaaggttacgtcctccttaagggaggccggggacacctgagccccgcctcggcgtcatgctctcatatacaccctctgcgccaagcatgtcccaacaactaaagaa

SEQ ID NO: 26883 - protein, 75 aa, Zea mays
  misc_feature: Ceres CLONE 1399852-F
MHIMNSFVNDIFKKLAREAAKFGRYNKKPSITSPGDPELWIVSIPPGEFPQDPESPRELGWFTKVTSSLREAGDT

SEQ ID NO: 26884 - DNA, 816 bp, Zea mays
  misc_feature: Ceres CLONE 1399852-R
  misc_feature (366)..(366): n is a, c, t, g, unknown, or other
ccgattgggtaccgggccccccctcgaggtcgacggtatcgataagcttttttttttttttttttcctcgcaagatttttatcttataaaacttcaacaggggtaactgatgcattcctctattctcacaaattctacattgttgcacgatccacctatcacacgcctaagtatgagaattaaacttgatcgtcgcaacgtgcggcggcaccctaagaggatgtataactgtggtaaccgccttggtcccttcagatacagcgtgcttggcgagctctcctgggacgactaagctaacctaggtccggatctaccgggcaggggatagtgggcttcttgttctaacgggcgaccttggctgcctcnggggactagcttcccgaagatagcatgtgatgaaagagttcatgatggacatggcctcggacaatatgccgatgttccgggcgcacctgcttgatcaccccacagatgtagatcttaggcgcctctacgctcttaccctgcttcttatattacttcttagtgccaccccccttggtgggcaagcgcttctccgcccttggcttcttatcggccttgtcctccttaggttctctctcggagggcctcttctatgccttgagcggccttcgaatcgaccacatgggtggcaaaagagatggagtaacgagctgcttcggaattcctatgtagtcgcggcaatttgtcgctcccactcactatatcctgacatgtagtacctgctacagtagagtctcattgcagtcctgcagcccacgaggatcggctagttatacaacagtccaaaaaccg

SEQ ID NO: 26885 - DNA, 707 bp, Zea mays
  misc_feature: Ceres CLONE 1399854-F
  misc_feature: Encodes the peptide sequence at SEQ ID NO. 26886
  misc_feature (432)..(432): n is a, c, t, g, unknown, or other
aagctggagctccccgcggtggcggccgctcttcactagtggatcccccgggctgcaggaattcgcacgagaccattacctagaacatcctaatcgaaaaatccaggcagcacagctccctccccactcgaggctccgagctttattttttcttgttttgttttgttttcttggtaggagtaacaatagtttctggcagccttcttcctcctcgctctctacccgaggagagaggagaggagagaaatccggaggcaaagcttcagggtttgtataaagggattctagatctaatcgactaaccagagagaaaaaaaaacaaaaaataacgcgagaaagcatgagccacttcgccgccgccgccgtgaagagccccctcgccgtggccgcgcccgccgccggcgacgccaagagcccgctcttctgccccangccgcggcgccccgcggcgcccctggcgtgccaccaggggcgcgacgccggaatggatctgctcgacctcctcctggtcaaagaaaggtgtttagggggaatgacagtgaccccctgacccgctatatctggggaaaaaagaaggaaccgacacctagggggcgcttaaggggcccccgcttcggccatataaatggttggaggggcgccctctaaccctccctccccccattccaattcattggttaaggggctaacgggggccctctaccccc

SEQ ID NO: 26886 - protein, 69 aa, Zea mays
  misc_feature: Ceres CLONE 1399854-F
  misc_feature (31)..(31): Xaa is any aa, unknown, or other
MSHFAAAAVKSPLAVAAPAAGDAKSPLFCPXPRRPAAPLACHQGRDAGMDLLDLLLVKERCLGGMTVTP

SEQ ID NO: 26887 - DNA, 737 bp, Zea mays
  misc_feature: Ceres CLONE 1399855-F
  misc_feature (335)..(335): n is a, c, t, g, unknown, or other
  misc_feature (409)..(409): n is a, c, t, g, unknown, or other
  misc_feature (426)..(426): n is a, c, t, g, unknown, or other
  misc_feature (428)..(428): n is a, c, t, g, unknown, or other
  misc_feature (429)..(429): n is a, c, t, g, unknown, or other
  misc_feature (452)..(452): n is a, c, t, g, unknown, or other
  misc_feature (487)..(487): n is a, c, t, g, unknown, or other
  misc_feature (488)..(488): n is a, c, t, g, unknown, or other
  misc_feature (544)..(544): n is a, c, t, g, unknown, or other
gctctataactagtggatcccccgggctgcaggaattcgcacgagaccattacctagaacatcctaatcgaaaactgctagtgctcagtcctcgccctctcgctttccgagggagcctttgcctttcccctccgcccgccagccattaatggcggcggcatctccatccactcccccctcgcccccctcccactgctgctacttctagaagcgctggtggcagggcaggcggtatcccggccgctggcgctggcgcgagagttggttggtggtggtgttcagcccccctccctcttcaggtttagggtggagcgatccgtgcaggccaacgcggngtgcgtgacccagaaagggaaaccgccgcctttttttctcttctgccgccccgcttttccaaatccctctcaanctcatccgcccccgccngnnacatcaacaaaaaaggtccccgnctttcttcttccctctctcctctgcccctgcttgnncgttgctcgtgcctcccccaccccccttctgattcagccaggggtcccttcggcgnggcggggcgtcgccatgggcaactgctggggggcaagataaagtccaaaagccccctccgggggggcctctcccccgtagggaaggggttcaaatttgcaaacaagaaacgggggggggcaaccccttgagggggggaaaaaaccaagcgttttccggtccatggtggcaaaccccccgaaggagaggcaaac

SEQ ID NO: 26888 - DNA, 666 bp, Zea mays
  misc_feature: Ceres CLONE 1399856-F
  misc_feature: Encodes the peptide sequence at SEQ ID NO. 26889
  misc_feature (541)..(541): n is a, c, t, g, unknown, or other
tccccgcggtggcggccgctctagaactagtggatcccccgggctgcaggaattcgcacgagaccattacctagaacatcctaatcgaaaaccggaatggtatcgtgcgacctgtagtcgtcgccagccacctcgctccctcctagacgacacccagctagtgctcccttccacacccaggaaccagccacctaaccccgcccgccatgccgggcctcgccgcctccgacaactcgcccccggcgccggcgccgccgccgcgccggctctcgtcgccgctaccccggcgggcgccgtcgaccccgtcgccggccgcctcctcgcgcgccaagcctcggaaggcctcggcctctcgcgcgggcttcgccgccgaagccgacgactcgctcgacagcccggagcagggggccttccacgtcagcaggcgggagacgccatggtgtcgaccgagggcggtggcgccgcgcgcgcactcgagtgcgccgagcgcgccgccgtggcgctcgagggaatccggagaggcatgacaggtcgaactcgncctgagcctcgccgtcgccgtcgccatccactgcgggcgcgggcgcgacgccgacggcagcccctccatcgagtgccgcgaggtaattcatacgcggccgctggtagtggccgcagaggctgagg

SEQ ID NO: 26889 - protein, 106 aa, Zea mays
  misc_feature: Ceres CLONE 1399856-F
MPGLAASDNSPPAPAPPPRRLSSPLPRRAPSTPSPAASSRAKPRKASASRAGFAAEADDSLDSPEQGAFHVSRRETPWCRPRAVAPRAHSSAPSAPPWRSRESGEA

SEQ ID NO: 26890 - DNA, 683 bp, Zea mays
  misc_feature: Ceres CLONE 1399858-F
  misc_feature: Encodes the peptide sequence at SEQ ID NO. 26891
  misc_feature (429)..(429): n is a, c, t, g, unknown, or other
  misc_feature (630)..(630): n is a, c, t, g, unknown, or other
  misc_feature (642)..(642): n is a, c, t, g, unknown, or other
caaagctggagctccccgcggtggcggccgctctagaactagtggatcccccgggctgcaggaattcgcacgagaccattacctagaacatcctaatcgaaaaaaccgcgccgctctctctctctttctctctcgcacgagccgcgccggcgccgccaccacgcgcgcgggagacagagaccacagccgcagccaccgacgggcggaataggattgggtggcgccggggggaggagcaggaggaggtccgttgcggtggccggcggcggaggagcttgacactgtacggaagaaggtggtggagattagtggaagggatgaacaagaggttatggttgctgcttgcccctacagaatttgccctttgggggctcatattgatcatcagggtggagtagtcacagctatgaccataaattatggagtacntccttggtttcgttccctctaatggttctgaggttttacttcattctggtcagtttgaaggtgctataagattcagagttgatgacttgcaaaagcctattgataaacctgagaactaaaactggggaagttatgcaaaaggtgctggttagtgcactgcagaataggtggatatgatctaaaggaagggtatcataggantatatttctggntgtgaaagggctttgatagtttccaggctcagtctttttgg

SEQ ID NO: 26891 - protein, 42 aa, Zea mays
  misc_feature: Ceres CLONE 1399858-F
  misc_feature (4)..(4): Xaa is any aa, unknown, or other
MEYXLGFVPSNGSEVLLHSGQFEGAIRFRVDDLQKPIDKPEN

SEQ ID NO: 26892 - DNA, 640 bp, Zea mays
  misc_feature: Ceres CLONE 1399863-F
  misc_feature: Encodes the peptide sequence at SEQ ID NO. 26893
  misc_feature (538)..(538): n is a, c, t, g, unknown, or other
  misc_feature (555)..(555): n is a, c, t, g, unknown, or other
tccccgcggtggcggccgctctagaactagtggatcccccgggctgcaggaattcgcacgagaccattacctagaacatcctaatcgaaaactcccttttagcttttagctcgccccttgcgttcgcggaaaaagctcatcttttcaggtggaaggagcgattcgtctgtgcctgcgcctgcgcctgcgcctcgccgggctcgtgccgctgtaccctccttctccaggagacctgtactgtgaaggggcgctcccgcgccaaacgggaagcaaagctcgctcgcgcccttttttcggatcatataacgccgcgcctagctcaaacaccacagctcgctgcctagatctacgcggcagcggcgtcggcagaggagagggacccggagctgcgccatggggcctaccgccggctccggcgaggacaaggctatgttagagctccggaaaaaacatcgtgtggacctggagagactaacaattacatcacgaccgttcaagacattgtcattctttgtgttagccatcgctcagaatttgnaaagacatgttcatctngtctgaaaaaagttacccagtaaaaaccgcatgcttttggggtgtgctacttgggttctctcatgttcactgatggcctgaatga

SEQ ID NO: 26893 - protein, 55 aa, Zea mays
  misc_feature: Ceres CLONE 1399863-F
  misc_feature (49)..(49): Xaa is any aa, unknown, or other
MGPTAGSGEDKAMLELRKKHRVDLERLTITSRPFKTLSFFVLAIAQNLXRHVHLV

SEQ ID NO: 26894 - DNA, 594 bp, Zea mays
  misc_feature: Ceres CLONE 1399866-F
  misc_feature: Encodes the peptide sequence at SEQ ID NO. 26895
  misc_feature (292)..(292): n is a, c, t, g, unknown, or other
gctctacaactagtggatcccccgggctgcaggtattcgcacgagaccattacctagaacatcctaatcgaaaaatccatcgagctgcccgcgcgcggcagttaagctcacacatcagctagctcaccttggacggccgaccaggtacgttgcgagcgatggcgggatacaaagcgtcgggcggcacggcgctcggcgtcgtcctggctgttgccgcgctcctcgccgcggcggcgatggcggtggacgacgagcacatgtaccactggaagtgcttcaactcgtgcacggngaagtgccgcgacgagggacgcctttgacgacggccaccgttttctggggattccgaaacgcgccctttcccggggggtttttgggggggggaaggggggaaaaaaacggggggccccccaaaaggggttttttgaagcatttgcgggggcctttttgttttaccccccaggggggggtttcaaaaaaaagagggggtttttttttttcccccccccccttttttataaaaaaaaaaaaaaaaaaaaaagtgggtggttggaaaaaaaaaagattttttttttcctcaaacacaaaaattct

SEQ ID NO: 26895 - protein, 53 aa, Zea mays
  misc_feature: Ceres CLONE 1399866-F
  misc_feature (45)..(45): Xaa is any aa, unknown, or other
MAGYKASGGTALGVVLAVAALLAAAAMAVDDEHMYHWKCFNSCTXKCRDEGRL

SEQ ID NO: 26896 - DNA, 722 bp, Zea mays
  misc_feature: Ceres CLONE 1399867-F
  misc_feature: Encodes the peptide sequence at SEQ ID NO. 26897
cgctctacaactagtggatcccccgggctgcaggaattcgcacgagaccattacctagaacatcctaatcgaaaaatatataatggtattacccccgtcgtcaaatgcaccgccacccaaccccatggccgccgccaccggaagaaccatgaagacgatggcgctcgtcgtcgtcctcgccgccctcctctgctccatctcggtcgccgctgcagccagcggcggactttcttcgtacgtggtgtacctcggccagcacgcgcacggcgcgtcgctgagcacgcacggcgacgaggagctgcaggcgctggagcgcgacgccgccgaggcgcactgcgacctcctcgccggggtcttgggcggagacaagcacaaggcgcgggaggtgatcttctactcgtacacgaagcacatcaacggcttcgcagacaacctggacgccgccaccgccgccgagattgcggtgaaacccggcgtgatctctgtgttccccaagcagggccgcaagctgcacacgacccggtcatggcagctcgtcggcctggccggtgccggcggcgtctcccacggcacggcgtggcgtaaggtcaatctcggcgccgacaccatcatcgagaacttcgacactggtgtgtggacggaatccgagagctttagagatgacggtctggaggcagatccgtcccattggtaaggagactgcgacaaggccaggatgataa

SEQ ID NO: 26897 - protein, 189 aa, Zea mays
  misc_feature: Ceres CLONE 1399867-F
  misc_feature (36)..(130): Pfam Name: Subtilisin_N Pfam Description: Subtilisin N-terminal Region
  misc_feature: SWISSPROT Homolog: EC 3.4.21.25 Cucumisin
MAAATGRTMKTMALVVVLAALLCSISVAAAASGGLSSYVVYLGQHAHGASLSTHGDEELQALERDAAEAHCDLLAGVLGGDKHKAREVIFYSYTKHINGFADNLDAATAAEIAVKPGVISVFPKQGRKLHTTRSWQLVGLAGAGGVSHGTAWRKVNLGADTIIENFDTGVWTESESFRDDGLEADPSHW

SEQ ID NO: 26898 - DNA, 620 bp, Zea mays
  misc_feature: Ceres CLONE 1399870-F
  misc_feature (231)..(231): n is a, c, t, g, unknown, or other
  misc_feature (241)..(241): n is a, c, t, g, unknown, or other
  misc_feature (385)..(385): n is a, c, t, g, unknown, or other
  misc_feature (399)..(399): n is a, c, t, g, unknown, or other
  misc_feature (400)..(400): n is a, c, t, g, unknown, or other
  misc_feature (417)..(417): n is a, c, t, g, unknown, or other
  misc_feature (441)..(441): n is a, c, t, g, unknown, or other
  misc_feature (449)..(449): n is a, c, t, g, unknown, or other
  misc_feature (476)..(476): n is a, c, t, g, unknown, or other
  misc_feature (493)..(493): n is a, c, t, g, unknown, or other
  misc_feature (547)..(547): n is a, c, t, g, unknown, or other
  misc_feature (571)..(571): n is a, c, t, g, unknown, or other
aaagctggagctccccgcggtggcggccgctctagaactagtggatcccccgggctgcaggaattcgcacgagaccattacctagaacatcctaatcgaaaaaccacgccccgcccgtgatgcccgctgccgcgcgcatcttcctccccgcaccccgcatgccccgcgccgcgaactgctcctcccgcacgccccgcccgtgatgcccgccgccgcgcgcgtcttcctccnttcctccccngctagctccgcgcttccttcgcccaccaacgcccgcacccgccaagtcccccaccaacgccactatagcccgcacctctctagactagggcacccaaacccgagccgtcgtccccattgtgcctctcgacgcgcagccaacccnaacccttccctccnngacggcgacgcgatggnccgcgcgacagagaaaacgctgangacatcgncgcgagctcaggagctccagtgcagcnacgcgagacaccggggnctgcgcgaccccgtggcttcgtcgggggacccccggcctggtcctggacctggnccccccccccgcccactccggggnttcggggaatcatgaagtttcccatggccccctcattcctcattttggt

SEQ ID NO: 26899 - DNA, 710 bp, Zea mays
  misc_feature: Ceres CLONE 1399873-F
  misc_feature (483)..(483): n is a, c, t, g, unknown, or other
  misc_feature (618)..(618): n is a, c, t, g, unknown, or other
ggagctccccgcggtggcggccgctctagaactagtggatcccccgggctgcaggaattcgcacgagaccattacctagaacatcctaatcaaaaaagaatatcgcatcgccgtcgcgtcgtcgtcgatctccccgccccgccccgcccgcgccgcggaatctgacacatctccctaatctctcctaggaccgggtgcccttacatccacgccgcaacgcacatcgccgtccgagccctcgcggtctctcgtctccccgtgcgagaggacgccggcagcagcggcgtgccagtgcggtggcttggtgggggaagaccggaggcggcggcagagctcgcgcccagaggtgcacggcaggcctgttctcggcgtcggctggcggaaggcgagtagccacgggaaggacgagtgaataatcatgagctcgatctgccctgtcgcgggagccacactgatgggtgagtatgccctgtgcaatctgantagactacactggtgtgtgccctggaaaatctgacaggacatcggtggtgatgccttgtcactggcaagatcatggtatcagctccggaaaggggtgatcctgtggagaaaaggaaccatcctggtgtcaaccanaaatggccattcggtatgaccccaaccttccagcggggccggtaagtgatttggtcccggcccttccctggaagtcaaaatggcaccgtggc

SEQ ID NO: 26900 - DNA, 667 bp, Zea mays
  misc_feature: Ceres CLONE 1399881-F
  misc_feature: Encodes the peptide sequence at SEQ ID NO. 26901
  misc_feature (414)..(414): n is a, c, t, g, unknown, or other
  misc_feature (548)..(548): n is a, c, t, g, unknown, or other
  misc_feature (578)..(578): n is a, c, t, g, unknown, or other
  misc_feature (614)..(614): n is a, c, t, g, unknown, or other
  misc_feature (635)..(635): n is a, c, t, g, unknown, or other
tccccgcggtggcggccgctctagaactagtggatcccccgggctgcaggaattcgcacgagaccattacctaaaacatcctaatcgaaaaacagccacgcacaggggtcaggtcagtcgcctacgaaattcaatagcacagcgagagccaaggaagaagaagaagcaagcggagcgccatggcggcgtccaacggcgagggccacggccggttcgacgtgatcgtggtgggcgcgggcatcatgggcagctgcgccgcctacgcggcgtcctctcgtggcgcgcgcgtgctgctcctggagcggttcgacctgctccaccaccggggctcctcgcacggcgagtcgcgcaccatccgcgccacctacccgcaggcgcactacccgcccatggtgcgcctgtcccggcgcctcntgggacgaggcccaggccgacgccgggtacaccgtgctcacgcccaccccgcacctcgacctgggcccgcgggacgactcggcgctcgtcgcctccaggaaggaacggcggtgccaccgaagtcgtccgccggngaatgagtcgtcgtcctgggcgtgggcagncggtggtcagggtcccccgaacgggtggaccggcgncgcggagcgaagctgggcggngttcatgaagggccaccaagggccgggggccc

SEQ ID NO: 26901 - protein, 124 aa, Zea mays
  misc_feature: Ceres CLONE 1399881-F
  misc_feature (12)..(73): SWISSPROT Homolog: EC 1.5.3.1 Sarcosine oxidase
  misc_feature (1)..(42): SWISSPROT Homolog: EC 1.14.99.7 Squalene monooxygenase
  misc_feature (79)..(79): Xaa is any aa, unknown, or other
MAASNGEGHGRFDVIVVGAGIMGSCAAYAASSRGARVLLLERFDLLHHRGSSHGESRTIRATYPQAHYPPMVRLSRRLXGRGPGRRRVHRAHAHPAPRPGPAGRLGARRLQEGTAVPPKSSAGE

SEQ ID NO: 26902 - DNA, 702 bp, Zea mays
  misc_feature: Ceres CLONE 1399882-F
  misc_feature: Encodes the peptide sequence at SEQ ID NO. 26903
cgcggtggcggccgctctagaactagtggatcccccgggctgcaggaattcgcacgagaccattacctagaacatcctaatcaaaactctaccacacgggagccgccgcggaggggaaccatggaccagaaggaccggctgagctgcctccccgacgacgtcctccaatccatcctccgcaaactctcgctcaagcaggccgtccgcaccggcgcgctctcccggtggtgggagtcccagtggattcgcgctctcgccggctcccctgttgtcaacctcaccgacgacccggactttgcccgcggccagccgccggcgctgtctgcggccacggtggatcgctgcctccggctccacgccgagctcggtacgcccctcgaggtgttccgcgtggcgctggtttgcccatcagatctggacgggcaagacgtcatcgggtggatcgcggctggcctgcggagggccgccagggcggccaaagtgattgcccccccccctccccggcgggaaaaataacctccctccccccccaccccaactccaagtactatccacgttacccccccctatcctcaacagtccggtacgcccgttgcgcgcgccaacaggaatcgcgggggcgttaggccaacgcgctacaacgcccacccgcccgcacacgcgcacaactagacgtttgctggatgcataactgcgcggaag

SEQ ID NO: 26903 - protein, 131 aa, Zea mays
  misc_feature: Ceres CLONE 1399882-F
MDQKDRLSCLPDDVLQSILRKLSLKQAVRTGALSRWWESQWIRALAGSPVVNLTDDPDFARGQPPALSAATVDRCLRLHAELGTPLEVFRVALVCPSDLDGQDVIGWIAAGLRRAARAAKVIAPPPPRREK

SEQ ID NO: 26904 - DNA, 655 bp, Zea mays
  misc_feature: Ceres CLONE 1399883-F
tggagctccccgcggtggcggccgctctagaactagtggatcccccgggctgcaggaattcgcacgagaccattacctagaacatcctaatcgaaaagagatttgaagttccaggcttccagccgtgctcgtgtaggcgaccagtgaggcagcgaccagcgagcagccagccgctagcacagggtgccgcagagcagctgagtagccgaggcagccgccgccgagcacagggcgcagccgagcagccgagcattctctggcctaatacacgtactcaactgccggcaccaatcgtgtccatgcgcaatggtagtctttaatttcctccctgcaagctacctatcgatcgaccgcacaaccccacgagtttatgtgcagtgcagtactgcagttttatttgctctcagactctagagcatgcggctggatcgcccctcgtctgccgggtgttgtaagagctgcatccagggcacttgtgcgccaagatgtggaactgcacgttggacgtcacgccacagtcgttgcaaaggatccatacctgaacgagaacgcaggaacaaggctgaatgctgccagttcgacagagaaacaacccagggggacggggaggcagacagagacagaggaggggccttctgctctgaagaaacgagtg

SEQ ID NO: 26905 - DNA, 655 bp, Zea mays
  misc_feature: Ceres CLONE 1399885-F
  misc_feature: Encodes the peptide sequence at SEQ ID NO. 26906
  misc_feature (425)..(425): n is a, c, t, g, unknown, or other
  misc_feature (426)..(426): n is a, c, t, g, unknown, or other
  misc_feature (438)..(438): n is a, c, t, g, unknown, or other
  misc_feature (476)..(476): n is a, c, t, g, unknown, or other
  misc_feature (487)..(487): n is a, c, t, g, unknown, or other
ggcggccgctctagaactagtggatcccccgggctgcaggaattcgcacgagaccattacctagaacatcctattcgaaaaatctagaaatccacttcgattcgccctggacgctcctgcctcctgctagtcgacgcgcaatccttggcaatctggcagacaggtgaggcgctgagcctgctactactaactaggagccgcggcgggaaatgagggatgcggaggcggcgtcgcgccggcggtggacgctggtgctggtgaacatggcgtcggtgctggagaaggcagacgaggtgttgctgcccgccgtgtacaaggaggtgggcacggcgctgggcgcttctccgaccgcgctgggctccctcaccctctgccgcgcgctcgtccaggccgcctgctacccgctcgcccgctacgcctcgcgnngcacgatcgggncccgtgtccgtcccccgtgggagcccttcctctggggncggccgcactncccctcgtcggcggtctccggcagcttcctcccagatgggggtttcccggggcctcaacgggatcgggtctcgggttgggccctcccggggaaccagctcgctcgggcccgaaataaccgatggacaccccccggggggggggccttcgggggggggtggaaagaccg

SEQ ID NO: 26906 - protein, 148 aa, Zea mays
  misc_feature: Ceres CLONE 1399885-F
  misc_feature (73)..(73): Xaa is any aa, unknown, or other
  misc_feature (77)..(77): Xaa is any aa, unknown, or other
  misc_feature (93)..(93): Xaa is any aa, unknown, or other
MRDAEAASRRRWTLVLVNMASVLEKADEVLLPAVYKEVGTALGASPTALGSLTLCRALVQAACYPLARYASRXTIGXRVRPPWEPFLWGRPHXPSSAVSGSFLPDGGFPGPQRDRVSGWALPGNQLARARNNRWTPPGGGAFGGGWKD

SEQ ID NO: 26907 - DNA, 672 bp, Zea mays
  misc_feature: Ceres CLONE 1399887-F
  misc_feature: Encodes the peptide sequence at SEQ ID NO. 26908
  misc_feature (618)..(618): n is a, c, t, g, unknown, or other
  misc_feature (672)..(672): n is a, c, t, g, unknown, or other
cgcggtggcggccgctctagaactagtggatcccccgggctgcaggaattcgcacgagaccattacctagaacatcctaatcaaaaaaaaacctagctagatttagaggaaaaaaaaaactgtccccaaccgtgagatggctgagtacggcgagcgctaccagggcaacggcgacccggccacgcccgagggtggctacgcgcagaccgagtacgccgccgccggtggctcgccgcccgccgaccgcaagccctccgtgttctccgaccacgctgacggtcgctcctcccagccccagcatgagactcaatcacatggcagtggttcctccaaatctcgagaaagggaccgagaacgtgataaggaaaaggacagggagcgaggcagagaccgtgtccgcgaaaaggagagggaccgagacagggacaaggatcgtgaaagaggtgacagagacagggatcgtgatcgccaccacatggatcgtcgcgagcgcagcgagataagggaacaccgtgatcgttctgatgatcgtgaccgtcaccgcgatgatcgtgaccgtcgcaggagtcatgattctgagagggagaagaagatcgtgacagagatggccatcgtagncatcgctcccgtccccttttctagagtcgtgaccgtgcccgcagattctagatn

SEQ ID NO: 26908 - protein, 178 aa, Zea mays
  misc_feature: Ceres CLONE 1399887-F
  misc_feature (161)..(161): Xaa is any aa, unknown, or other
MAEYGERYQGNGDPATPEGGYAQTEYAAAGGSPPADRKPSVFSDHADGRSSQPQHETQSHGSGSSKSRERDRERDKEKDRERGRDRVREKERDRDRDKDRERGDRDRDRDRHHMDRRERSEIREHRDRSDDRDRHRDDRDRRRSHDSEREKKIVTEMAIVXIAPVPFSRVVTVPADSR

SEQ ID NO: 26909 - DNA, 686 bp, Zea mays
  misc_feature: Ceres CLONE 1399890-F
  misc_feature: Translation starting site: 126
  misc_feature (561)..(561): n is a, c, t, g, unknown, or other
tccccgcggtggcggccgctctagaactagtggatcccccgggctgcaggaattcgcacgagaccattacctagaacatcctaatcgaaaaacccgacccgcctccaactccaagcaaagccgccatggcggctccgcccgtgaccaccgccacgactcaccaccgcgcgctcctcccgcccacgcgcacccacgccgccgatacgcactccgcgatccgcctcgcgctccgcgcgcatccccacgcccacgcccagcgcgcgcgcctcaccgcggctgctgtcccggcccccgcggagtcgacggtctccctcgagtcctccgacgcgtgcaaacccttatacgctcgcggtcgacaaccacggcgccgcgggtgttgcgctgatgcgcgaattctccaacggggactgctcctacgacctctcccccgagggcacccggcccatatctcgctctgcggcgcgatcatcgtaagttgctgaaccaaggccccccgcccccccctctgagggggcagagggaagcatccccgtaggcgggccccaccggccttcaaaatcntaacatcacaaaactggcggaaagcccccggatgacgggaggccctccctcaacacccccgagcttatatgccaccaccctcctcccacccccccaaaccttagttcctcgggcatcttttcaag

SEQ ID NO: 26910 - DNA, 639 bp, Zea mays
  misc_feature: Ceres CLONE 1399892-F
  misc_feature (381)..(381): n is a, c, t, g, unknown, or other
tggagctccccgcggtggcggccgctctagaactagtggatcccccgggctgcaggaattcgcacgagaccattacctagaacatcctaatcgaaaaagttccccaaattcccaacgccgccgcgacggcgctgctagctagtctttggtgttgtaggtgttcgattcctgattccaaattccagactccaaactcggttcttcaatcgacagattccgatttacatcccaaagctcttcggattgaaatcccagcgcggacccagagataagagtttttgggataagtagataggatagtagaaatagagagggaccccttttcgctgatgaataccggggaagaaaaaaaccccccaaaaagggagggaaggggggggngccaaccccccgcggggagagggtttttttggaaaaaaattctccccgcccccccggggggggagggggaaagaggccctctttcccttttggcgaatcccccccccccccccaaaatcaaaaaaaaatttggttctacaacccccccaaagagtaaaaaaagccccctaaaataacccccccgccccttttttttcttggggggggggggaaactcttgtttcccccccccccccccggggtggaaaaccccttttc

SEQ ID NO: 26911 - DNA, 663 bp, Zea mays
  misc_feature: Ceres CLONE 1399894-F
  misc_feature: Translation starting site: 126
  misc_feature: SWISSPROT Homolog: EC 3.2.1.39 Glucan endo-1,3-beta-D-glucosidase
  misc_feature (365)..(365): n is a, c, t, g, unknown, or other
  misc_feature (429)..(429): n is a, c, t, g, unknown, or other
  misc_feature (430)..(430): n is a, c, t, g, unknown, or other
  misc_feature (435)..(435): n is a, c, t, g, unknown, or other
  misc_feature (436)..(436): n is a, c, t, g, unknown, or other
  misc_feature (631)..(631): n is a, c, t, g, unknown, or other
  misc_feature (637)..(637): n is a, c, t, g, unknown, or other
  misc_feature (644)..(644): n is a, c, t, g, unknown, or other
  misc_feature (662)..(662): n is a, c, t, g, unknown, or other
tccccgcggtggcggccgctctagaactagtggatcccccgggctgcaggaattcgcacgagaccattacctagaacatcctaatcgaaaaacgcccaggcagactccaacatagcagagaagccatggccggtccgccgctcttgagcttccccttcttcttccttctctgcgtcgccctcgcctggagcgaggcgtatggagcaagcggtggctacgggctcggcgtcaactacggccgggtggcggacgacatcccttcgccgtggcgctccgtggagctgctccgcgcggcgggggccgggtcggtcaagatctacgacgccaacccgggcgtgctccgcgcgctggctgggacgcgctgncccgtctccatcatggtgccaaaccaaatcataccggacctcgccgccctctgctgccgcgcgnnaccgnntggtcgccgagaacctggtcccctactacccggcgacactggtcaagtccttctcgtggggaacgagatcctctccgacttggtcatcgcgaactccactggccacaccttgtccgggcgatggagacatccaccggagcctccgcaagaggggcatcagcagcgtcaagatcggcacacgctcgccatgacgcngctcgncgacggngcttccggggccaccgtng

SEQ ID NO: 26912 - DNA, 584 bp, Zea mays
  misc_feature: Ceres CLONE 1399897-F
  misc_feature (42)..(42): n is a, c, t, g, unknown, or other
  misc_feature (201)..(201): n is a, c, t, g, unknown, or other
tccccgcggtggcggccgctctagaactagtgggatcccccngggctgcaggaattcgcacgagaccattacctagaacatcctaatcgaaaactccttcccctccctctttcccgacaccaaaagaaaccgaaaaccatcgacgcgctcccgtcaccctcccctaccccggggtctcctcccctacgctccagccagggnaaaaacctaccctagatgggcgcgtcacctcacgggcggggggggtttgccttttccccgcccaacccccccgtttaaagggtttaagagggggggccgtttcggggccctggaaacccaaagtccggggccgggacaattaaagggggggctccggggcggggaaacaaaaaggggcgtcttgggggcgggaaaaaaaaaaagttccaaaggggggaaaaaaaaaaaaggggggccccggtgttgggaacacccccccccccccccgggaaaaaataaaagggggggggcgccttcccccaaaaaaaaacaccgccgggggggtggttatcaatatagcaagggcccccccggcgtgggaacatcattactttttttccccc

SEQ ID NO: 26913 - DNA, 664 bp, Zea mays
  misc_feature: Ceres CLONE 1399899-F
  misc_feature: Translation starting site: 158
  misc_feature (329)..(329): n is a, c, t, g, unknown, or other
  misc_feature (433)..(433): n is a, c, t, g, unknown, or other
  misc_feature (441)..(441): n is a, c, t, g, unknown, or other
  misc_feature (552)..(552): n is a, c, t, g, unknown, or other
  misc_feature (590)..(590): n is a, c, t, g, unknown, or other
  misc_feature (606)..(606): n is a, c, t, g, unknown, or other
acccgcggtggcggccgctctagaactagtggatcccccgggctgcaggaattcgcacgagaccattacctagaacatcctaatcgaaaaaatctcctctccatcgaaaccctagcacgacgcaattcccgtcttcccacgccgtatcgccgttgctatgggcaagaagcggaagctcgagcccaaatcggcggcagggttcacgccggttaaggcctccccgaccaccaggtctgccaccgctaaggccgctggtctatccgaggtcctcgcccccgtcgaggctacgatggagaagctgccgcagggggcaggcggcgaggatgtanaggaaatcgaggaggaggtggaggtcgagaaggaagtggaagtggaagaagaagaagaaggcgagagcgactaggcttcgatccaggcgctgctggattcgttncccaaggnacagctcgtcgagctgttacgcgacgctgccatcgctcacggcgacgtgctaaccacatccggcgcgtggccgacgccgacccggctcagcggaagatcttcgtacacggnctcggctgggacacccacaccgacaccctcaccgaggnctttcgcccatacggngagatagaggatctcaaggtcgtcaccgaccgcacacggcaaggcaaagggggtacgg

SEQ ID NO: 26914 - DNA, 675 bp, Zea mays
  misc_feature: Ceres CLONE 1399905-F
  misc_feature (208)..(208): n is a, c, t, g, unknown, or other
  misc_feature (245)..(245): n is a, c, t, g, unknown, or other
  misc_feature (280)..(280): n is a, c, t, g, unknown, or other
  misc_feature (445)..(445): n is a, c, t, g, unknown, or other
ggagctccccgcggtggcggccgctctagaactagtggatcccccgggctgcaggaattcgcacgagaccattacctagaacatcctaatcgaaaaaccttgtctacagggttttccgctgtcttatcccttcgtccacgctccctgcagccgccgcccaaaccctagcaacccgtcctccgccatggccgacgaccactactcctcntagaggaagtacgacgacccctcgccgccgccgcggngcacggggttctcttcgggcccgccgcctgctcgncggttcgcgggcgggggcccgtcgtaacacagcgtggcacggcccccccgaggagatccagctcgcgaagcagcgcgcggcaggagatcgcgggccgcgaatctttaccgccgaaaagggcaagggggccttcgcgtcgacaagggggaacgatggaagcggggntttttccgggaagccctggcagcactgggggggggggggccccatccgggggggggaggaatccggttttccgcccctgggcgggggggggggacaggggttttttttccccaaaattattttttcaaagagggggcccctcaaaatccccctttaggggggggaaccggggggcaaagcaaaaagattggattcccctgtggggggggggtgggggtataaattgaaaa

SEQ ID NO: 26915 - DNA, 666 bp, Zea mays
  misc_feature: Ceres CLONE 1399908-F
  misc_feature: Translation starting site: 263
  misc_feature: SWISSPROT Homolog: EC 3.4.16.5 Carboxypeptidase C
  misc_feature (261)..(261): n is a, c, t, g, unknown, or other
  misc_feature (267)..(267): n is a, c, t, g, unknown, or other
  misc_feature (493)..(493): n is a, c, t, g, unknown, or other
  misc_feature (550)..(550): n is a, c, t, g, unknown, or other
  misc_feature (551)..(551): n is a, c, t, g, unknown, or other
  misc_feature (560)..(560): n is a, c, t, g, unknown, or other
  misc_feature (666)..(666): n is a, c, t, g, unknown, or other
aagctggagctccccgcggtggcggccgctctagaactagtggatcccccgggctgcaggaattcgcacgagaccattacctagaacatcctaatcgaaaaatctctctcgctttctctagccatgacgctggtgaggatgccttgccgcctctgctgcttcctgctcgtcgtcgccgcctccgccgtctccgggcgggggcgggtggtcaccaccctcccgggctacgagggccgcctccccttccacctcgaaacaggntatgtnggaggtggacgaggacgccggcgcggagctcttctactacttcgtccgggccgagtccggcgccgacgacagcgacaccccgttcgtcctccggatccccggcggccaacgctgctcctccttcagcggcctcgcctacgagataggtcccatcatgtttgtcgtggagccctacaacggcagcttgccgcgcctgcgctacacccaaactcgtggacaaaggtgncgcatattctttttgtggattcacagttgggggccgggttttcctctccagagatgnncaaggtacnaccgctggagcggtatcaaccacgatgcgcttggcgaaagtcctcaccaggtggttcaatggacatcccgagaaacatgcaaatcctttctacatcgatggaagan

SEQ ID NO: 26916 - DNA, 670 bp, Zea mays
  misc_feature: Ceres CLONE 1399909-F
  misc_feature: Encodes the peptide sequence at SEQ ID NO. 26917
  misc_feature (41)..(41): n is a, c, t, g, unknown, or other
  misc_feature (50)..(50): n is a, c, t, g, unknown, or other
  misc_feature (69)..(69): n is a, c, t, g, unknown, or other
  misc_feature (83)..(83): n is a, c, t, g, unknown, or other
  misc_feature (274)..(274): n is a, c, t, g, unknown, or other
  misc_feature (292)..(292): n is a, c, t, g, unknown, or other
  misc_feature (293)..(293): n is a, c, t, g, unknown, or other
  misc_feature (344)..(344): n is a, c, t, g, unknown, or other
  misc_feature (366)..(366): n is a, c, t, g, unknown, or other
  misc_feature (393)..(393): n is a, c, t, g, unknown, or other
  misc_feature (451)..(451): n is a, c, t, g, unknown, or other
tacccgcggtggcggccgctctagaactagtggatcccccngggctgcanggaattcgcacgagaccanttacctaagaacantcctaatcaaaagattggcgattccatttctaccccgagacctccagccgtccgcccctgaaccctcagccttctccgtcccgcctcggcactcgacggccgccggcacacaccgcgcagtctcgagacaggaaccggaggaacgaggatggaggatgactcgccgctgacgaagacgatgaaaggtgcgntgacaggactcgccgcgnngaccatctggggcaccgtcgtcgccacctggtacgacgtgccccgtgtggnagcgcacgtcgcgctccttggnctttatcggacgctcaagatggggggnacctaaagggggccactttcgccaccattggggggctcttaattcggggtcaaaaaanttccgggcaaaccagggaaaaaaacggcactccccaaaggggccccacaagggggtttctttgcccggaccctttgttgggggaaaacaagaaaaaagattttttccggcccccccttcggaggggcccggggggggtttcaactctgggggggggggagattgtggggaaaaaacccccaatggtgacccgggaaaaaaaaaattttcccacccacgg

SEQ ID NO: 26917 - protein, 55 aa, Zea mays
  misc_feature: Ceres CLONE 1399909-F
  misc_feature (15)..(15): Xaa is any aa, unknown, or other
  misc_feature (21)..(21): Xaa is any aa, unknown, or other
  misc_feature (38)..(38): Xaa is any aa, unknown, or other
MEDDSPLTKTMKGAXTGLAAXTIWGTVVATWYDVPRVXAHVALLGLYRTLKMGGT

SEQ ID NO: 26918 - DNA, 658 bp, Zea mays
  misc_feature: Ceres CLONE 1399911-F
  misc_feature (384)..(384): n is a, c, t, g, unknown, or other
  misc_feature (442)..(442): n is a, c, t, g, unknown, or other
aagctggagctccccgcggtggcggccgctctagaactagtggatcccccgggctgcaggaattcgcacgagaccattacctagaacatcctaatcgaaaaaaacaacgccgcgacgagaagagagaagagggcgggcatcggccagtgggggctcggaggccgagggaggcgaggaaagcggcgggtgccgggccgcccgcgccggtgccgaggccctcaccagtcaccaccccctcccctcttccgtctgtcccccgcttgccgccaccgccgctgcctgctcgcgacccttcccccttttaacgctcccgcggccccgcgtcgtgctcccttttgtcgccgctgccttcgtgcccgtactcgcgggttctcctcgctcctncatctccgcgcctgggcgcggcgttcgccgccggatctgggcgcgggacggtgcccgnaacggcgatgggcgcgggtgccgctccgtttgggcgccgcgcgctcgcgtgtctcgtcctcgtgtcaggggctctgctccacttgtcagttccgacgatggaacaacactgcgatggtggtgtcaggggctgggtggattcctcacggggcggggggaaggcggggacaaatgaggcctcaggatttgctcttcttcttccacatactaggactgg

SEQ ID NO: 26919 - DNA, 685 bp, Zea mays
  misc_feature: Ceres CLONE 1399912-F
  misc_feature: Encodes the peptide sequence at SEQ ID NO. 26920
  misc_feature (443)..(443): n is a, c, t, g, unknown, or other
  misc_feature (447)..(447): n is a, c, t, g, unknown, or other
  misc_feature (448)..(448): n is a, c, t, g, unknown, or other
  misc_feature (463)..(463): n is a, c, t, g, unknown, or other
  misc_feature (539)..(539): n is a, c, t, g, unknown, or other
  misc_feature (553)..(553): n is a, c, t, g, unknown, or other
  misc_feature (558)..(558): n is a, c, t, g, unknown, or other
  misc_feature (582)..(582): n is a, c, t, g, unknown, or other
  misc_feature (583)..(583): n is a, c, t, g, unknown, or other
  misc_feature (596)..(596): n is a, c, t, g, unknown, or other
  misc_feature (683)..(683): n is a, c, t, g, unknown, or other
tggagctccccgcggtggcggccgctctagaactagtggatcccccgggctgcaggaattcgcacgagaccattacctagaacatcctaatcgaaaagctatttcttcacccgtccgttcacctgcgttcatccggcctacgttaaaatctctccatcccggcgacgactggcgacagccgctgccggcctactccaggtccccaggtctacgtcggacccttcgccgcggcgagcaccaccagatggcgagcacggggcggtcgatgctgctgtcactgctcctcttcgcagtgacgctgtcgctgctggagatgtacagggccaagttcgcctcgtcggagctcatgacccatcgccggtggattcgtctgctccctcctattcctgctactcctcacctttattggaaactatcaagaagctagtggagatagaactggntggnngtgcagttggtgtancacaacttgtagctcttattggtagcgcactgtcccacgtgtctgtatcacacatggctcctggtttccgctggancccttttacgaggntgacnagctctctggcatgatcttttgcnnagagtgaagtctnagggtgaggcggcactaagcacagaagcagcacagagagatgatacattggatatttttatgtagatgaattatttgagtccaaacngg

SEQ ID NO: 26920 - protein, 60 aa, Zea mays
  misc_feature: Ceres CLONE 1399912-F
MASTGRSMLLSLLLFAVTLSLLEMYRAKFASSELMTHRRWIRLLPPIPATPHLYWKLSRS

SEQ ID NO: 26921 - DNA, 649 bp, Zea mays
  misc_feature: Ceres CLONE 1399913-F
  misc_feature: Encodes the peptide sequence at SEQ ID NO. 26922
tccccgcggtggcggccgctctagaactagtggatcccccgggctgcaggaattcgcacgagaccattacctagaacatcctaatcgaaaaacacggtccacacagcccaacaaaggagcgcggcggcccctccttccttcctcccacttctctcgcgcggcgctcgcttacctcgcctcgcattccgttcgagcaggggagcggcagtgagaagggagggaattaaggcaagatgttcatcgagagcttccgcgtcgagagcccccacgtgcggtacggcccgacggagatcgagtcggagtaccggtacgacacgacggagctggtgcacgaggccaaggacggcgcctcccgctgggtcgtccgccccaagtccgtcaagtacaacttccggaccagcaccgcggtccccaagctcggggtcatgctttgtgggggtggggaggcaacaacgggtccacgctggacggcttggggtcattgccacaaggggagggggatctcatgggcgaccaaggacaaggtgcagcaagccaactactacggctccctcacccaggcttccccatcagagtaggagtacacaagggggaggagaaaatatgcgccgttcaagagcctcctacccatgtgaaccagaacgacctt

SEQ ID NO: 26922 - protein, 114 aa, Zea mays
  misc_feature: Ceres CLONE 1399913-F
  misc_feature: SWISSPROT Homolog: EC 5.5.1.4 Inositol-3-phosphate synthase
MFIESFRVESPHVRYGPTEIESEYRYDTTELVHEAKDGASRWVVRPKSVKYNFRTSTAVPKLGVMLCGGGEATTGPRWTAWGHCHKGRGISWATKDKVQQANYYGSLTQASPSE

SEQ ID NO: 26923 - DNA, 667 bp, Zea mays
  misc_feature: Ceres CLONE 1399915-F
  misc_feature: Encodes the peptide sequence at SEQ ID NO. 26924
  misc_feature (526)..(526): n is a, c, t, g, unknown, or other
  misc_feature (550)..(550): n is a, c, t, g, unknown, or other
tggagctccccgcggtggcggccgctctagaactagtggatcccccgggctgcaggaattcgcacgagaccattacctagaacatcctaatcgaaaaaaactaaccccaaaccccaatccaccccatcccctcctcatccactccgggcggccatggcctgctccttctccgccgccatcaccgtctcttccgcccctaccccggccgccagacccctcgctgctgccccgcagtccgtctgcatcgctcgctccgcggtcgccaccactgccaggccgctccgcctcgccgcctcaaggtccgcgcgggctaccagactcgttgcccgcgccagcgtagtcgatgacttgccgctggtcgggaacaaggcgccagacttagaagccgaggctgtgttcgaccaggagttcatcaacgtgaagctctctgattacattgggaaagagtacgtcattctgttcttctaccccttggatttcaccttcgtctgcccgaccgagattactgcgtttagtgacagatacnaggaatttgagaagtgaacactgnagggtcttggtgtttccattggacagtgtgttctcccaccttgcatgggtgcagacagaggggaagtcggggggggctcggcgatcttaaatacccatttgtttctgatgtgacaaa

SEQ ID NO: 26924 - protein, 129 aa, Zea mays
  misc_feature: Ceres CLONE 1399915-F
  misc_feature: SWISSPROT Homolog: EC 1.11.1.15 Peroxiredoxin
  misc_feature (125)..(125): Xaa is any aa, unknown, or other
MACSFSAAITVSSAPTPAARPLAAAPQSVCIARSAVATTARPLRLAASRSARATRLVARASVVDDLPLVGNKAPDLEAEAVFDQEFINVKLSDYIGKEYVILFFYPLDFTFVCPTEITAFSDRYXEFEK

SEQ ID NO: 26925 - DNA, 728 bp, Zea mays
  misc_feature: Ceres CLONE 1399918-F
  misc_feature (343)..(343): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
tccccgcggtggcggccgctctagaactattggatcccccgggctgcaggaattcgcacgagaccattacctagaacatcctaatcgaaaacttcccctctctcgcccctcctccctccgtctcgtctcccaggtcatggcaaaagctggagcaccgggaaaaataacaagtgggagataaacaggaagagctaggtgaatacttggagaaaaaggtcccccacaccccccacgcaggtgaatactacaagtagcagtacaaggaagagagccaatctgcccgtgactgccagtgagttgctcgggtgtggtgggttaggttgaagggtcaaccccgaaatgncggnnnncgccaacccattttcccttggcctctcaaaaaaagggggggccccccggcggggcgcaccctctctgggtcaaatttgtggaaattggggggaatttcccacaaaaaagggggggccttgggttttcccccccctggggggggggcccacacaaaaaaattttttcccgggggagaattcctcccccgggggggagaaaaaaaaaaggggggggggtaaacaaaaaaaaaaacccccgggggggggtttttttcccccccctcccaactttctttggaggggcgccccgcaaaaaaaaaaaggttcttcctccctcccccgggggggggggaacaaacacgcaaaggggcgggggtggaggagtaggtgtgcggaaaa

SEQ ID NO: 26926 - DNA, 718 bp, Zea mays
  misc_feature: Ceres CLONE 1399919-F
  misc_feature: Encodes the peptide sequence at SEQ ID NO. 26927
  misc_feature (573)..(573): n is a, c, t, g, unknown, or other
  misc_feature (574)..(574): n is a, c, t, g, unknown, or other
  misc_feature (579)..(579): n is a, c, t, g, unknown, or other
  misc_feature (580)..(580): n is a, c, t, g, unknown, or other
  misc_feature (582)..(582): n is a, c, t, g, unknown, or other
  misc_feature (583)..(583): n is a, c, t, g, unknown, or other
  misc_feature (674)..(674): n is a, c, t, g, unknown, or other
aaagctggagctccccgcggtggcggccgctctagaactagtggatcccccgggctgcaggaattcgcacgagaccattacctagaacatcctaatcgaaaagtcgtctcgtgcttcccaatcaccatagagccggttgatccccaaaggcccatggttttctccgacgccgcgtcgcctctcgtagccaccgccgctgactctgcttcctcctgcgtcgcccacctcccctgctgctgtcgcgttagttgttgccgttgttgttgaagacgcgtagctcgctagggttcgtgatttctcgccgatcggttcgggaactggtaagctatggatctctcgcggcccgcatcgtcagacctctcgctcgggctgcactctcatgcccacgcccacgctcgcgtgcatgcggcagccgcgccgctgcgcctgttcgacgacgcgaagccggagcgcctcgtggccggggaggccgacgcggagagggacgacggggacggtggcgaccagcacttctccctcctcgggcactccctctgcgtcaagcgcccgcgccgcgcgtcaacggcggtgggnngcggnngnnggaaaagacgtcatcctgctcgtccccggcgctgcgccccgccaagggcaggcggcggggggaagatagccgccgcggatctggagaccgnccgcggcgcggtccgtttctggggcaaccagtcgcctggcggag

SEQ ID NO: 26927 - protein, 130 aa, Zea mays
  misc_feature: Ceres CLONE 1399919-F
  misc_feature (83)..(83): Xaa is any aa, unknown, or other
  misc_feature (85)..(85): Xaa is any aa, unknown, or other
  misc_feature (86)..(86): Xaa is any aa, unknown, or other
  misc_feature (116)..(116): Xaa is any aa, unknown, or other
MDLSRPASSDLSLGLHSHAHAHARVHAAAAPLRLFDDAKPERLVAGEADAERDDGDGGDQHFSLLGHSLCVKRPRRASTAVGXGXXKRRHPARPRRCAPPRAGGGGKIAAADLETXRGAVRFWGNQSPGG

SEQ ID NO: 26928 - DNA, 710 bp, Zea mays
  misc_feature: Ceres CLONE 1399920-F
  misc_feature: Encodes the peptide sequence at SEQ ID NO. 26929
  misc_feature (544)..(544): n is a, c, t, g, unknown, or other
  misc_feature (610)..(610): n is a, c, t, g, unknown, or other
aaagctggagctccccgcggtggcggccgctctagaactagtggatcccccgggctgcaggaattcgcacgagaccattacctagaacatcctaatcgaaaaaatcgtatcgggcaggggctgcaacccaggctgtacgggcgcggcagggcagcggcggcgacatctgcatctgcatctcccacctcgtctccctcccgcatctgccctgcctcgatcccgccgccagccatctaagggagccgggagccatgtctccctccggcgagctgctggcgtccatctcctccgctctcgccgtggccttcgtcttcctcgcctgcgtcgagctcggcgacgccgccgccgccgtcagcgtctaccgcctcatccagtacgacctcgccggcgccccgctcggtcccggcgccgcggtcctcaatcaccacgccgcggtgctcccgctccctgccggcgcagacctctcccgctccgccctcgtcgcgccgctcctcgaccttccgctctccttcctcagagaggtacctgggtggagaaaaacagnttgggggggggattgctcattttgctcccgacaaacagggtggatagggattagtgcggaatgacnagggcaaagggcaaaaggggtactgactggaactgtggaaaaaatttgcttggggcaacaaacaattccaataattccaggggaactttggggcttttgg

SEQ ID NO: 26929 - protein, 118 aa, Zea mays
  misc_feature: Ceres CLONE 1399920-F
  misc_feature (98)..(98): Xaa is any aa, unknown, or other
MSPSGELLASISSALAVAFVFLACVELGDAAAAVSVYRLIQYDLAGAPLGPGAAVLNHHAAVLPLPAGADLSRSALVAPLLDLPLSFLREVPGWRKTXWGGDCSFCSRQTGWIGISAE

SEQ ID NO: 26930 - DNA, 663 bp, Zea mays
  misc_feature: Ceres CLONE 1399922-F
  misc_feature: Encodes the peptide sequence at SEQ ID NO. 26931
gctctagaactagtggatcccccgggctgcaggaattcgcacgagaccattacctagaacatcctaatcgaaaaatgaccgactagcccatggtctctctccgctccgacgcgcccgacccaccaccacatccctcatggctgccctcgccgacatcgactcctcggcacttccgccgtccgagtcatccaaaggcaagggcaagatggacaaggaggaggaggacgaggcgaagggcgcggagaagatgtgcggcatctgctatctcgacggccggcgggccatccgcggcgagctcgactgctgcgcccatttcttttgctttgtctgcatcatggcttggggccgcgcgaagtcccgctgtcccttctgcagggcccgcttccacaccatccgccgcccgcccgtcggccggccggttccccgacgagcgaatcgtctcgatccaagagcgcaaccaggtacaccatcctcagggcaacgggagcagcatagggggggcggagatccttacgtgaacacatatttgcaccggtttgcagcagctccccgcgaatgactagctgggtgctactctgcggaggtctgcgagtcagctgacaaaccttaatgggggtcgggcctggggacaccgtggccgagaggggggaattggtttttgcg

SEQ ID NO: 26931 - protein, 140 aa, Zea mays
  misc_feature: Ceres CLONE 1399922-F
MAALADIDSSALPPSESSKGKGKMDKEEEDEAKGAEKMCGICYLDGRRAIRGELDCCAHFFCFVCIMAWGRAKSRCPFCRARFHTIRRPPVGRPVPRRANRLDPRAQPGTPSSGQREQHRGGGDPYVNTYLHRFAAAPRE

SEQ ID NO: 26932 - DNA, 659 bp, Zea mays
  misc_feature: Ceres CLONE 1399924-F
  misc_feature: Translation starting site: 146
  misc_feature: Pfam Name: Glyco_hydro_1 Pfam Description: Glycosyl hydrolase family 1
  misc_feature: SWISSPROT Homolog: EC 3.2.1.21 Beta-glucosidase
  misc_feature (437)..(437): n is a, c, t, g, unknown, or other
  misc_feature (655)..(655): n is a, c, t, g, unknown, or other
cgcggtggcggccgctctagaactagtggatcccccgggctgcaggaattcgcacgagaccattacctagaacatcctaatcgaaaaacacacttcacaagcagctcaaagctctagttctagctagctagcaaagggggggaaaatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctttactacacgatctgcaagagtaggcagccaaaatggagtccaaatgttgagcccctcggaaatcccacaaagggactggttcccctctgacttcaccttcggtgccgccacttcagcgtaccaaattgaaggtgcttggnaatgaagatggaaagggggaaagcaactgggatcacttctgccacaatcatccggaaaggatactggacgggagcaattcagacattggagcgaattcgtacatatgtaccaaaacggacgttagattgctcaaggaatgggatgacccgcatataggttctctatctcttggcccaaataactgccgaaggacccaaaggaggaggatttaaaccgnaatg

SEQ ID NO: 26933 - DNA, 664 bp, Zea mays
  misc_feature: Ceres CLONE 1399925-F
  misc_feature: Translation starting site: 249
tggagctccccgcggtggcggccgctctagaactagtggatcccccgggctgcaggaattcgcacgagaccattacctagaacatcctaatcgaaaaaactccgacccacacccacggcacggtagccggcagctgccagcgtcgagcgcagtgccctcttgtctgttgcctcctacctgcccgtccgctgcctcgtgcccagtttcactcacacagtcacacgatccgatcggaggtcgttgaggatatggacactgattcgttgactacgaggctcgcattgctggcgctgtttctcctggcggcgcccgcccgaccgtcctcggcgtatccggtgcacgatgacctgctcagcaatggtgactttgatacagcaccaccgatgccttcgtaagatctgcctctgttgctgaccgctgatcagcaatccctggttggagaatcaatggagcagtcgagctcatctcaacatgccatgatcagggctggatgatcctgattgttccacacgcatgacatgctgtatggctaagccatgatgctagcgttggccaggtcggtgtacgtagagaatgctgcgtactacgctgccacattcagcgctggccggaaatgtggacaactggaagcactgaaacgctccgttgctagtggagtagcgcc

SEQ ID NO: 26934 - DNA, 771 bp, Zea mays
  misc_feature: Ceres CLONE 1399927-F
  misc_feature: Encodes the peptide sequence at SEQ ID NO. 26935
  misc_feature (402)..(402): n is a, c, t, g, unknown, or other
aagctggagctccccgcggtggcggccgctctagaactagtggatcccccgggctgcaggaattcgcacgagaccattacctagaacatcctaatcgaaaaagaagacttcccttcgtctgcttcccagagacccagccatggcgatctcccagatctcacgcatattcctggccatccttctcctggccgccgccttcgccgccgccccagctgcgcttgcggacggcgacgacgtggtggcccttaccgaatccacgttcgagaaggaggtcggaaaggaccgcggcgccctcgtcgagttctacgccccctggtgtggtcactgcaagaagcttgctcctgagtatgaaagacttggtgcaagttttaagaaagctaaatctgtcttgatggctaaagntgattgtgatgaccacaagagtttgtgcagcaagtatggagtttcccggtatccaaccatccatgggtccccgaaagatccttggagccaaaaagtatgaaggacaacgcctggcaaagcccctgctgaattcctcaaactggagggagcccaaaggaaagctgggcaccttcccttaaagggtgggggttccccccccaaaagaccttgacccaatggccttggagaaaacaaagagggccctgggagggcctagccccccggggggggccccggaaaaatctttcccccaaaaaaataaaaagggtgctcttttttcagggtggaggaagagggggttttttttcaacctgcgccggcaaaaacggg

SEQ ID NO: 26935 - protein, 120 aa, Zea mays
  misc_feature: Ceres CLONE 1399927-F
  misc_feature (32)..(121): Pfam Name: Thioredoxin Pfam Description: Thioredoxin
  misc_feature: SWISSPROT Homolog: EC 5.3.4.1 Protein disulfide-isomerase
  misc_feature (88)..(88): Xaa is any aa, unknown, or other
MAISQISRIFLAILLLAAAFAAAPAALADGDDVVALTESTFEKEVGKDRGALVEFYAPWCGHCKKLAPEYERLGASFKKAKSVLMAKXDCDDHKSLCSKYGVSRYPTIHGSPKDPWSQKV

SEQ ID NO: 26936 - DNA, 696 bp, Zea mays
  misc_feature: Ceres CLONE 1399930-F
  misc_feature: Translation starting site: 159
  misc_feature (385)..(385): n is a, c, t, g, unknown, or other
  misc_feature (591)..(591): n is a, c, t, g, unknown, or other
aagctggagctccccgcggtggcggccgctctagaactagtggatcccccgggctgcaggaattcgcacgagaccattacctagaacatcctaatcgaaaatcgtctccactgctctgctgctcctcgcaccgccgccgccgccgccgcagcgacgtaatggcttccgccgcggtgctccggaacgccggctcccggcgcctcttctcctaccctactctccgcgccgctgcgatatatgtaccttctgcgctacccgatgcgcccgcggcggcggcagcgccggcccagccgccaccgacggccgggaccctcctgggcgaggtctatggccaccttcacgcgcacgaagccccatggtgaatgtcggcaccattggggcacgntcgatcacggcaaaaccactcctcactgctgtcatttaccaaggtcctgggcgaggggaaaggagggccaaaggccgttgcttttccaacgagatcgacaggggttccgggaggaagaaggccagaggaatcaccattgcgacagctcaccgtcgaaggaatgagaccggctaaaaggattatggctcccccgtgggatggtcagntcacgcccagattatgtcaagaactgatccactgagctgtcaaaaggggtggggggggaagttttcttgggccgggcaaccccctgaagggcccgatgcccaaac

SEQ ID NO: 26937 - DNA, 663 bp, Zea mays
  misc_feature: Ceres CLONE 1399932-F
  misc_feature: Encodes the peptide sequence at SEQ ID NO. 26938
  misc_feature (163)..(163): n is a, c, t, g, unknown, or other
  misc_feature (205)..(205): n is a, c, t, g, unknown, or other
  misc_feature (272)..(272): n is a, c, t, g, unknown, or other
  misc_feature (294)..(294): n is a, c, t, g, unknown, or other
  misc_feature (385)..(385): n is a, c, t, g, unknown, or other
  misc_feature (389)..(389): n is a, c, t, g, unknown, or other
  misc_feature (404)..(404): n is a, c, t, g, unknown, or other
tggcggccgctctagaactagtggatcccccgggctgcaggaattcgcacgagaccattacctagaacatcctaatcgaaaagggaaacaaagcgaagttggggcggcgagacgcgagacgcgagacgcgagaaatggcggagccgcctttggccgccggctngcacgacaaactggaggagggaggcggatgagcggctgcggngcctccactccctcctcttcggcgccgacgccgcactcgagcacggggacgccacggtggcgcaggngctcgcgctccgcctcctcggnttcctcgactctcaggcgctagcgggcagcgcggggcccccgaggacgcccgccttcgtcgcgcccattcgcaccgcggcttccgctcggntagncgccgcctcacgggncccgcgcctctgactccgaccgtgcagcttttgagcttgcaagaacgaatggttggctgtgtttttgcaaatcagggtgacaataatgttgaaggaatccagcgttcgaaagatttccaagctctttctcagaagtctaaaggaaatgtttctgaacaacgaatgcacatggcaaggagtctcagttcaatggccccatgcgtcgatgaaagccagctggaatgaaaaagggagctaagatcgggcctcaaggtaatgg

SEQ ID NO: 26938 - protein, 58 aa, Zea mays
  misc_feature: Ceres CLONE 1399932-F
MVGCVFANQGDNNVEGIQRSKDFQALSQKSKGNVSEQRMHMARSLSSMAPCVDESQLE

SEQ ID NO: 26939 - DNA, 697 bp, Zea mays
  misc_feature: Ceres CLONE 1399934-F
  misc_feature: Encodes the peptide sequence at SEQ ID NO. 26940
  misc_feature (439)..(439): n is a, c, t, g, unknown, or other
  misc_feature (440)..(440): n is a, c, t, g, unknown, or other
  misc_feature (472)..(472): n is a, c, t, g, unknown, or other
  misc_feature (554)..(554): n is a, c, t, g, unknown, or other
  misc_feature (568)..(568): n is a, c, t, g, unknown, or other
  misc_feature (577)..(577): n is a, c, t, g, unknown, or other
  misc_feature (605)..(605): n is a, c, t, g, unknown, or other
  misc_feature (606)..(606): n is a, c, t, g, unknown, or other
  misc_feature (625)..(625): n is a, c, t, g, unknown, or other
  misc_feature (669)..(669): n is a, c, t, g, unknown, or other
tggagctccccgcggtggcggccgctctagaactagtggatcccccgggctgcaggaattcgcacgagaccattacctagaacatcctaaaaaaaaaacggttaaacccatgccgctaatcgacgccgccgcctcggcggtcgcgccgcccccaccccggcgagtggctcaactccgcttcttcagcactcgcagacccggaatcctatccctaactgccaccagctgctccccctcccctccgcccccggtcgctgcggaggtgcctgcggcgccacaggaagcgaagtcgaagccgaggccacggcggtacccgaagcagtaccccggcgagtcggtgggcgttgctgaggagatgcgctttgtcgccatgcgcctgcgtaaccccaagcgcaccaccataaaagacaagtcggggacggaggacgcggacgccggnngcgggggtgtcggagggcgaggctgaggaggnacgacggcggcggcgtgaaggaggaacacgaggaggaggatgagggcgagctcgaggaaggggaatgatgcccccaatgggnaaggggttcgtgcngatactggntggacagcaggctcgtctcgacccatcnnaggggggcccgtgcgaaancccacccgatgtccgctgggggagtcacaggtccatccccatcnttttgggctgggagtggcttttttgggg

SEQ ID NO: 26940 - protein, 118 aa, Zea mays
  misc_feature: Ceres CLONE 1399934-F
  misc_feature (111)..(111): Xaa is any aa, unknown, or other
MPLIDAAASAVAPPPPRRVAQLRFFSTRRPGILSLTATSCSPSPPPPVAAEVPAAPQEAKSKPRPRRYPKQYPGESVGVAEEMRFVAMRLRNPKRTTIKDKSGTEDADAGXGGVGGRG

SEQ ID NO: 26941 - DNA, 806 bp, Zea mays
  misc_feature: Ceres CLONE 1399935-F
  misc_feature: Encodes the peptide sequence at SEQ ID NO. 26942
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (33)..(33): n is a, c, t, g, unknown, or other
  misc_feature (34)..(34): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
nnnnncccccccccaccnnnccccccccccccnnctnnngagggaaaaaaaacaaaactggtgctccaccgcggtggcggccgctctagaactagtggatcccccgggctgcaggaattcgcacgagaccattacctagaacatcctaatcgaaaactagtccagccagatctccaccgccgccggcgagagcacggtatcagatccgccgcgatggcgttccgccgcatcttatccacagcggtgcgccgccgctcggccatcgccgcggcagcgtccgggaacgcgcgcgaggcctccacggccgtcgccgcggcgcccggcgtgctagcccccgacgcgaccccggtgcgcgctcccgtgatgccgtacgatcgcatcgccgaagccgttaacgccagggttccggcggattgaagcacccagacccgcgcttcctgcgttatgcaagccccgcttccgtcccacgccgaccacacggccatccttgcggcgccggagacccgggtcaccacggctgtccaccggccttgcgccggggccaacggagttggtccctcgcccgcgcgcacgggttactggtgcgccgggtccgcaccacacggcggcgccgcaggcccccaagaaccgagctggcgccgccccgccggccccccgccattcttgccccccgcccgatcgcttggttccagagaggaaccgggggacaccaggaacggggatgcgaaaaatatgggacgtaagtgagagatctgaggcgggcagttgggtgcgggcctcccccgttttgaagggtcttatcggcc

SEQ ID NO: 26942 - protein, 67 aa, Zea mays
  misc_feature: Ceres CLONE 1399935-F
MAFRRILSTAVRRRSAIAAAASGNAREASTAVAAAPGVLAPDATPVRAPVMPYDRIAEAVNARVPAD

SEQ ID NO: 26943 - DNA, 706 bp, Zea mays
  misc_feature: Ceres CLONE 1399936-F
  misc_feature: Translation starting site: 231
  misc_feature (356)..(356): n is a, c, t, g, unknown, or other
  misc_feature (366)..(366): n is a, c, t, g, unknown, or other
  misc_feature (450)..(450): n is a, c, t, g, unknown, or other
  misc_feature (486)..(486): n is a, c, t, g, unknown, or other
  misc_feature (532)..(532): n is a, c, t, g, unknown, or other
ggagctccccgcggtggcggccgctctagaactagtggatcccccgggctgcaggaattcgcacgagaccattacctagaacatcctaatcgaaaaaaaaccaaaaccctccatccattctacacgcgccgccgcactcctgtacacgccccgccgccaccgcctccaccaccacagcgcgcaggaatccctcgttctctgagggtttcaggcgtcgtatgtaagagaagatggcgctctcagtatccatggagggcatcgaggcgcgggcgcgggatctcggggtggacctctccgctgtcgatctggactccatcaccctcccggccggcgaggacttcggcatcgtcagtgangacgaggagntacttcggtggtgaggatcttccaaacttgaaaaatggggtttgtccaacatttattgtcgtggacatccctgccagttgttcntcccagaaaagttttgagaagccttggagaatgtcnatacgcaagatctacagccaaattggagcgataaaaagaaaatggntctaatggatgcctgtaaacccagagacaaagaagacatacgggttactgggttcatttgagtatagtaccccttcagaaagctgagctgggctagggaaaaaaaccaatgggtacaaactcgacagtctacaaatctttgcagcaattttggtcgagaatttcagaaaaaaaa

SEQ ID NO: 26944 - DNA, 694 bp, Zea mays
  misc_feature: Ceres CLONE 1399937-F
  misc_feature: Encodes the peptide sequence at SEQ ID NO. 26945
gctctagaactagtggatcccccgggctgcaggaattcgcacgagaccattacctagaacatcctaatcgaaaaatatattcacctgagccaggtcgctgtttcatcatcgtgcttgactgcagtctgcagggggtgtggccgcgctgcagcctgcctgtcaatctcgatcgatcaaggggtggcgtgccgagatggcggaccggccgtcgcttcctgctctcattattgctatcgccgttcttgctggcagttactgccgcgtggcgagctcggcctcgccggcggtggaagatgagctgcgcggtggaggaggagccggcggtccgacgacgatgcggcggcgcgcggcgtcggtgacggtgcccatcaccatcctcaagtccgctgttaacgacgaagctgtgtgcatgaatgaaacgccacctgcttaccacttgcatcctggttcccggagcgggaacaaaaacttggattgggaaccttaaagggaggggggggggtggaccgcgggtcaaaaaatgcccggtccccccggaggttcccggcgcggctttgccgggccccctggccccacgaatcccccccccccggcctccttggcccccacccccccccgggaaccccggtttctatctttgttacccctcgcaccggggccctcttcaccaccggttctcttccctccccgtact

SEQ ID NO: 26945 - protein, 97 aa, Zea mays
  misc_feature: Ceres CLONE 1399937-F
MADRPSLPALIIAIAVLAGSYCRVASSASPAVEDELRGGGGAGGPTTMRRRAASVTVPITILKSAVNDEAVCMNETPPAYHLHPGSRSGNKNLDWEP

SEQ ID NO: 26946 - DNA, 735 bp, Zea mays
  misc_feature: Ceres CLONE 1399941-F
  misc_feature (332)..(332): n is a, c, t, g, unknown, or other
  misc_feature (333)..(333): n is a, c, t, g, unknown, or other
  misc_feature (342)..(342): n is a, c, t, g, unknown, or other
  misc_feature (362)..(362): n is a, c, t, g, unknown, or other
  misc_feature (408)..(408): n is a, c, t, g, unknown, or other
  misc_feature (409)..(409): n is a, c, t, g, unknown, or other
  misc_feature (470)..(470): n is a, c, t, g, unknown, or other
  misc_feature (479)..(479): n is a, c, t, g, unknown, or other
  misc_feature (508)..(508): n is a, c, t, g, unknown, or other
tccccgcggtggcggccgctctagaactagtggatcccccgggctgcaggaattcgcacgagaccattacctagaacatcctaatcgaaaagaatcgttattatcagtgggctagaacatactaatgcgagtgctgtgctgctaaatctaatctgcgtgcgattggtcgatgggcaggttcggtggagatcgccgccgttggcgtttcgatcgccatatttaaccaagtctccaaggtctgcatctaccctctcgttagcgtcacaacgtcgttcgtcgcggaggaagacgcgatcattcagtaaggccgtccgaggaaacagcagccaggnnaggaggacngtggagaaagcctcccacgntgggcttttgatccggagaccagcaatctgcatgcatctgggcccnntgcaggtatgggcagaatggcgtgaactcgtgatcccccctacggagtggcgcagcagatncctctgganggcaaagggcggtgcgagaaagagggacnggtggcggtcggtccacgtcgggctttaaaaaaagtcggttccattctcgggctgggtttcaggccggctttccctggggccttcgggcccagattcgtgtcaaacaatttgggggggggtggaaaagccccggatccccggatggagggggcccctgcgggtgcgctaccctaaacgataaagggtcccttggtgggcccccccttgtggggcttgttggctctgc

SEQ ID NO: 26947 - DNA, 689 bp, Zea mays
  misc_feature: Ceres CLONE 1399944-F
  misc_feature: SWISSPROT Homolog: EC 2.4.1.12 Cellulose synthase (UDP-forming)
  misc_feature (392)..(392): n is a, c, t, g, unknown, or other
  misc_feature (542)..(542): n is a, c, t, g, unknown, or other
tccccgcggtggcggccgctctagaactagtggatcccccgggctgcaggaattcgcacgagaccattacctagaacatcctaatcgaaaaaaagagattggctggatctatggttcagtaacggaggatattctgactgggtttaaaatgcatgcaaggggctggcaatcaatctactgcatgccaccacgaccttgtttcaagggttctgcaccaatcaatctttccgatcgtcttaatcaggtgctccgttgggctcttgggtcagtggaaattctgcttagtagacattgtcctatctggtatggttacaatggacgattgaagcttttggagaggctggcttacatcaacactattgtatatccaatcacatccattccgcttattngcctattgtgtgcttcccgctatctgcctccttaccaataaatttatcattcctgagattacaataatggcctgggatgttcttcattcttcttttcgcctccatttttgcactgggtatattggagtcaaaaggggaagtggtgttggnattgaaagattggtgaaaaaatgagccagttttggggttattggggggaacctctgccattctccttcgaaagggttccagggtctggtgaaaaatggttggtctgggattgatacccaacttcccagtttacctccaaagcatccc

SEQ ID NO: 26948 - DNA, 666 bp, Zea mays
  misc_feature: Ceres CLONE 1399945-F
  misc_feature: Encodes the peptide sequence at SEQ ID NO. 26949
  misc_feature (213)..(213): n is a, c, t, g, unknown, or other
  misc_feature (666)..(666): n is a, c, t, g, unknown, or other
tggagctccccgcggtggcggccgctctagaactagtggatcccccgggctgcaggaattcgcacgagaccattacctagaacatcctaatcaaaaggcccgcgcctcgctctctcttgtctcgcccgctagctcccatcccagcctcccaccgcgcccgcctgccccaacctcccccctcccctccccgctccgctccgctccacgcacggngccagatctgctgctgctgcggcggccggtggacgccgcgccgcgcgtgccggcggcggtgacgtgagcggcggatcctgcccggccgtgccatcccggcgacgatgacagcgtaagcgggcggcggacgaccgcgcccccccggcccctactcccgaggtcattggcgtgtgctccttggcagaaaatggcgatgatggtggatccccccaatggcatggcaagtcaaggaaagcattactatactatgtggcagacactggttgagatcgacaccaagtacgtgccgatcaagcccatcggaaaaggagcttacggaaacgtttgctcatctggtaaaccgcgagaccaatgaaaaaggcgcgataaaaaagataaacaacgtcttttgacaaccgtgtggaagccctaaagacgctaagagaactgaaactccttcgggcacttgaggcn

SEQ ID NO: 26949 - protein, 55 aa, Zea mays
  misc_feature: Ceres CLONE 1399945-F
  misc_feature: SWISSPROT Homolog: EC 2.7.11.24 Mitogen-activated protein kinase
MAMMVDPPNGMASQGKHYYTMWQTLVEIDTKYVPIKPIGKGAYGNVCSSGKPRDQ

SEQ ID NO: 26950 - DNA, 668 bp, Zea mays
  misc_feature: Ceres CLONE 1399946-F
  misc_feature: Encodes the peptide sequence at SEQ ID NO. 26951
  misc_feature (230)..(230): n is a, c, t, g, unknown, or other
  misc_feature (441)..(441): n is a, c, t, g, unknown, or other
aagctggagctccccgcggtggcggccgctctagaactagtggatcccccgggctgcaggaattcgcacgagaccattacctagaacatcctaatcaaaaaaggccagcgtggaaactggaaaagctgcctccgccaaatccaaaccaaacgggacggtcgccggaggaagcatacccgaaactcccctcccctctccttacaataccgcgaggcggcggctgacgtcgnttagccgctttcccacaccttcgccgccgcctatactcctgcagaaatagcccgagggagggcggttgctgctgcatcgtgttcggtgttccttccctcgccgcacgcgggatccatttgacggacggaccgaccgagcgactcacccgtccaccgagagccatggggcagaggcagagccacagcaagcgggacgggagcagccacgggncggcggtcgcgctcctttcagcagcagccgtcggcgcagtggggcgccggaagaggagggtactaccagcaggacccaagcaccggctactacgggggcgccggtgccacacaggggaggagggtactaccaccaggacccaggcacgggctactacgggcgcggcgggtgcacagaaggggaaggaggtacgccgcgcccgaccggaacaagcccgccgctgtcgc

SEQ ID NO: 26951 - protein, 92 aa, Zea mays
  misc_feature: Ceres CLONE 1399946-F
  misc_feature (17)..(17): Xaa is any aa, unknown, or other
MGQRQSHSKRDGSSHGXAVALLSAAAVGAVGRRKRRVLPAGPKHRLLRGRRCHTGEEGTTTRTQARATTGAAGAQKGKEVRRARPEQARRCR

SEQ ID NO: 26952 - DNA, 694 bp, Zea mays
  misc_feature: Ceres CLONE 1399950-F
  misc_feature: Encodes the peptide sequence at SEQ ID NO. 26953
  misc_feature (499)..(499): n is a, c, t, g, unknown, or other
  misc_feature (584)..(584): n is a, c, t, g, unknown, or other
cgctcacaactagtggatcccccgggctgcaggaattcgcacgagaccattacctagaacatcctaatcgaaaaaatcacgagaagggcgccgatctgggaaggcattgtcttgttgtactttcccttccggcagtggcctcgattcgcatccccttttcccgtccatgcgcgcgccggcgggcggtgccagtgccaccgcgctcgcggcggccatgaacattaagcagccgctgcacggcgcatcgacgctgttcgcgctgctctctctctcgctgctcctcctccgcctgctcctccgcctccgcctggccgccttccgcgacgcggcgctgtcgctccacctgctggcgcgcctccgcctccgccccgtcctcctctgcctcccggcagcctgccacgacggcggcgccggcgccggcgccaccacgctgcgcgtctggtgccccgccaccccatcctccaagccgccgctgctcctcctccacggcttcggcggngacgccaagtggacgtgggcgcgcaacctcccgcgcctggcccgccacttccacgtgtacgcgccggaacctcgtgttcttcggngcgcaggcccgggcacgcgccccccctgcgctccgtggggttccagggccggtgcggccgacaagacatgcgcctccctcgggggggccaagtgccaagatccgcgaccg

SEQ ID NO: 26953 - protein, 176 aa, Zea mays
  misc_feature: Ceres CLONE 1399950-F
  misc_feature: SWISSPROT Homolog: EC 3.8.1.3 Haloacetate dehalogenase
  misc_feature (140)..(140): Xaa is any aa, unknown, or other
MRAPAGGASATALAAAMNIKQPLHGASTLFALLSLSLLLLRLLLRLRLAAFRDAALSLHLLARLRLRPVLLCLPAACHDGGAGAGATTLRVWCPATPSSKPPLLLLHGFGGDAKWTWARNLPRLARHFHVYAPEPRVLRXAGPGTRPPCAPWGSRAGAADKTCASLGGAKCQDPRP

SEQ ID NO: 26954 - DNA, 682 bp, Zea mays
  misc_feature: Ceres CLONE 1399952-F
  misc_feature: Encodes the peptide sequence at SEQ ID NO. 26955
  misc_feature (572)..(572): n is a, c, t, g, unknown, or other
gctctccaactagtggatcccccgggctgcaggaattcgcacgagaccattacctagaacatcctaatcgaaaaaccaccaagtggacgcagcagctttaaccccccaaagcctcgacgccgcgagcacagctccgccgccaccgcccccttctcatccgcggtctccgccgcctgctgcatctctatcgatctagcgggactggctccttcccgtgctgggtccttcgtcaatcgtcagcgcgcaagatcggcacttgtgtacatctgagcagtttccggtgccctaattcaggcgcgggcgttgttgggttttcgataattttgggggttcacctgaaccctcatgacccaggtgaagcccgcccctgggggaaggatgctgaccgtgctgcgggtgcacctcccgtcggagatcccgatcgtcggctgtgagatcacgccgtatgtgctcctgcggcgccccgacggaggcgtcttcaccgacgacgtgtctgagaccgcgcccgtggatgggtacttcatgcgctacaagtggtaccgcatacaaagtgatcgtagagctgctatccngagggtacacccaacagaaccagcaacacttcagcggatagggtgtctgaagtcaaaaaaaccgggtgctaaagctaccattgttcttctaagtgcttccccaagcctgg

SEQ ID NO: 26955 - protein, 112 aa, Zea mays
  misc_feature: Ceres CLONE 1399952-F
  misc_feature (76)..(76): Xaa is any aa, unknown, or other
MTQVKPAPGGRMLTVLRVHLPSEIPIVGCEITPYVLLRRPDGGVFTDDVSETAPVDGYFMRYKWYRIQSDRRAAIXRVHPTEPATLQRIGCLKSKKPGAKATIVLLSASPSL

SEQ ID NO: 26956 - DNA, 665 bp, Zea mays
  misc_feature: Ceres CLONE 1399955-F
  misc_feature: Encodes the peptide sequence at SEQ ID NO. 26957
  misc_feature (620)..(620): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
aaagctggagctccccgcggtggcggccgctctagaactagtggatcccccgggctgcaggaattcgcacgagaccattacctagaacatcctaatcgaaaaaagctcaccagagcagagaaactcgcacgcactcactctcttccccccctcctgcccactctccaaagcggcgcacgcatctggcacagctgcgcagcgcacccagcaagcttggtctggagagacagatatagccagccagagagcagcagacgaggcatggcgacgtccgtggcttgcgccttcttcttcgacgcggagccgctgggcgagcccgggcggcacgcgctggacgcctgcgcgctctgcgccaagccgctgagccgcaacagcgacatcttcatgtacaagggcgacaccccgttctgcagcgaggactgccgctacgagcagatgcaccacgacgcggcgtacgcaaggcaggcggccagcagccggcggaagcagcagcagtcgcagtcgcagcggagcagaggagcctcgtccgtgggcgccaaggcggacgtgtccgtggccagctagtcagtagtaaagcagcacagcgacgcccagtaaagggaggagatggagtagagaanaagaaggccgtgctggttgagcacgtagtgaccccnnnnnggggg

SEQ ID NO: 26957 - protein, 100 aa, Zea mays; identical to SEQ ID NO: 16608
  misc_feature: Ceres CLONE 1399955-F
  misc_feature (14)..(66): Pfam Name: DUF581 Pfam Description: Protein of unknown function (DUF581)

SEQ ID NO: 26958 - DNA, 688 bp, Zea mays
  misc_feature: Ceres CLONE 1399956-F
  misc_feature (360)..(360): n is a, c, t, g, unknown, or other
  misc_feature (361)..(361): n is a, c, t, g, unknown, or other
  misc_feature (426)..(426): n is a, c, t, g, unknown, or other
  misc_feature (501)..(501): n is a, c, t, g, unknown, or other
  misc_feature (511)..(511): n is a, c, t, g, unknown, or other
  misc_feature (522)..(522): n is a, c, t, g, unknown, or other
  misc_feature (523)..(523): n is a, c, t, g, unknown, or other
  misc_feature (532)..(532): n is a, c, t, g, unknown, or other
  misc_feature (671)..(671): n is a, c, t, g, unknown, or other
cgcggtggcggccgctctagaactagtggatcccccgggctgcaggaattcgcacgagaccattacctagaacatcctaatcgaaaagatcccaaatgtgcccggcccggtccctctgcactgcgctgcgcccatccatccttaaaccctcctgcgcgcgtaggcctcgtctcgtgcttccccagcatacctttcctcctccttcgccaggtgcctcttcgttctcctctccgtttccctgcgtggcgcgcgcggcgctccgggctatcaggacgaaataactggccgcgctgcacaccggccgccgcgagaagaagcgctcgccccgcgcgctctgcccgctggttcggccgtgccatnnccccggccggtgcttcttccccccctggtgcccgcttgatctccttccgcgcgcacgcaacacgncagtggtccgtcgcccgcccgctgattgatcctgcaggaaaaacagggcaaggagctactttgagcccgagacanactgaaaaanatgagatgggnncgaggtggncaaccacagcaagaggaacacacgacagctacttcagtgggcaaggcgccccgcacaaatttttggggggaggatccggcagcattggcctccaaaaaagcccaaggtatgccagcccgagactcgcgcccgatcaccnaagggagaaaaagggca

SEQ ID NO: 26959 - DNA, 691 bp, Zea mays
  misc_feature: Ceres CLONE 1399957-F
  misc_feature: Encodes the peptide sequence at SEQ ID NO. 26960
tccccgcggtggcggccgctctacaactagtggatcccccgggctgcaggaattcgcacgagaccattacctagaacatcctaatcgaaaaatccgactaaaaagggccagggccagggccttcgcttgcttactactcctgcttaccacactctaccttgtctcttcacgtgcacacgacgcctcccccaatggctgcggtggcggaggaggaggtgatcgtcgtcggcgcggggcagtcggggctagcggtggcggcgtgcctgtccctgcgcggcgtgcgggcgctggtcctggagcgcgacgactgcgtggggtcgctgtggcggaagcgcgcctacgaccgcctccacctccacctcaccaagaagtactgcgcgctgccgcacgcgccgcacccggccgaggcccccgcgtacctgcaccgcgacgacttcgcgcggtacctggacgggtacgccgcgcggttcgccgtccgcccgcgcctccgccgcgaggttcgttccgggcggcactgctccgcgctggtgcggtgctaggtcaacccttgggactactgcttaggatcgctcccctgttgcccgcactggttccggatggcattgttaacggcaaggcacccgctacacacatcagcaactgctgaagccccctcactacctgacttcacggggtccccagacaacccaat

SEQ ID NO: 26960 - protein, 115 aa, Zea mays
  misc_feature: Ceres CLONE 1399957-F
MAAVAEEEVIVVGAGQSGLAVAACLSLRGVRALVLERDDCVGSLWRKRAYDRLHLHLTKKYCALPHAPHPAEAPAYLHRDDFARYLDGYAARFAVRPRLRREVRSGRHCSALVRC

SEQ ID NO: 26961 - DNA, 725 bp, Zea mays
  misc_feature: Ceres CLONE 1399958-F
  misc_feature: Encodes the peptide sequence at SEQ ID NO. 26962
  misc_feature (389)..(389): n is a, c, t, g, unknown, or other
aaagctggagctccccgcggtggcggccgctctagaactagtggatcccccgggctgcaggaattcgcacgagaccattacctagaacatcctaatcgaaaagaatacaccacccctcgtctccccacggaggccgtcctctcctctcctctgcgtccgccactgcccaccgctcgcccgcgcgcgctccattacctcggcgggcgatggccgacctatccaacaccggctccacctaacacgagcagcgcccccgcctaggcggcagctggctggtcggtcgtcgagcagctagcggcggcagcgcccggagggaggccgtctcactctcctcgtcggggcggcaggagatggaggccatcgtgggcgtccgcgcgccgccgcgtggncgtgcctgggccggcctcgagaagccgccgcgcgccgcttgccgcgccagagtcccgacggcgaggctcgcggtcgcggcggacagggcgccggagctggtgctgctgggcgccgatacgcgaaggggccgcggatcctgccctccgtgcggcgcgcaatctgcaggtggaacaggaaaggtccactactctggtgatgacgctctcatactacagggttagaaaaaatgcacccccccaaccccccccaaaaggaactgaaggaattgcgtaattccttggaaggggaaaaaattatcaaacggctttagctatttatatggtgggaaaaatata

SEQ ID NO: 26962 - protein, 86 aa, Zea mays
  misc_feature: Ceres CLONE 1399958-F
MEAIVGVRAPPRGRAWAGLEKPPRAACRARVPTARLAVAADRAPELVLLGADTRRGRGSCPPCGAQSAGGTGKVHYSGDDALILQG

SEQ ID NO: 26963 - DNA, 712 bp, Zea mays
  misc_feature: Ceres CLONE 1399961-F
  misc_feature: Encodes the peptide sequence at SEQ ID NO. 26964
  misc_feature (647)..(647): n is a, c, t, g, unknown, or other
  misc_feature (712)..(712): n is a, c, t, g, unknown, or other
gctctagaactagtggatcccccgggctgcaggaattcgcacgagaccattacctagaacatcctaatcgaaaaactccaccagtccggtccatctgctggacctcgattggtttcttcttacctaggaacatccggggatgtcgactcctgcgaggaagaggctgatgagggatttcaagcggttgatgcaggaccctccggccggcataagtggcgccccgcaggataacaacataatgctgtggaatgctgtcatatttggacctgatgataccccgtgggatggaggtacgtttaagctgactctccagtttaatgaagaatatccaaacaaaccaccaactgtgcgatttgtttctaggatgttccatcctaacatttatgctgatggaagcatatgcttagatatcctgcagaatcagtggagtccgatatatgatgtagctgcgatactcacgtcaatccagtcattgttgtgcgatccaaacccgaattcgcccgctaactctgaagccgcccgcatgttcagcgagaacaagcgagagtacaaccgcaaagttcgggaggtcgtggagcagagctggacggcggatggaatggcccttgtgggtgccgtcccgctgtgctgcgcagctgctcactgcngccccgcacacaggtcagcctcagccaccgaccgttgcaccagctcgcatggcgctccacgcgcn

SEQ ID NO: 26964 - protein, 191 aa, Zea mays
  misc_feature: Ceres CLONE 1399961-F
  misc_feature (8)..(145): Pfam Name: UQ_con Pfam Description: Ubiquitin-conjugating enzyme
  misc_feature: SWISSPROT Homolog: EC 6.3.2.19 Ubiquitin--protein ligase
  misc_feature (170)..(170): Xaa is any aa, unknown, or other
MSTPARKRLMRDFKRLMQDPPAGISGAPQDNNIMLWNAVIFGPDDTPWDGGTFKLTLQFNEEYPNKPPTVRFVSRMFHPNIYADGSICLDILQNQWSPIYDVAAILTSIQSLLCDPNPNSPANSEAARMFSENKREYNRKVREVVEQSWTADGMALVGAVPLCCAAAHCXPAHRSASATDRCTSSHGAPRA

SEQ ID NO: 26965 - DNA, 688 bp, Zea mays
  misc_feature: Ceres CLONE 1399969-F
  misc_feature: Encodes the peptide sequence at SEQ ID NO. 26966
  misc_feature (385)..(385): n is a, c, t, g, unknown, or other
  misc_feature (386)..(386): n is a, c, t, g, unknown, or other
  misc_feature (560)..(560): n is a, c, t, g, unknown, or other
  misc_feature (561)..(561): n is a, c, t, g, unknown, or other
ggagctccccgcggtggcggccgctctagaactagtggatcccccgggctgcaggaattcgcacgagaccattacctagaacatcctaatcgaaaagtcggaagctcccttcatttctttcacctccgattcgattccttgtcccctcttgatccgagccgccaccaaaccctaactatctaaaacccccgtctcgctgtccgatggccgccgcctcgccgccgccctccccaccccacgcaaagcgccccaagatgtcctcctcctccgacccggaagccgatgctgagcccacctcggcctccgccgccgttgagggcgccgatcctgcgcagcgtcgtcccaggtacaagcgccgcaaggtcgccatccttctcgggtaatnngcggcgcggggtatcagggcatgcagaagaatccgggcgcgcgcaccatcgagggggacctcgaggaggcgctcttaccaggcgggcgccgtgcccgaggccgaccggtcggcgccgcgcccgttacgattgggcacgtgctgcgcgcaccgacaagggcgtcaggccgcggcnncaagggggtggtcgggcgcttctacgtcgacccgccgggcttcatcgatcgcttgaacgcgcagctcgcgccgcagatccgcgcctacggctacgtgcgcgttaccaactcatcaaaggggaaaaag

SEQ ID NO: 26966 - protein, 94 aa, Zea mays
  misc_feature: Ceres CLONE 1399969-F
  misc_feature (52)..(52): Xaa is any aa, unknown, or other
MQKNPGARTIEGDLEEALLPGGRRARGRPVGAAPVTIGHVLRAPTRASGRGXKGVVGRFYVDPPGFIDRLNAQLAPQIRAYGYVRVTNSSKGKK

SEQ ID NO: 26967 - DNA, 750 bp, Zea mays
  misc_feature: Ceres CLONE 1399972-F
  misc_feature: Encodes the peptide sequence at SEQ ID NO. 26968
  misc_feature (286)..(286): n is a, c, t, g, unknown, or other
  misc_feature (302)..(302): n is a, c, t, g, unknown, or other
  misc_feature (303)..(303): n is a, c, t, g, unknown, or other
  misc_feature (312)..(312): n is a, c, t, g, unknown, or other
  misc_feature (323)..(323): n is a, c, t, g, unknown, or other
  misc_feature (365)..(365): n is a, c, t, g, unknown, or other
  misc_feature (379)..(379): n is a, c, t, g, unknown, or other
  misc_feature (417)..(417): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (544)..(544): n is a, c, t, g, unknown, or other
  misc_feature (550)..(550): n is a, c, t, g, unknown, or other
  misc_feature (553)..(553): n is a, c, t, g, unknown, or other
  misc_feature (554)..(554): n is a, c, t, g, unknown, or other
  misc_feature (559)..(559): n is a, c, t, g, unknown, or other
  misc_feature (560)..(560): n is a, c, t, g, unknown, or other
  misc_feature (603)..(603): n is a, c, t, g, unknown, or other
  misc_feature (619)..(619): n is a, c, t, g, unknown, or other
  misc_feature (620)..(620): n is a, c, t, g, unknown, or other
  misc_feature (634)..(634): n is a, c, t, g, unknown, or other
  misc_feature (666)..(666): n is a, c, t, g, unknown, or other
  misc_feature (676)..(676): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
aagctggagctccccgcggtggcggccgctctataactagtggatcccccgggctgcaggaattcgcacgagaccattacctagaacatcctaatcgaaaaaccttgtctacaagggttttccgctgtcttatcccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgcctcngccgctcgcgggcggnngccccgtcngtaaacagcgntgccaccgcccccccgatgagatccagcttcgcgaagcagcngcgcgcaggagaantcgcggcgcggatcttttaacgccgcagaaggccaagncgtccctcgcgtcgacaaacggcgacgatgacagcgggccggcttcttgtgtagagctgggcagcacttggnnnntggcggtggcgcatccnnnncggcgggaggactcggttctcgtccctctggncccggnggnnggggnnaacggggggctcttatccccccaattatcttcttcagagaggngcaccccagacttccnnccttatgggggggnagatattcggggaccaagcaacaagatgattncaaatggggnannngggggttgggggttaattcattgtggaaaagacgggaaaacaccataatggatattcccaacttccatcc

SEQ ID NO: 26968 - protein, 40 aa, Zea mays
  misc_feature: Ceres CLONE 1399972-F
  misc_feature (38)..(38): Xaa is any aa, unknown, or other
MADDHYSSKRKYDDPSPPPRRTGFSSGPPPASAARGRXPR

SEQ ID NO: 26969 - DNA, 662 bp, Zea mays
  misc_feature: Ceres CLONE 1399975-F
  misc_feature: Encodes the peptide sequence at SEQ ID NO. 26970
  misc_feature (541)..(541): n is a, c, t, g, unknown, or other
  misc_feature (544)..(544): n is a, c, t, g, unknown, or other
tggagctccccgcggtggcggccgctctagaactagtggatcccccgggctgcaggaattcgcacgagaccattacctagaacatcctaatcgaaaaacccgacccgcctccaactccaagccaagccgccatggcggctccgcccgcgaccaccgccacgactcaccaccgcgcgctcctcccgcccacgcgcacccacgccgccgctacgcactccgcgctccgcctcccgctccgcgcgcatccccacgcccacgcccagcgcgcgcgcctcaccgccgccgctgccccggcccccgcggcgtcgacggcctccctcgagtcctccgccgcggggaagcctacggtgctcgtggccgagaagctcggcgccgcggggcttgcgctgctgcgggaattcgccaacgtcgactgctcctacggcctctcccccgaggacctccgtgtcaagatctcgctctgcgacgcgctcatcgtcaggtccgggatccaggtcgggccgcgacgtcttcgaggcgtacggggcagtatccgcgcgcntgncccgggccggaaaaagtttctaccacgtcgacactgccccagcgaccggagaggaatggcaaaataaggaagcatctaccgccagcccggaggggctggacttagacgtcagggaaaa

SEQ ID NO: 26970 - protein, 159 aa, Zea mays
  misc_feature: Ceres CLONE 1399975-F
  misc_feature: SWISSPROT Homolog: EC 1.1.1.95 Phosphoglycerate dehydrogenase
  misc_feature (137)..(137): Xaa is any aa, unknown, or other
  misc_feature (138)..(138): Xaa is any aa, unknown, or other
MAAPPATTATTHHRALLPPTRTHAAATHSALRLPLRAHPHAHAQRARLTAAAAPAPAASTASLESSAAGKPTVLVAEKLGAAGLALLREFANVDCSYGLSPEDLRVKISLCDALIVRSGIQVGPRRLRGVRGSIRAXXPGRKKFLPRRHCPSDRRGMAK

SEQ ID NO: 26971 - DNA, 688 bp, Zea mays
  misc_feature: Ceres CLONE 1399976-F
  misc_feature: Encodes the peptide sequence at SEQ ID NO. 26972
  misc_feature (476)..(476): n is a, c, t, g, unknown, or other
  misc_feature (480)..(480): n is a, c, t, g, unknown, or other
  misc_feature (481)..(481): n is a, c, t, g, unknown, or other
  misc_feature (550)..(550): n is a, c, t, g, unknown, or other
  misc_feature (551)..(551): n is a, c, t, g, unknown, or other
  misc_feature (619)..(619): n is a, c, t, g, unknown, or other
tggagctccccgcggtggcggccgctctagaactagtggatcccccgggctgcaggaattcgcacgagaccattacctagaacatcctaatcaaaaaaggccagcgtggaaactggaaaagctgcctccgccaaatccaaaccaaacgggacggtcgccggaggaagcatacccgaaactcccctcccctctccttacaataccgcgaggcggcggctgacgtcgcttagccgctttcccacaccttcgccgccgcctatactcctgcagaaatagcccgagggagggcggttgctgctgcatcgtgttcggtgttccttccctcgccgcacgcgggatccatttgacggacggaccgaccgagcgactcacccgtccaccgagagccatggggcagaggcagagccacagcaagcgggacgggagcagccacgggcggcggtcgcgctcctttcagcagcagccgtcggcgcagntggnngcgccccggaggaggagggtactaccagcaggacccaagcaccggctactacgggcgcggcggtgcacnnaccaggggaggagggtactaccaacaggacccaggcaccggctactacgggcgcgccggtgcacaggnaagggaaggaggggtacgcgcgccgtaccgggacaaggccccgccgctgtcgccgttgctgctcccggc

SEQ ID NO: 26972 - protein, 100 aa, Zea mays
  misc_feature: Ceres CLONE 1399976-F
  misc_feature (30)..(30): Xaa is any aa, unknown, or other
  misc_feature (31)..(31): Xaa is any aa, unknown, or other
  misc_feature (55)..(55): Xaa is any aa, unknown, or other
MGQRQSHSKRDGSSHGRRSRSFQQQPSAQXXAPRRRRVLPAGPKHRLLRARRCTXQGRRVLPTGPRHRLLRARRCTGKGRRGTRAVPGQGPAAVAVAAPG

SEQ ID NO: 26973 - DNA, 696 bp, Zea mays
  misc_feature: Ceres CLONE 1399977-F
  misc_feature (458)..(458): n is a, c, t, g, unknown, or other
  misc_feature (485)..(485): n is a, c, t, g, unknown, or other
  misc_feature (494)..(494): n is a, c, t, g, unknown, or other
  misc_feature (495)..(495): n is a, c, t, g, unknown, or other
  misc_feature (696)..(696): n is a, c, t, g, unknown, or other
cgcggtggcggccgctctagaactagtggatcccccgggctgcaggaattcgcacgagaccaacctagaacatcctaatcgaaaagaacacgatccctttctcccctttccctgcgtagtgcggagctccagtgaaggaaccaaacagcgcaacacacgaacacaccaggcggcaggctccaccccgtccttttcctgccttttccccccgtcgagttaatccatccagtcgccaaaagctttgctaaatttcacgtgtctcgcctcgagtcgtccctaatccgacgatgccttgttctactcctaaaaaaacccaaagatcctgactttctcttgctgctagcctcccttttcccttctcccttaatcgcactgttggaagctcttcgctgtcacccccacccacctccggcgctcttttttagcattttccttgggctctggactccaaatcccangccttttgtttgcttctctgctcttgnctgattggnngtccccgggtccagaactcttgatgccccctccgcggggggggtttcgggccccatggcggccagctgcgctggcattggcagaaaacagggtggtggccgagctcccaagtggaggtgtgaagacgcccgccgtcgatgcttgcgcggaaggtggcccgtggaagattggcccgcgagaaatgggccggcggggcttggn

SEQ ID NO: 26974 - DNA, 694 bp, Zea mays
  misc_feature: Ceres CLONE 1399979-F
  misc_feature (457)..(457): n is a, c, t, g, unknown, or other
  misc_feature (482)..(482): n is a, c, t, g, unknown, or other
  misc_feature (504)..(504): n is a, c, t, g, unknown, or other
  misc_feature (529)..(529): n is a, c, t, g, unknown, or other
  misc_feature (581)..(581): n is a, c, t, g, unknown, or other
  misc_feature (651)..(651): n is a, c, t, g, unknown, or other
  misc_feature (672)..(672): n is a, c, t, g, unknown, or other
  misc_feature (678)..(678): n is a, c, t, g, unknown, or other
cgctctagaactagtggatcccccgggctgcaggaattcgcacgagaccattacctagaacatcctaatcgaaaagagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggtcgcccctgtgacgatcgaggacgtggacctcagctctcatcaggccgcggncgacgacggggagctcgccgcgcgntggcgggaggtcacgcagcacnaactgggagggtctgctggaccccnatcgacgcgtgctcctccaggagctcatccgctacggcgagttcgcccaggncacctacgacagcttcgactacgaccgcttctcccctactgcggaagctgcagtaaccggggaagacttncttccacgagtcgggctcggnggattngggatacgagtccacc

SEQ ID NO: 26975 - DNA, 717 bp, Zea mays
  misc_feature: Ceres CLONE 1399982-F
  misc_feature: Encodes the peptide sequence at SEQ ID NO. 26976
  misc_feature (435)..(435): n is a, c, t, g, unknown, or other
  misc_feature (436)..(436): n is a, c, t, g, unknown, or other
  misc_feature (457)..(457): n is a, c, t, g, unknown, or other
  misc_feature (494)..(494): n is a, c, t, g, unknown, or other
  misc_feature (570)..(570): n is a, c, t, g, unknown, or other
aaagctggagctccccgcggtggcggccgctctagaactagtggatcccccgggctgcaggaattcgcacgagaccattacctagaacatcctaatcgaaaaactctccaatctcgccgccaagcctcaccgcaccatggcgaccttcaccgcggcctcctccctctccctcctcttctcccacccgcactcccactcccgccaaccatccgcccaggggcccaccgccagctcccacctccacctgcatccgcgcgccagccgcgcgcgctgcgcctcttccgacacgacggccacgaagcaccgccgcccagcggaggagaacatccgcgaggaggcggcgcggctccgaggcccggcccagggtttctctgcgtggtacgagcccttcccgccggcgcccggcggcgacccgaaacgagcgctactcgctgnnacgaggtcgtctaccgtccangctcggggggccctcctcgacgtgcgcacgacatggnaggcgctggcccgctacccggggccctactgggggggactcttcgactcccgggtgggcggaccgcctggcccaanggttcgggcggttgtccaaagaaagaggtcgggctccccgaaatgaaatccaacacaatggtctcccttttggagggaactccaccctttttggggggagggccccggcgggaacacttcgggggaaaagacaactctgggaaaaaa

SEQ ID NO: 26976 - protein, 159 aa, Zea mays
  misc_feature: Ceres CLONE 1399982-F
  misc_feature: SWISSPROT Homolog: EC 4.2.3.1 Threonine synthase
  misc_feature (100)..(100): Xaa is any aa, unknown, or other
  misc_feature (107)..(107): Xaa is any aa, unknown, or other
  misc_feature (120)..(120): Xaa is any aa, unknown, or other
  misc_feature (145)..(145): Xaa is any aa, unknown, or other
MATFTAASSLSLLFSHPHSHSRQPSAQGPTASSHLHLHPRASRARCASSDTTATKHRRPAEENIREEAARLRGPAQGFSAWYEPFPPAPGGDPKRALLAXTRSSTVXARGALLDVRTTWXALARYPGPYWGGLFDSRVGGPPGPXVRAVVQRKRSGSPK

SEQ ID NO: 26977 - DNA, 717 bp, Zea mays
  misc_feature: Ceres CLONE 1399986-F
  misc_feature: Encodes the peptide sequence at SEQ ID NO. 26978
  misc_feature (342)..(342): n is a, c, t, g, unknown, or other
  misc_feature (375)..(375): n is a, c, t, g, unknown, or other
  misc_feature (469)..(469): n is a, c, t, g, unknown, or other
  misc_feature (478)..(478): n is a, c, t, g, unknown, or other
  misc_feature (574)..(574): n is a, c, t, g, unknown, or other
  misc_feature (575)..(575): n is a, c, t, g, unknown, or other
  misc_feature (586)..(586): n is a, c, t, g, unknown, or other
  misc_feature (627)..(627): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (634)..(634): n is a, c, t, g, unknown, or other
  misc_feature (635)..(635): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (641)..(641): n is a, c, t, g, unknown, or other
  misc_feature (642)..(642): n is a, c, t, g, unknown, or other
  misc_feature (648)..(648): n is a, c, t, g, unknown, or other
  misc_feature (649)..(649): n is a, c, t, g, unknown, or other
tacccgcggtggcggccgctctagaactagtggatcccccgggctgcaggaattcgcacgagaccattacctagaacatcctaataaaactgtcccgccgagttcggagcgcagcgcaaggcggggggaggagcaagaagccgccggcctccctcctccggctcaccaccaggcttactccgcaccgcgctgccacgggtaggagcggcgtcaaattcgggattcccaagcggcttcagcccggaggttcagccaaagctattttctaagaaaaatggcggcaatgatggtggcgatgactgcgaggagcaagaacagcatattacccgtggagaagaagcnagggctggtctattcagctaccagagctccggnttcccttgggattcacatgaagacaagggtttctctctgagtctggcaaggatctggactttctcatgggcggcctgttttgccttagcggggntccttaaantggtcgacaggtgcccccagcagtggcgccccgggaccgggtggacaagggaatattaagattccattcactgatattttgggaatggagtacggnncctgaaagggnagtgggggaacacagggttattagcactgaacggaccaatnggnnngnnannngnngtgtgnnttttttctaagggaaaaaaaagccagcccaagaaaacgtggggctgcagctgaaaaaaatttaagatt

SEQ ID NO: 26978 - protein, 46 aa, Zea mays
  misc_feature: Ceres CLONE 1399986-F
  misc_feature (23)..(23): Xaa is any aa, unknown, or other
  misc_feature (34)..(34): Xaa is any aa, unknown, or other
MAAMMVAMTARSKNSILPVEKKXGLVYSATRAPXSLGIHMKTRVSL

SEQ ID NO: 26979 - DNA, 701 bp, Zea mays
  misc_feature: Ceres CLONE 1399987-F
  misc_feature: Encodes the peptide sequence at SEQ ID NO. 26980
aaagctggagctccccgcggtggcggccgctctcgaactagtggatcccccgggctgcaggaattcgcacgagaccattacctagacatcctaatcgaaaaattccactattgtctctctcgaaatcggccgtctctctcccgtccggcacttcctccgatcgactagcctgcggcggcgccggcgccggcgaccagcggccatgcgggtggcacccagggtgctcttcctcgtccgcgacgccgcgggctacggcgctgccctcgccgacgcgctccgcccgccgcccgggctaacgagggagtcctcgcccttcgagctcccccttggaaagtacggcctcgacggagagaaggcgtgcgccgagctcctgagcttttccgattccagtggctctccacaggtgaccatttttgttctgccagactataagccacctcttgcagcgtgtgttgtaaatgaggtcttggaactgatttcttctgaagctacctccactgagcgaactctaattgtcccatacatcacaagatcgtcaagctatcatcatggaacggaacatgcaacaaaggcatcgactgtacttcatggtgcttgaataagggcaaccactgactatactcacctgttggtggaggggacactaaacctcctaactccttgcaaaaacgcagtggaacattatacggtccgcggcaaag

SEQ ID NO: 26980 - protein, 131 aa, Zea mays
  misc_feature: Ceres CLONE 1399987-F
MRVAPRVLFLVRDAAGYGAALADALRPPPGLTRESSPFELPLGKYGLDGEKACAELLSFSDSSGSPQVTIFVLPDYKPPLAACVVNEVLELISSEATSTERTLIVPYITRSSSYHHGTEHATKASTVLHGA

SEQ ID NO: 26981 - DNA, 663 bp, Zea mays
  misc_feature: Ceres CLONE 1399988-F
  misc_feature: Encodes the peptide sequence at SEQ ID NO. 26982
  misc_feature (383)..(383): n is a, c, t, g, unknown, or other
  misc_feature (578)..(578): n is a, c, t, g, unknown, or other
  misc_feature (626)..(626): n is a, c, t, g, unknown, or other
  misc_feature (627)..(627): n is a, c, t, g, unknown, or other
  misc_feature (654)..(654): n is a, c, t, g, unknown, or other
tggagctccccgcggtggcggccgctctagaactagtggatcccccgggctgcaggaattcgcacgagaccattacctagaacatcctaatcgaaaaaacgcatttcgctccccacagcggctcggccacaacccacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacaagctccgccaggttgctgtgtgaagtccaaggttgtcacatggattcagcacaagatttccaacccaggacattcntctataaagttgtggccaccaagtgaaagcacacggatcatgcttgttgacaggatgacaaacaatctgtctacagagtccattttctctcgcaatatcgccttttgggaaagcaagaggctcatgagaatgcaaaaacgattgaagaactttgctttgccttggctgatgagcatttcagaaggagcaaatggntgatgggaagttctgctggtcagctatatgcaaaggaacgagcaaagnnattgtttgaagttctgaaaaagggccnaggactact

SEQ ID NO: 26982 - protein, 52 aa, Zea mays
  misc_feature: Ceres CLONE 1399988-F
MLVDRMTNNLSTESIFSRNIAFWESKRLMRMQKRLKNFALPWLMSISEGANG

SEQ ID NO: 26983 - DNA, 703 bp, Zea mays
  misc_feature: Ceres CLONE 1399990-F
  misc_feature: Encodes the peptide sequence at SEQ ID NO. 26984
  misc_feature (448)..(448): n is a, c, t, g, unknown, or other
  misc_feature (457)..(457): n is a, c, t, g, unknown, or other
  misc_feature (521)..(521): n is a, c, t, g, unknown, or other
  misc_feature (600)..(600): n is a, c, t, g, unknown, or other
  misc_feature (645)..(645): n is a, c, t, g, unknown, or other
  misc_feature (649)..(649): n is a, c, t, g, unknown, or other
  misc_feature (666)..(666): n is a, c, t, g, unknown, or other
aaagctggagctccccgcggtggcggccgctctataactagtggatcccccgggctgcaggaattcgcacgagaccattacctagaacatcctaatcgaaaagtcatagagagccacaggccacaggcaagacaggcaggaggatcggacgagtcggcgaggaagctgcctgcttttcagatagagttattaagatggcgttgcttcggctgcttgccctgatctccctgctcttcgcagtggccactcctgtcagggacatcgcccacgatgcctgctcgtcagaagtgaaggatttccagcacctgaacaacagctcggggctccacctgacgctgcaccacccgcagagcccctgctccccggcgccgctgcccgccgacctcccttctccgcgggctcggccacgacggcgcgcgcatcgcggcgctcgccgcgcgcctcgccnagacgccgncctctcggcccaccttgcttgacgagagccgcgcggggtcgtcgtcgtcgtcccccgatgacgngtcgtccctcgcgtccgtgccgctcggcccggggccgtccgcttgcgggggcgctacgttccccgcgtgggcctcgggncgccggcccagtcgtacgtcgtggccgtgcccccggcgccctttntccnctcgcccccggcgctcntcctgggccgtggttttgtgcccgctgccccgtcctc

SEQ ID NO: 26984 - protein, 94 aa, Zea mays
  misc_feature: Ceres CLONE 1399990-F
  misc_feature (85)..(85): Xaa is any aa, unknown, or other
  misc_feature (88)..(88): Xaa is any aa, unknown, or other
MALLRLLALISLLFAVATPVRDIAHDACSSEVKDFQHLNNSSGLHLTLHHPQSPCSPAPLPADLPSPRARPRRRAHRGARRAPRXDAXLSAHLA

SEQ ID NO: 26985 - DNA, 718 bp, Zea mays
  misc_feature: Ceres CLONE 1399991-F
  misc_feature: Encodes the peptide sequence at SEQ ID NO. 26986
  misc_feature (590)..(590): n is a, c, t, g, unknown, or other
  misc_feature (707)..(707): n is a, c, t, g, unknown, or other
gagctccccgcggtggcggccgctctagaactagtggatcccccgggctgcaggaattcgcacgagaccattacctagaacatcctaatcgaaaagagtccacactccccactccattatctaccatcacactgacacgttcatagctagctagtcttcagctagtaacttacgacgggataatctcgatctgggagcgagggggaggacgacgaccatgaagatgagctccgtgcccgcggtagcgccggtgatggtggtggtggtggtgctgctatctgcagcggcgacgactgtgacgtggcaggcgcttgtgccgggcgtgatgatcttcggcgactcggtgggtgacgccggctacaacaaccggctagcgacgctggtgcgcgccgacttcccgtcctaggggcgcgacttcccggagacgcacgcgccgacggagcggctgctgcaaggacaagctcgacacggactacaccgcgtagagacggatgatgagctcgtacccgtcgctgtaccgtatggaggaggcgcagatgaactacgagagcctgcctcacggcgcctactgcacgtatgacggcagcggntacctggacgcctccggcggcctctacggagccatgtcgctgaacgggggggtgtagcacttctgcaagtacaaatcgcgagtggggagcgacgtccatctgcacgacatcgcggtnatgggtacgaa

SEQ ID NO: 26986 - protein, 62 aa, Zea mays
  misc_feature: Ceres CLONE 1399991-F
MKMSSVPAVAPVMVVVVVLLSAAATTVTWQALVPGVMIFGDSVGDAGYNNRLATLVRADFPS

SEQ ID NO: 26987 - DNA, 661 bp, Zea mays
  misc_feature: Ceres CLONE 1399993-F
  misc_feature: Translation starting site: 219
  misc_feature: SWISSPROT Homolog: EC 5.1.3.2 UDP-glucose 4-epimerase
  misc_feature (492)..(492): n is a, c, t, g, unknown, or other
  misc_feature (610)..(610): n is a, c, t, g, unknown, or other
  misc_feature (644)..(644): n is a, c, t, g, unknown, or other
aaagctggagctccccgcggtggcggccgctctagaactagtggatcccccgggctgcaggaattcgcacgagaccattacctagaacatcctaatcgaaaagctgaactgctgacgcttcgcgcgggtccgaggtcaggcggcagcagcacggagtagcaccagggcgaccgcccaggttatcgtcggccgccggcgacctgtaccccggcgagaagatgcatctgagcgcgaacgaggggatcgagggtctgcgattcgcggtgacgggcgggcagggcttcgtcggagctgccctcagcctcgagctgctccgccgcggtgcccgcgaggtccggtccctcgatctccgcgcctcctcctcctggtcccagcagctcctcgacgccggcgtccgaatcatccaaggggacataagaaagaaggatgatgtgcggaaggctttccgtggagtggactgtgttttccaccttgcttcttatggcatgtcangggaaggagatggtgcagactgggagaatctgatgaggttaatataaatgggacctgcaatgtactggacgcttgcccatgagcagatgtcagaaggcttgtgtatgtagcacatacnatggtggtattcggagggacaggcgatgtcacgnaaatgaggcgttgcctt

SEQ ID NO: 26988 - DNA, 754 bp, Zea mays
  misc_feature: Ceres CLONE 1399995-F
  misc_feature: Encodes the peptide sequence at SEQ ID NO. 26989
  misc_feature (615)..(615): n is a, c, t, g, unknown, or other
  misc_feature (628)..(628): n is a, c, t, g, unknown, or other
  misc_feature (678)..(678): n is a, c, t, g, unknown, or other
  misc_feature (682)..(682): n is a, c, t, g, unknown, or other
  misc_feature (683)..(683): n is a, c, t, g, unknown, or other
aagctggagctcaccgcggtggcggccgctctagaactagtggatcccccgggctgcaggaattcgcacgagaccattacctagaacatcctaatcgaaaaaacttcactcgcgtcgcgcccctccactgcaccagcgtcatggcggtggcctcgacctcgccgctgtccgccaagcccgccacggccccctcgccgcccgctcccggatccgggctcctcgctctcggcgttcgccgcgcccccgccactgccgcgtggaggaggctccgcgtggaggcgatcaggacgcagcgggagaagcagcgggcggaggtgcccgtcgaggagtccgcccccgccagggacgctgccgcgcccctggccggaaacggagccggagccggagcggacggctccgtggttccttcctcggacgacagctgggttgtcaagctcgagcagtcgttcaacattttcgccacggattcggtgattatggtactcaagggcgtgtacggtgatcggtactacgccaggttctttgcgctggagacgattgcgaaggtgccgtacttcgcattcatatcggtgcttcacttgtatgcgaccctttggatgggtggagacgagctgntttatataaaggntcactttgcgcagagctggaaacgagtccatcacctcttgatcatggaangaanntggtgcgacttctttggggttggactgttttctggctcgggttatggcattcttttactacttcatgactg

SEQ ID NO: 26989 - protein, 204 aa, Zea mays
  misc_feature: Ceres CLONE 1399995-F
  misc_feature (159)..(159): Xaa is any aa, unknown, or other
  misc_feature (163)..(163): Xaa is any aa, unknown, or other
  misc_feature (180)..(180): Xaa is any aa, unknown, or other
  misc_feature (181)..(181): Xaa is any aa, unknown, or other
MAVASTSPLSAKPATAPSPPAPGSGLLALGVRRAPATAAWRRLRVEAIRTQREKQRAEVPVEESAPARDAAAPLAGNGAGAGADGSVVPSSDDSWVVKLEQSFNIFATDSVIMVLKGVYGDRYYARFFALETIAKVPYFAFISVLHLYATLWMGGDELXYIKXHFAQSWKRVHHLLIMEXXWCDFFGVGLFSGSGYGILLLLHD

SEQ ID NO: 26990 - DNA, 764 bp, Zea mays
  misc_feature: Ceres CLONE 1400000-F
  misc_feature: Encodes the peptide sequence at SEQ ID NO. 26991
  misc_feature (634)..(634): n is a, c, t, g, unknown, or other
  misc_feature (684)..(684): n is a, c, t, g, unknown, or other
aaagctggagctccccgcggtggcggccgctctagaactagtggatcccccgggctgcaggaattcgcacgagaccattacctagaacatcctaatcaaaaacttttttcctccacacaagcaaggcgctcaacctgccgcccgggaaaaaccctagaccggcgatgtccgtccccggcgcccccgcgggcggcggttcccgcagcttcgacttcggcgccgacgacgtgctctgctcctacgatgacttcgccgcctcgtccgagcccaagcgccccgatccggccgacagtgcgcccgattttcatgatagcagactggggaggccatttgtgaaaccttatgaacaagaaagttatgggaaagaggatgtgctttctgctgttgagaaatgcatgaaaaagtatgctgataatttgctacgatcacttgagggaatcactagtcggctttcgcaactggagatttattgctataagcttgagagatccataggtgaacttcgaagtgatgtgcttcgtgatgagactgaccataggttgaagtctcttgagaaacatctaaatgaagtacacaggtctatccaaattcttagggacaaacaggagttagctgaagctcagaaggaattggncaaatttcagcttacacaagatacatctaaaaagaaggaagatgtaccancatttattcctgagcaaaagaaagctgaaagaaaacctgacacatcaaaccagcatttgggctcttggttttgcctcatc

SEQ ID NO: 26991 - protein, 200 aa, Zea mays
  misc_feature: Ceres CLONE 1400000-F
  misc_feature (157)..(157): Xaa is any aa, unknown, or other
  misc_feature (174)..(174): Xaa is any aa, unknown, or other
MSVPGAPAGGGSRSFDFGADDVLCSYDDFAASSEPKRPDPADSAPDFHDSRLGRPFVKPYEQESYGKEDVLSAVEKCMKKYADNLLRSLEGITSRLSQLEIYCYKLERSIGELRSDVLRDETDHRLKSLEKHLNEVHRSIQILRDKQELAEAQKELXKFQLTQDTSKKKEDVPXFIPEQKKAERKPDTSNQHLGSWFCLI

SEQ ID NO: 26992 - DNA, 695 bp, Zea mays
  misc_feature: Ceres CLONE 1400001-F
tcaccgcggtggcggccgctctagaactagtggatcccccgggctgcaggaattcgcacgagaccattacctagaacatcctaatcgaaaaacagcgagtaccgagtaggagcaaccgcttgcgtcagacgcacactgacggagagtgatcactgatttctggtcatggcaaccgtaactgaggaagttgctccggtcgtcaccgtctccgaggagccggcgccggaagcggcgaaggaggtgggggaagaagcccggaggaggggaagaagcccgacgaggagggtgacgagagaaagaaggccgaccccgccgccgagaaggagaagaaggcgaggaagcggggctgcgagggatgcgctcgccggtgggccgaagttggggctaagcttgggctgtgcacagtcgagaagacggaggcaaggccagtcactccattcacgctgtgcatgtcacccaaggcgcggcctcccaatctcgagcctaacttttcacggaggggttaatggattttggcagcaggggaatccccccggagattgtgcctccttggaaaagggcttctttcttgccaactacatattttcaaattttggatgaccattaaatcgtcccggggttccttggttctcatctttttaaccctcttgtagttacacaaaacccacctttgattgtgctaacaagaccccaaa

SEQ ID NO: 26993 - DNA, 614 bp, Zea mays
  misc_feature: Ceres CLONE 1400003-F
  misc_feature: Encodes the peptide sequence at SEQ ID NO. 26994
  misc_feature (283)..(283): n is a, c, t, g, unknown, or other
  misc_feature (345)..(345): n is a, c, t, g, unknown, or other
  misc_feature (351)..(351): n is a, c, t, g, unknown, or other
  misc_feature (357)..(357): n is a, c, t, g, unknown, or other
  misc_feature (370)..(370): n is a, c, t, g, unknown, or other
tggagctccccgcggtggcggccgctctagaactagtggatcccccgggctgcaggaattcgcacgagaccattacctagaacatcctaatcgaaaaaccagaaacccgcgaatcaatcccgaatcccgatcgaccggcggcgcgggaggcgatgccggacaaggcggtggacgacgtcatggaggccgcggtgggggcccacttcagcggcctccgcctcgaggcgctgcgcctctccacctctgcgccctcttccccttcctcctccgccgccgccgcggngcacacgcactccaacgggagccgtctacgcctacggcaccaccgagcttccctctcctggncgctgnccggcnagcattcgtcatncgggttttctggagggacggcgtcggggaaagacgacggtggtgcgacatgatcatcccagcaggttgcacgaaccaccgggggtgcgggttcgttaaccaggattctttttaccggggcctttgggggaaaaaatgggcacccgcccaaaaaatatttttggtccccccggggggttttaaaccaagaaattttaaaagggcggggggccctgaaaggggcccacccggaaggggcccaattt

SEQ ID NO: 26994 - protein, 89 aa, Zea mays
  misc_feature: Ceres CLONE 1400003-F
  misc_feature (44)..(44): Xaa is any aa, unknown, or other
  misc_feature (65)..(65): Xaa is any aa, unknown, or other
  misc_feature (67)..(67): Xaa is any aa, unknown, or other
  misc_feature (69)..(69): Xaa is any aa, unknown, or other
  misc_feature (73)..(73): Xaa is any aa, unknown, or other
MPDKAVDDVMEAAVGAHFSGLRLEALRLSTSAPSSPSSSAAAAXHTHSNGSRLRLRHHRASLSWXLXGXHSSXGFSGGTASGKDDGGAT

SEQ ID NO: 26995 - DNA, 745 bp, Zea mays
  misc_feature: Ceres CLONE 1400016-F
  misc_feature: Encodes the peptide sequence at SEQ ID NO. 26996
aaagctggagctccccgcggtggcggccgctctagaactagtggatcccccgggctgcaggaattcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatggcggcggcgccagcgctcgcgcgggagctgctggacgcggcgcgggagccggagttcgcggagtggcagcgcggcgtgcggcgccggatccaccagcacccggagctggccttccaggagcaccgcaccagcgcgctcgtgcgcgccgagctcgacgcgatcggcgtcccgtacgcctggcccgtcgcgcagacgggcgtcgtggccaccatcaccggccccgccgcgggccccgtgttcgcgctccgcgccgacatggacgcgctccccatccaggaaatggtagaatgggagttcaagagcaaggaagacgggaagatgcatgcgtgcggccatgacgcccacgtggcgatgcttcttggagcagctaggttgcttcagtctcggagggacgatttaaaggtactgatagtttttttggctggcttttttggcagagatatttcagtaatccgttctactacgtacaggtgtgaagcttaatttggtt

SEQ ID NO: 26996 - protein, 161 aa, Zea mays
  misc_feature: Ceres CLONE 1400016-F
  misc_feature: SWISSPROT Homolog: EC 3.5.1.14 Aminoacylase
MAAAPALARELLDAAREPEFAEWQRGVRRRIHQHPELAFQEHRTSALVRAELDAIGVPYAWPVAQTGVVATITGPAAGPVFALRADMDALPIQEMVEWEFKSKEDGKMHACGHDAHVAMLLGAARLLQSRRDDLKVLIVFLAGFFGRDISVIRSTTYRCEA

SEQ ID NO: 26997 - DNA, 764 bp, Zea mays
  misc_feature: Ceres CLONE 1400018-F
  misc_feature: Encodes the peptide sequence at SEQ ID NO. 26998
  misc_feature (478)..(478): n is a, c, t, g, unknown, or other
  misc_feature (633)..(633): n is a, c, t, g, unknown, or other
  misc_feature (634)..(634): n is a, c, t, g, unknown, or other
  misc_feature (732)..(732): n is a, c, t, g, unknown, or other
  misc_feature (752)..(752): n is a, c, t, g, unknown, or other
aagctggagctccccgcggtggcggccgctctagaactagtggatcccccgggctgcaggaattcgcacgagaccattacctagaacatcctaatcgaaaaagtcgtccctgtccctccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcggccccgagccgtcgcgcggtcgcctccacatctcgtcgtgctttaaggtctttggcctccgccgttcttggacaggggcacaccactgtccaccggtgcccactacgcgaaatacgagtccctcgtgcggctccgtagggtggaagagatccatcaggcggtgagtgggaaggggcggcgtccacacaaccggagggggaggggggcaatgggcggncgtggcaggcccactctgcacgtgggctcgtcgccgcgtgcttatctgcggcatgcgacgctgaagagcacaagcagaagcatttctgcgcaggcggaagccgcgcttggggggcggtgtcatgctcggccagcgccgccgcctcggcgcgcggnngtcgcggcttggcgcgctctggatggactatggctggtgccttacaagctgaaaagagtgtcattgaaaagaagaaaccgatatcaacaaggggaggntgggttgtcactggcatggntgtagtgacacc

SEQ ID NO: 26998 - protein, 33 aa, Zea mays
  misc_feature: Ceres CLONE 1400018-F
  misc_feature (30)..(30): Xaa is any aa, unknown, or other
MAGALQAEKSVIEKKKPISTRGGWVVTGMXVVT

SEQ ID NO: 26999 - DNA, 894 bp, Zea mays
  misc_feature: Ceres CLONE 1400020-F
  misc_feature (13)..(13): n is a, c, t, g, unknown, or other
  misc_feature (21)..(21): n is a, c, t, g, unknown, or other
aacccccccctcncacccccnatgattagcacacaacctcaaactgaaactccacgcgctggcggccgctctacaatagtggatcccccggcctgcaggagttcgcacgagaccattacctacaacatcctaatccaaaaacaccaacccgaatctgcctccgcttctatcatggcgaggccagcgctttcgtcgccgccatcaacggtgtagctatctcctccctatccggagtccgcgatgctcgccacccctcctcccccaagcgccggacgctcgcacatgctcgcctccctcccctccggtccgcctcaatccccttacgcccttccgtcacgtgctctttggaaaaaaggtccagcacccccaaactccccagcggggccatctcgcccaccctcttactggacgccggatccccgccgtccccaccaattcgacctgtgtatggatcatcaaacccacccccattcatggcctcagaaagagacattttctcgcacaccgtaccgccgggcgccggtccacccttcacgcccgggacatccaaaaaacagcccccgcagccggatatcccaataacgctctttcctcacccctatccggttggccattcctccccaatccaccatctcccccttagaaatacccacaaattacccgcgtacgaacaaaaggacaaaaccattgagagcctggaaccacaccccttcctaggcgacaccaaacactcacccatccgtgaaaaccaccccgcgggacccccctatgaacgggggggtcctccccaattccttcgtccgagggtacacacgggtggaacaacaccccccatccgtggccaacccgcaagtatacccctctaagtcatattactggggaaagccaaaccgt

SEQ ID NO: 27000 - DNA, 696 bp, Zea mays
  misc_feature: Ceres CLONE 1400022-F
  misc_feature: Translation starting site: 146
  misc_feature: SWISSPROT Homolog: EC 1.11.1.6 Catalase
gctctagaactagtggatcccccgggctgcaggaattcgcacgagaccattacctagaacatcctaatcgaaaaatgtaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatccccggagcgcgtggtgcacgcgcgcggggcctccgccaagggcttcttcgagtgcaccccacgacgtggacgtcgctgacgtgcgccgacttcctgcgcgcgcccggcgtgcgaacgccccgtgatcgggcgcttcctcgacgtggtcccccgaaggggggttcccccggaaacgatccgggaaccggggggggtttccccgggggaaagtctaccccccgcgaggggcaacggggaaccctggtgggcaaaaattttccccgttttttttgttccggggacgggttcaagttccccccgagggggacgcccccggggtaaggcgccaacccccggggcgggacgggggagaggaggcactgcggcgcggacgg

SEQ ID NO: 27001 - DNA, 669 bp, Zea mays
  misc_feature: Ceres CLONE 1400023-F
  misc_feature: Encodes the peptide sequence at SEQ ID NO. 27002
  misc_feature (472)..(472): n is a, c, t, g, unknown, or other
  misc_feature (491)..(491): n is a, c, t, g, unknown, or other
ggagctccccgcggtggcggccgctctagaactagtggatcccccgggctgcaggaattcgcacgagaccattacctagaacatcctaatcgaaaaaccactgctgcccacggccacccacaccacaccacaccaatacaccataccagaaggagcaaaaataagacgagatggcggacgagcgcttgcctcaaacggccggcgcccgcacggctctcgccagagctactggatcctcggcacggaaacgcgcccgcgatagttaggtgcgcctgtgggcccggccggctcgtcacttacataggcgcacgcacccccgcctggtgcgtcgtcgatcgctgctttgctggcgcgcggcggccctgtgtggcacagtagaggtctgctgaggacgacgaccggaggcgtgctgcgtggatggtcctcatggccgggatgctccccggcgtggagtgcgcgcgtcggcgccggntccggcagggcggtgcggngatgggagcggaggcggccggaggaggcacggggcggcggtcctccttctgcctgtacgcgggcggccacggtggcgccgtcaattctgcaaacgtagcgccggggtggtgcacgggcccgggtgaaccctggacagcaatgccccggaggcccaaggagcggctgaacccaaaactg

SEQ ID NO: 27002 - protein, 84 aa, Zea mays
  misc_feature: Ceres CLONE 1400023-F
  misc_feature (19)..(19): Xaa is any aa, unknown, or other
  misc_feature (25)..(25): Xaa is any aa, unknown, or other
MVLMAGMLPGVECARRRRXRQGGAXMGAEAAGGGTGRRSSFCLYAGGHGGAVNSANVAPGWCTGPGEPWTAMPRRPKERLNPKL

SEQ ID NO: 27003 - DNA, 656 bp, Zea mays
  misc_feature: Ceres CLONE 1400026-F
  misc_feature: Encodes the peptide sequence at SEQ ID NO. 27004
  misc_feature (409)..(409): n is a, c, t, g, unknown, or other
  misc_feature (412)..(412): n is a, c, t, g, unknown, or other
  misc_feature (453)..(453): n is a, c, t, g, unknown, or other
gctggagctcaccgcggtggcggccgctctagaactagtggatcccccgggctgcaggaattcgcacgagaccattacctagaacatcctaatcgaaaaaagaccatttgttggttcgcgtcgcatcgtgttatcgtgcgtagaatcggtagtagacaaaacgggcagcaaaccgcgccaagaatttccacacagatttcaacagagatgatgggctcgcccgccgctgatgctgcacttcctgatggctcggacgacgagccgctgactgtggggcctcgcggtcccatcctgctggaggactaccacctgatcgagaaggtggcgcacttcgcgcgcgagcgcatcccggagcgcgtgccgcacgcgcgcggggcctccgccaagggcttcttcgagtgcacccacnacntgacgtcgctgacgtgcgccgacttcctgcgcgcgcccggngtgcggacgcccgtgatcgtgcgcttctcgacggtgatccacgagcggggttccccggagacaattcgcgacccgcgcgggttccccgtgaagttctaccccgcgaggggaattgggacctggctggcaacaatttccccacttccttcttccgcgacggattaggattcccccacctgattccacggttcaagcaccacccc

SEQ ID NO: 27004 - protein, 136 aa, Zea mays
  misc_feature: Ceres CLONE 1400026-F
  misc_feature (6)..(136): Pfam Name: Catalase Pfam Description: Catalase
  misc_feature: SWISSPROT Homolog: EC 1.11.1.6 Catalase
  misc_feature (68)..(68): Xaa is any aa, unknown, or other
  misc_feature (69)..(69): Xaa is any aa, unknown, or other
MMGSPAADAALPDGSDDEPLTVGPRGPILLEDYHLIEKVAHFARERIPERVPHARGASAKGFFECTHXXTSLTCADFLRAPGVRTPVIVRFSTVIHERGSPETIRDPRGFPVKFYPARGIGTWLATISPLPSSATD

SEQ ID NO: 27005 - DNA, 703 bp, Zea mays
  misc_feature: Ceres CLONE 1400027-F
  misc_feature: Encodes the peptide sequence at SEQ ID NO. 27006
  misc_feature (457)..(457): n is a, c, t, g, unknown, or other
  misc_feature (474)..(474): n is a, c, t, g, unknown, or other
aaagctggagctccccgcggtggcggccgctctagcaatagtggatcccccgggctgcaggaattcgcacgagaccattacctagaacatcctaatcgaaaactctgctcttcctgtttagggtttccccctctctctgctcccgccggatgcgatggcgattccgccgcggactccttccccgccgccatcgtggtcgcgctctgtaaccgagaccgttcgggggtcccaccagttcaccgtacggggctactccctcgccaagggcatgggccccggccgctacctcgccagcgacgtcttcgccgtcggaggataccactgggccgtctacctctaccccgacggcaagaacgccgaggacaactccaactacgtctccgttttcgttgccctcgcttccgacggcatcgacgtccgagccctcttcgagctcaccctcctcgaccagtccggncgcggctgccacaaggntcactcgcactttgaccgctcgctcaagtccggcccatacacccctcaggacagggggatccatggtggcgttcaagcgcttctaaaacaaaaaactcttggagaaactgatttctcaacaattggttgttagggataacgggccccgcggcggggtcgcgcaccgttaaaaatcccaaagaactctcaaattgcggagggtaggaacacgggtgtcggtcccctttat

SEQ ID NO: 27006 - protein, 150 aa, Zea mays
  misc_feature: Ceres CLONE 1400027-F
  misc_feature (107)..(107): Xaa is any aa, unknown, or other
MAIPPRTPSPPPSWSRSVTETVRGSHQFTVRGYSLAKGMGPGRYLASDVFAVGGYHWAVYLYPDGKNAEDNSNYVSVFVALASDGIDVRALFELTLLDQSGRGCHKXHSHFDRSLKSGPYTPQDRGIHGGVQALLKQKTLGETDFSTIGC

SEQ ID NO: 27007 - DNA, 669 bp, Zea mays
  misc_feature: Ceres CLONE 1400028-F
  misc_feature: Encodes the peptide sequence at SEQ ID NO. 27008
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (535)..(535): n is a, c, t, g, unknown, or other
  misc_feature (536)..(536): n is a, c, t, g, unknown, or other
  misc_feature (542)..(542): n is a, c, t, g, unknown, or other
  misc_feature (543)..(543): n is a, c, t, g, unknown, or other
  misc_feature (545)..(545): n is a, c, t, g, unknown, or other
  misc_feature (547)..(547): n is a, c, t, g, unknown, or other
  misc_feature (548)..(548): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (556)..(556): n is a, c, t, g, unknown, or other
  misc_feature (557)..(557): n is a, c, t, g, unknown, or other
  misc_feature (565)..(565): n is a, c, t, g, unknown, or other
  misc_feature (566)..(566): n is a, c, t, g, unknown, or other
  misc_feature (571)..(571): n is a, c, t, g, unknown, or other
  misc_feature (572)..(572): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (582)..(582): n is a, c, t, g, unknown, or other
  misc_feature (587)..(587): n is a, c, t, g, unknown, or other
  misc_feature (590)..(590): n is a, c, t, g, unknown, or other
  misc_feature (593)..(593): n is a, c, t, g, unknown, or other
  misc_feature (621)..(621): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (639)..(639): n is a, c, t, g, unknown, or other
  misc_feature (640)..(640): n is a, c, t, g, unknown, or other
aaagctggagctccccgcggtggcggccgctctagaactagtggatcccccgggctgcaggaattcgcacgagaccattacctagaacatcctaatcaaaaattcctcatccagtgttctgtcctagcgccgccgccgccccagctcgccttgcgtgactgagagctcgtcggcttccgtccacgcgtgaagcgagagcatggacacccaggtgaagcttgctgttgtggtgaaggtgatggccaggaccggctccaggggtcaggcgacccaggtcagagtgaagtttttggatgaccagaaccggctcatcatgaggaatgtcaaggggcccggttcgcgagggtgacatcctcaccctgctcgagtccgagagggaggccaggaggctgcgctgaagccctagcgttcttggtgcgctcttgtatgggtctttggagtcttggaatttgtgctatgtttgaacttctgtgaccctgttttaagagtagtaagcctggtattagatttgcagcttttgtttnnnannnnnccnnttgccnngncnncnnncgcnnactgaaannccgcnncnnncgcctntttcnccnggntctcctctgcggggggcgggggcccccngggcgccccctnnnnccnnctttgttctcttctccgccgcctgcgggg

SEQ ID NO: 27008 - protein, 49 aa, Zea mays
  misc_feature: Ceres CLONE 1400028-F
  misc_feature (1)..(49): Pfam Name: Ribosomal_S28e Pfam Description: Ribosomal protein S28e
MDTQVKLAVVVKVMARTGSRGQATQVRVKFLDDQNRLIMRNVKGPGSRG

SEQ ID NO: 27009 - DNA, 678 bp, Zea mays
  misc_feature: Ceres CLONE 1400029-F
  misc_feature: Encodes the peptide sequence at SEQ ID NO. 27010
  misc_feature (408)..(408): n is a, c, t, g, unknown, or other
  misc_feature (431)..(431): n is a, c, t, g, unknown, or other
  misc_feature (462)..(462): n is a, c, t, g, unknown, or other
  misc_feature (468)..(468): n is a, c, t, g, unknown, or other
aaagctggagctccccgcggtggcggccgctctagaactagtggatcccccgggctgcaggaattcgcacgagaccattacctagaacatcctaatttaaaaatagtcactcccccaactctggtgcttcccgtggtcgtggttcaaaattcgaatccagaaagacttccccaagcattttccgattctttaaaccgccatcgtgctccctcgtgctagcctcgctcgttgcgggttcaaatttcgaaccacctccgtcttcgacgccccaaaccctagcccgacccctccgtcctccacctgcgccaccgcccaccatgagctccgccgccgcgccagctgccgtcggcagcggcaaggagcttgccaacccgcccgccgacggaatcaccaacctccgcttctccnaccacagcaacaacctcctcgcntcctcaggggacaagacggtgcggctctacnacgccnacgccacgtgctcaaaggggaagttcatgacccccggagccgtcctcgactgctgctttcacgacgactcctcgggctttagcgccggtgccgacaccccgtggccggagggtgggaatttagctcgcccaaggaaagatgttttggggcgattggatggtcccggtccggttgggtggaatacctttatgctggaagtcaagtcatcac

SEQ ID NO: 27010 - protein, 120 aa, Zea mays
  misc_feature: Ceres CLONE 1400029-F
  misc_feature (31)..(31): Xaa is any aa, unknown, or other
  misc_feature (49)..(49): Xaa is any aa, unknown, or other
  misc_feature (51)..(51): Xaa is any aa, unknown, or other
MSSAAAPAAVGSGKELANPPADGITNLRFSXHSNNLLASSGDKTVRLYXAXATCSKGKFMTPGAVLDCCFHDDSSGFSAGADTPWPEGGNLARPRKDVLGRLDGPGPVGWNTFMLEVKSS

SEQ ID NO: 27011 - DNA, 717 bp, Zea mays
  misc_feature: Ceres CLONE 1400030-F
  misc_feature: Encodes the peptide sequence at SEQ ID NO. 27012
acagctggagctccccgcggtggcggccgctctattactagtggatcccccgggctgcaggaattcgcacgagaccattacctagaacatcctaatcgaaaagacaaacacgagcgcgggcgcgcacaagttcgccaacccccaccccccacccccccgtgtggtgcgcgtcgttggaaccaaggattggattatcctccccgaggaggaggtggtggtcggcgaggggctcgaggggtatggatcatttcgaggctccttgtggtggagatgacggtgccgctgtggatcgccgctttcgatgccaacggcgagtacctggagcactgctgctcggcgacggctcgccggtgtcgcgggagcagccgctggtcaacgaggacagcgccgtcctgatggtggacatgggacagatccacaagcacatgacggtgctagagtcagacataggagagcgatctcttgaactgaagcaatgggaggatggccttctggccctggagcaagccattgaagagaaatttcagggtattacctctatgctggacgagattgcttccctccaggcaaaagggactgtatctgccggagagcacggctactaggccaatgcccaggttgtttgagcttgagacggggtgacaaaataaaaaggattttttagcccccacgaccactaatgcggcctaggttatatggccacgagccggaaaaaag

SEQ ID NO: 27012 - protein, 121 aa, Zea mays
  misc_feature: Ceres CLONE 1400030-F
MDHFEAPCGGDDGAAVDRRFRCQRRVPGALLLGDGSPVSREQPLVNEDSAVLMVDMGQIHKHMTVLESDIGERSLELKQWEDGLLALEQAIEEKFQGITSMLDEIASLQAKGTVSAGEHGY

SEQ ID NO: 27013 - DNA, 805 bp, Zea mays
  misc_feature: Ceres CLONE 1400030-R
  misc_feature: Encodes the peptide sequence at SEQ ID NO. 27014
ttccgattgggtaccgggccccccctcgaggtcgacggtatcgataagctttttttttttttttgacggctaaaccgaccactcgtcactcaactaataagttaaaatgcaggtcggctacaaaaacaagcatacggactcacacgctttccccagttacaataaacaaatgaccaatcatactaaagacgaggcatcacctcctgaacccggcaaactgcacataaaaggtctgctgccctgaagtccatatatacagcgctgggtacggaaatgccaaagacaacatcatgttggtcggtgtacaatgcattctctacgtaagggtgcccatgacccaatcctgctcaaaaatctgccccggtacgaaagcatactgaaccctaaagtgatgagcaaaatgatctacttgtcagcaatgccgcctcttgaatctcatcgtggccatcgttaacattaccactaccagggcccttgtatccccttcggaggacaacgtcccttctacaaccctgtgtataatgaagacaggatcatccagaagagatgaagccaccaaccggactaactcatgacttgccaatgatcttgctatatcacgctggtgaaggtatgccatgaatcttgcttgagcctgtcaatggtatgtggttgacgactgaagaaagacccctctgatgaactgctctcttagaggcggcttcatagaagtctattttctcacacgtgggtaggaatctaccaatcgatcagtacggctataaacttatgatttacgggtctaggatgaaaacattcacttgaa

SEQ ID NO: 27014 - protein, 45 aa, Zea mays
  misc_feature: Ceres CLONE 1400030-R
MQVGYKNKHTDSHAFPSYNKQMTNHTKDEASPPEPGKLHIKGLLP

SEQ ID NO: 27015 - DNA, 683 bp, Zea mays
  misc_feature: Ceres CLONE 1400034-F
  misc_feature: Encodes the peptide sequence at SEQ ID NO. 27016
  misc_feature (505)..(505): n is a, c, t, g, unknown, or other
  misc_feature (585)..(585): n is a, c, t, g, unknown, or other
  misc_feature (638)..(638): n is a, c, t, g, unknown, or other
  misc_feature (639)..(639): n is a, c, t, g, unknown, or other
ggagctccccgcggtggcggccgctctagaactagtggatcccccgggctgcaggaattcgcacgagaccattacctagaacttcctaatcgaaaaaccagaccgccgtcgctcgctcgcctgcacaacctctccatccaggccacagctcgagaccaacgaccgacgcctagacgcggctgggcggtcggcctcacctcgttcccccgcctcccttcttcctgctccgcgtctcgatctcgactcccccgccgcgtcgcgcgacccggccagatctcgcccaccctgcgccgcggccatggataacttgatcaccctcgtcaacaagctgcagagggcttgcacggctctcggagaccacggagaggagagcgccctcccgacgctctgggactcgctgccggctatcgccgtcgttggaggacagagctctggtaaatcatctgtgttggagagcgtggttgggaaggatttcctaccgaaggggttcaggcattgtaacccnggcggcctctggtgctgcagctccacagaattgatggtgacagggaattatgcagagttcatgcatcttccgagaaaganatttacagattttgctgctggtgagaagggagatagctgatgaaatgaccgannaaacaggccgttcaagcaaaatatcaactgtccctatcctttta

SEQ ID NO: 27016 - protein, 108 aa, Zea mays
  misc_feature: Ceres CLONE 1400034-F
  misc_feature: SWISSPROT Homolog: EC 3.6.5.5 Dynamin GTPase
  misc_feature (96)..(96): Xaa is any aa, unknown, or other
MDNLITLVNKLQRACTALGDHGEESALPTLWDSLPAIAVVGGQSSGKSSVLESVVGKDFLPKGFRHCNPGGLWCCSSTELMVTGNYAEFMHLPRKXFTDFAAGEKGDS

SEQ ID NO: 27017 - DNA, 713 bp, Zea mays
  misc_feature: Ceres CLONE 1400039-F
  misc_feature: Encodes the peptide sequence at SEQ ID NO. 27018
  misc_feature (382)..(382): n is a, c, t, g, unknown, or other
aaagctggagctccccgcggtggcggccgctctacaactagtggatcccccgggctgcaggaattcgcacgagaccattacctagaacatcctaatcgaaaaaaggttgttttgttgcttccttgtcccgctctcaccagcaatcccgtcgatcacccagacctccacggcactgctccgtctcctccgttccgttccgaaccgcaagctcccaacccttccgcgatggacctcacctcgccgtcgcccgcggcgcgccgcgccgccgccatcgcgcgccacctcgccgcagccgccgcccccatcccggcgagcagcgccctggaaccttcctgctgcctcagctacgtcccgccggagtccacggagcggccggcggcgnttgcgccggccgacctcaggcttctgctggacgggcacgacctgcccacgcgggactggctcttccgcgccatggaggagagcccccttttccgcagccggagttcgcggacgggatccagggtggtcggggggccgcacttcaacgacgccatagaaagggcaccgcgacgcccccgatgccgagcaaccgcggaatctggaacgggcgcggcgtggctccgcggcaggcctaacctagtactccctcctaaccgccggacaggagtggtggatccgctggatcaggacacacgcgccggcgaagggccggggaggcacgccccccgaat

SEQ ID NO: 27018 - protein, 162 aa, Zea mays
  misc_feature: Ceres CLONE 1400039-F
  misc_feature (53)..(53): Xaa is any aa, unknown, or other
MDLTSPSPAARRAAAIARHLAAAAAPIPASSALEPSCCLSYVPPESTERPAAXAPADLRLLLDGHDLPTRDWLFRAMEESPLFRSRSSRTGSRVVGGPHFNDAIERAPRRPRCRATAESGTGAAWLRGRPNLVLPPNRRTGVVDPLDQDTRAGEGPGRHAPR

SEQ ID NO: 27019 - DNA, 715 bp, Zea mays
  misc_feature: Ceres CLONE 1400044-F
  misc_feature: Encodes the peptide sequence at SEQ ID NO. 27020
gcggtggcggccgctctagaactagtggatcccccgggctgcaggaattcgcacgagaccattacctagaacatcctaatcgaaaaggcagtcggacctcgggtctcgacgtctcgtctcgcctcgtctcgcctgcccgcagccccttgctttcgtgtccatccggcttctccgagccccgggacaggaccgggatggcgtaccgtatgctgcgagacgcgcatgcggacggattgccactgcctgcccttccccatcatctgccgagtcatgcctcggatactacccctacgatcctccatgctacgagctgactaggacaaaaactgcagaatttgcgcacgcccttttactgtattccgacgacgtcctgggcgagatgaacttgactgtaacactgaaatctgccagacatgttgcaagctaaagaatgtccgacatctctgcctgatggatcttgaatatgccctgcctgtacgggtccgagatgcatcactctctatctcttccgatgatgcatatccctggagtgatgtcaatcgcgattattttgctacatagcgtgataggaggcacagagctggctgatactatgattcatcctatgggaaagctcgtcccaatgatacgattctgaagcttcaatggacttcaccgactgacttgaggaccagagctcatgtttgcagtttccttgaggcgagtgaatgcacaa

SEQ ID NO: 27020 - protein, 36 aa, Zea mays
  misc_feature: Ceres CLONE 1400044-F
MDLEYALPVRVRDASLSISSDDAYPWSDVNRDYFAT

SEQ ID NO: 27021 - DNA, 712 bp, Zea mays
  misc_feature: Ceres CLONE 1400048-F
  misc_feature: Translation starting site: 229
  misc_feature (400)..(400): n is a, c, t, g, unknown, or other
  misc_feature (420)..(420): n is a, c, t, g, unknown, or other
  misc_feature (430)..(430): n is a, c, t, g, unknown, or other
aaagctggagctccccgcggtggcggccgctctagaactagtggatcccccgggctgcaggaattcgcacgagaccattacctaacatcctaatcgaaaaatccatcaaagtcacagagacgaccagctgaagcgaacacagagctgctcgccgtgtaacgcagcaggcagcagcacccagaggcggcaggtcacacacacagcacacgcagatcttcgatcaccaccatgggttctctcggcagcgccgcgcagcagcagcagcaaccgcacgccgtgtgcctgccgtacccagcgcagggccacatcaccccgatgctcaacgtggcgaagctgctgcacgcccggggcttccacgtcaccttcgtcaacaccgagtacaaccaggcgcgcctcgtcnggaccccgcggggcggcggncgtggccggnctcccgggcttccgcttcgccaccatccccgacggcctgggcgcgtcggaggacgacgacgtcacgcaggacatcccctcgttgtgcaagtccaccacggagacctgcctcgatcccttcggccgctgctcgcggacctcagggacccgcccgtcacctgcggcggctcggaagggggcatggggtttctccatcgacgccaccaaaaagttgggcctccccaagttcaggtcgggaccgccaggacattcggttcctgggttaccgccataccaccttctg

SEQ ID NO: 27022 - DNA, 712 bp, Zea mays
  misc_feature: Ceres CLONE 1400051-F
  misc_feature: Encodes the peptide sequence at SEQ ID NO. 27023
  misc_feature (650)..(650): n is a, c, t, g, unknown, or other
  misc_feature (651)..(651): n is a, c, t, g, unknown, or other
  misc_feature (677)..(677): n is a, c, t, g, unknown, or other
aaactggagctcaccgcggtggcggccgctctagaactagtggatcccccgggctgcaggaattcgcacgagaccattacctagaacatcctaatcgaaaaattccaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggctcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtggtacttcttctcgccgcgcgaccgcaagtacccgaatggctccaggcctaaccgggcggccgggacagggtactggaaggccaccggcgccgacaagccggtagggtcgccgcgccccgtggccatcaagaaggcgctcgtcttctacgccgggaagccgcccaagggcgtcaagaccaactggatcatgcacgagtaccgcctcgcggacgtcgaccgctcggnncgcgcacgcaagaagaccacaacgcngctcagctgggatgactgggtgctgtgcccgatca

SEQ ID NO: 27023 - protein, 160 aa, Zea mays
  misc_feature: Ceres CLONE 1400051-F
  misc_feature (9)..(134): Pfam Name: NAM Pfam Description: No apical meristem (NAM) protein
  misc_feature (140)..(140): Xaa is any aa, unknown, or other
  misc_feature (149)..(149): Xaa is any aa, unknown, or other
MDCGGSLQLPPGFRFHPTDDELVMYYLLRKCGGLPLAAPVIAEVDLYKFDPWQLPEKAFGGEKEWYFFSPRDRKYPNGSRPNRAAGTGYWKATGADKPVGSPRPVAIKKALVFYAGKPPKGVKTNWIMHEYRLADVDRSXRARKKTTTXLSWDDWVLCPI

SEQ ID NO: 27024 - DNA, 732 bp, Zea mays
  misc_feature: Ceres CLONE 1400054-F
  misc_feature: Encodes the peptide sequence at SEQ ID NO. 27025
  misc_feature (636)..(636): n is a, c, t, g, unknown, or other
  misc_feature (658)..(658): n is a, c, t, g, unknown, or other
aaagctggagctccccgcggtggcggccgctctataactagtggatcccccgggctgcaggaattcgcacgagaccattacctagaacatcctaatcgaaaaacattattcaggtccaggtcacatgatgcacagacagcccgtccgacgccgcgttagctacttgcctacttcagctatatgaaacggcaaaagtcttcccctcgttccccaatctcctctccatcgaaaccctagcacgacgcaattcccgtcttcccacgccgtgtcgccgttgctatgggcaagaagcggaagctcgagcccaaatcggcggcagggttcacgccggttaaggcctccccgaccaccaggtctgccaccgctaaggccgctggtctatccgaggtcctcgcccccgtcgaggctacgatggagaagctgccgcagggggcaggcggcgaggatgtagaggaaatcgaggaggtggaggtcgaggaggaagtggaagtggaagaggaagaagaaggcgagagcgaccaggcttcgatccaggcgctggctggattcgttccccaagggaccagctcgtcgagctgttacgcgacgctgccatcgttccacggcgacgtgctaaccacaatcccggcgcgtggncgacgccgacccggctcagcgnaagatcttcgtacacgggcctcggctgggacaccacaaccgacaccctcaccgaggccttcggcccatacgggg

SEQ ID NO: 27025 - protein, 151 aa, Zea mays
  misc_feature: Ceres CLONE 1400054-F
  misc_feature (127)..(127): Xaa is any aa, unknown, or other
MGKKRKLEPKSAAGFTPVKASPTTRSATAKAAGLSEVLAPVEATMEKLPQGAGGEDVEEIEEVEVEEEVEVEEEEEGESDQASIQALAGFVPQGTSSSSCYATLPSFHGDVLTTIPARGRRRPGSAXDLRTRASAGTPQPTPSPRPSAHTG

SEQ ID NO: 27026 - DNA, 627 bp, Zea mays
  misc_feature: Ceres CLONE 1400056-F
  misc_feature: Encodes the peptide sequence at SEQ ID NO. 27027
gctctgaactagtggatcccccgggctgcaggaattcgcacgagaccattacctagaacatcctaatcgaaaagtgtcgtcttcctctccgccgcttctcctgtccaccctcgactgcttgcgcgtgacctgagccgccgccgcctacatccgctcatccccgcgcccgcctcaaccacgccgccaccgaccacgtataatcctgcctccccttcgcgcggtttcgaggctcgtttcctttgggatcgttcgtctgccccgaccgcgtgggggcttcttcttcgggatctcgctggaccgagcggcccagggctacgggatccaggcccatggggtggcggcgcggtccctccccccaattggaaggggattcccccagcaaaaagccatcccaccaagggaactcaagtggctctccctccccctttggggggctcctccaaaagggaaattcccttccgggggccccggtttgggctcttttcacaggaagggaccccatccaaacttccattgggacaccccctggcccgcccggttcccgggaccttcaaaaaacccgcccaaggggaaacccctccccgcgtttttaataacgttctcccaaaaagttgctccccctacacc

SEQ ID NO: 27027 - protein, 87 aa, Zea mays
  misc_feature: Ceres CLONE 1400056-F
MGWRRGPSPQLEGDSPSKKPSHQGNSSGSPSPFGGLLQKGNSLPGAPVWALFTGRDPIQTSIGTPPGPPGSRDLQKTRPRGNPSPRF

SEQ ID NO: 27028 - DNA, 614 bp, Zea mays
  misc_feature: Ceres CLONE 1400061-F
  misc_feature (359)..(359): n is a, c, t, g, unknown, or other
cgctctagaactagtggatcccccgggctgcaggaattcgcacgagaccattacctagaacatcctaatcgaaaagagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccggggccggcgggttccccagcagtgtgggcacttgacgacaacgccttaaggggccgggggncgggttctccgccgttattttgccgccccccgggaaaaaaagcaaaaagggggcccccctgggacattcggggggggggactcccatttttttagggccgggggaaaaaaggggaactccccccgcgggggggggggggccccccggccaacacactggggggggggggggggaccccccaaggaggggggggccccccgggggggtcctccccctcaggggggggttcccccgggctcccacaaagaggttttt

SEQ ID NO: 27029 - DNA, 701 bp, Zea mays
  misc_feature: Ceres CLONE 1400062-F
  misc_feature: Encodes the peptide sequence at SEQ ID NO. 27030
tcaccgcggtggcggccgctctataactagtggatcccccgggctgcaggaattcgcacgagaccattacctagaacatcctaatcaaaaacatgccacattgccaccaagccacagttccacctttcgattcatgcacgctcagtcatgggcgccctccggagtttagccatctcctacccggagttcctcgtgggcggactgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccggatgcacgctcatgttccgcgggccgtggctcgcccgcgcggacttcctgctgacgtgcgacccggcggtcgtccagcactgcctggcgtccaaccacgggggctacgacaggggccgagactttgcggagatgttcgacctcctgggcgacgagctgctggatgcggacgccgcgacgcgagagcgccagtggcacatcgccgtcaccgacatcggcaccccggggagcggagactcatccttgatcagcatggagaacactgcgtatccgtgtgtcgagtggctactggagtgcaggtcaacgctgttggtaattgcttgaatgcctaacccgggaggagctcg

SEQ ID NO: 27030 - protein, 176 aa, Zea mays
  misc_feature: Ceres CLONE 1400062-F
MGALRSLAISYPEFLVGGLCFVSLSALRHAMRERRQRAPLSWPVVGMLPFVLANLGRLYDAITDALHGSGCTLMFRGPWLARADFLLTCDPAVVQHCLASNHGGYDRGRDFAEMFDLLGDELLDADAATRERQWHIAVTDIGTPGSGDSSLISMENTAYPCVEWLLECRSTLLVIA

SEQ ID NO: 27031 - DNA, 687 bp, Zea mays
  misc_feature: Ceres CLONE 1400064-F
  misc_feature: Translation starting site: 171
aaagctggagctccccgcggtggcggccgctctagaactagtggatcccccgggctgcaggaattcgcacgagaccattacctagaacatcctaatcgaaaagtctcgatccggaaacctctgcaaatcctatccgcctcctcaagtttcagagctcatgaatctgttccatggtcagtgagacggagaccttcgcatttcaggctgagatcaaccagctgctctcactcatcatcaacaccttctactccaataaggagatcttcctccgagagcttatctccaactcttccgatgggctgcacaatatcaggttcgagagtctcactgacgacagcaagctcgatgggtagtctgagtttttcatccaccttgtcccagacaaggccacgaacacgctctccatcatcgacagtggcatcggcatgaccaagtgcgaccttgtcaacaacctgcgttaccatcgccaggttcgggaccaaggatttcatggaatgccttgctgccggagttgatgtgtccatgattgcccagatcgtagtcggtttctactctgcctacctcgtccccgatagagctgtcgtgaccaccaagcacaacgatgacgagcagtacgtgtgatagtcgcgagtcgggcgcgtcgttcactgttactcgtgacacgtcaggcgcatagtttggcagctg

SEQ ID NO: 27032 - DNA, 689 bp, Zea mays
  misc_feature: Ceres CLONE 1400066-F
  misc_feature: Translation starting site: 276
  misc_feature (654)..(654): n is a, c, t, g, unknown, or other
aaagctggagctccccgcggtggcggccgctctagaactagtggatcccccgggctgcaggaattcgcacgagaccattacctagaacatcctaatcaaaaaacattggaacgcgaacgctctcggatccatccacctccaaagtccaaaagcgaagcctacgcccgccccaacggtgaaaacgtcggaaccctagatccctctcacggtcgcgcctgtgctccaaaaccttagatccgacatgcatcagcccagagcccgctacccacccgggtatggctccagcgggggaggcggtggcgggggaaggcggtagtggaggaggaagaggaggcagcggcggcggaggaaaccacaactactacggccggaacacacatccacagcatcaacaccactaccagcagcagcagcagcactcgcataggaactcctcgcaccagcagcagtggctgcggcgagaccagggccccgccgttgcggggccagtgtctggaaacgctgtgcctaagacggcgcctcagcttgacgctgttgactcgagttctcaagattggaagggctcactaaatataccagctccagacacacgctacagggacagaggatgtcactgcaacaaaaggcatggagtttgaggattattttctgaancgtgagttgcttatgggatatatggagagggggat

SEQ ID NO: 27033 - DNA, 473 bp, Zea mays
  misc_feature: Ceres CLONE 1400067-F
aagctggagctccccgcggtggcggccgctctagaactagtggatcccccgggctgcaggaattcgcacgagaccattacctagaacatcctaatcaaaaattaataaaaagtttgctagtggagtcgagaagagagagagaggcgtccggaattcatcgccagcgatgtctccgtccgccgacgccccccggccgggcctcctccgcctcggggcccccgctcgcgcccctcatcgccgcgcaggtcaactaacctcttctccgcactccaaggttgcccattttaggggggtaccggatcgggggcccggtttggccggaaaagggtcccccccctgggccgaatcgggtttcggggtttcggccatttccccttttttggggcttggaataaaagggcccactgggggggaatttcccggggggacaaaagggggggggtgttgtccccccccccaaggggggggggcgc

SEQ ID NO: 27034 - DNA, 713 bp, Zea mays
  misc_feature: Ceres CLONE 1400069-F
  misc_feature: Encodes the peptide sequence at SEQ ID NO. 27035
  misc_feature (561)..(561): n is a, c, t, g, unknown, or other
aaagctggagctccccgcggtggcggccgctctagaactagtggatcccccgggctgcaggaattcgcacgagaccattacctagaacatcctaatcaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcatgttccgcgggccgtggctcgcccgcgcggacttcctgctgacgtgcgacccggcggccgtccagcactgcctggcgtccaaccacgggggctacgacaggggccgagactttgcggagatgttcgacctcctgggcgacgggctgctgggttgcggatgaccgcgtcgtgcatgcgccagcggnacgtcgacgtcaccgtcttcggcaccgcgggggttcgggtccttcgtcctgtgcaccatggggcgccagacggcgcgactgctcgtgcccgttcttggactgcgcccgcccggaatcaggaaggggaacgggggcgtccctttatctcgagg

SEQ ID NO: 27035 - protein, 126 aa, Zea mays
  misc_feature: Ceres CLONE 1400069-F
MGALRSLAISYPEFLVAGLCFVSLSALRHAMRERRQRAPLSWPVVGMLPFVLANLGRLYDAITDALHGSGCTLMFRGPWLARADFLLTCDPAAVQHCLASNHGGYDRGRDFAEMFDLLGDGLLGCG

SEQ ID NO: 27036 - DNA, 704 bp, Zea mays
  misc_feature: Ceres CLONE 1400076-F
  misc_feature: Encodes the peptide sequence at SEQ ID NO. 27037
  misc_feature (319)..(319): n is a, c, t, g, unknown, or other
  misc_feature (678)..(678): n is a, c, t, g, unknown, or other
aaagctggagctcaccgcggtggcggccgctctagaactagtggatcccccgggctgcaggaattcgcacgagaccattacctagaacatcctaatcgaaaaagggccggacgacggggacagacagcggtgtcgcgggggcacctgcttcccaacgccgtccgcacctgctgccctgtcgtccgccctccttcccttctcctcccctccaactgtttcctcaacctcccgacccaaccacggccgtgcccgccaaggcgccaaccgcacagtatcgctgtctcttggacattgcagcagcagctggggtgctgacgtngctgtgggtggttctgttgtccatggcgcggaagcatcagcatgttgccatatttaccacagcgtgcttgccgtggatgactgggactgcggtaaacccactgtttcgggctgcataccttgccaaggctggagattgggaggtcacgctggtggtgccttggctgtccaagggggatcaggagctcgtttatcaaacaagatgaggttcagtttgccggcagagcaggaaaactatgtgcggcggtggcttgaggaacggactgggctgttgccgaagtttgacataaagttctatccctgggaagttttcaactgaagaaaagaagtattctacctgttggagacatcagtcagacnatatctgatgataaaggggatattgc

SEQ ID NO: 27037 - protein, 60 aa, Zea mays
  misc_feature: Ceres CLONE 1400076-F
  misc_feature: SWISSPROT Homolog: EC 2.4.1.241 Digalactosyldiacylglycerol synthase
MARKHQHVAIFTTACLPWMTGTAVNPLFRAAYLAKAGDWEVTLVVPWLSKGDQELVYQTR

SEQ ID NO: 27038 - DNA, 663 bp, Zea mays
  misc_feature: Ceres CLONE 1400077-F
  misc_feature: Encodes the peptide sequence at SEQ ID NO. 27039
  misc_feature (183)..(183): n is a, c, t, g, unknown, or other
  misc_feature (192)..(192): n is a, c, t, g, unknown, or other
  misc_feature (197)..(197): n is a, c, t, g, unknown, or other
  misc_feature (198)..(198): n is a, c, t, g, unknown, or other
  misc_feature (249)..(249): n is a, c, t, g, unknown, or other
aaaagctgggagctccaccgtcggtggcggccgctctagttctagtggatcccccgggctgcaggaattcgcacgagaccattacctagaacatcctaatcaaaagtgttgtctagcactctagctgcttctctcggttctcgcgactcccaaacggcaaaacgccaaaaccctagccgcggncattccggnattgnncatggaggcgagggcgtcgccgcgtccgtcggtctccatcggtgggcgcgncggcttcggagctgggcggggtgacggcagcgccttctcgtttctctcaaaggggtgccgcgagtgcgggaattccgcaccggcgacttgggccttatggccgggaggctggattcttcctaccctccgggaccggaagttcaagaccctccccgggccccctccctgggggtgacccccggcccccgcggcgttttgcgggggggccccccaaaccaaattaaattttgggggccccggttccccccccaaaattcccaaaagggggcccgcaaattggtcaaaaggggggaagacccccccccccaggtttctcaggggggggggcccccccccgggggaaaaaaacccccggggggcgggggggccacctcttgggggaaacccccccctccaaaaaaaattttttttttt

SEQ ID NO: 27039 - protein, 74 aa, Zea mays
  misc_feature: Ceres CLONE 1400077-F
  misc_feature (17)..(17): Xaa is any aa, unknown, or other
MEARASPRPSVSIGGRXGFGAGRGDGSAFSFLSKGCRECGNSAPATWALWPGGWILPTLRDRKFKTLPGPPPWG

SEQ ID NO: 27040 - DNA, 709 bp, Zea mays
  misc_feature: Ceres CLONE 1400078-F
  misc_feature: Translation starting site: 186
  misc_feature (567)..(567): n is a, c, t, g, unknown, or other
  misc_feature (601)..(601): n is a, c, t, g, unknown, or other
  misc_feature (641)..(641): n is a, c, t, g, unknown, or other
  misc_feature (643)..(643): n is a, c, t, g, unknown, or other
  misc_feature (672)..(672): n is a, c, t, g, unknown, or other
  misc_feature (673)..(673): n is a, c, t, g, unknown, or other
aaagctggagctccccgcggtggcggccgctctagaactagtggatcccccgggctgcaggaattcgcacgagaccattacctagaacatcctaatcgaaaaatcacttatcatccccatccgcacctctctccatctccctgctcctccgccttcttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggtcatgccaaatgccactttgttgccatagatatattcaacgggaaaaagctcgaagatattgttccttcgtcacacaactgtgatattccgcatgtgaaccgtactgagtatcagctgattgatatatcagaaggatggatttgtgagccttcttacttcagatggcaacactaaggatgatcttagactcccaactgatgagactcttgtggccagnattcaaggaggggtttgaaagtggcaaggacgcngcgcgcacgaacggctcgctctctctccgacaccaggatncntcccgtttcaggaaacggaaaagatccgnncgtcaacccgagccgctccgcttccgtccgattcgg

SEQ ID NO: 27041 - DNA, 709 bp, Zea mays
  misc_feature: Ceres CLONE 1400079-F
  misc_feature: Encodes the peptide sequence at SEQ ID NO. 27042
  misc_feature (270)..(270): n is a, c, t, g, unknown, or other
  misc_feature (291)..(291): n is a, c, t, g, unknown, or other
  misc_feature (415)..(415): n is a, c, t, g, unknown, or other
  misc_feature (470)..(470): n is a, c, t, g, unknown, or other
  misc_feature (480)..(480): n is a, c, t, g, unknown, or other
  misc_feature (484)..(484): n is a, c, t, g, unknown, or other
  misc_feature (619)..(619): n is a, c, t, g, unknown, or other
  misc_feature (671)..(671): n is a, c, t, g, unknown, or other
  misc_feature (696)..(696): n is a, c, t, g, unknown, or other
aaagctggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgcgnggcccggacgccggctcgcgngccttctcggtgcgcgtgcgccgccgcctgccggacttcctgcagtcggtgaacctcaagtacgtgcgcctcgggtaccactacctcatcagccacggcgtgtacctggccaccatccccgtcnatcgtgctggtgtgcggcgccgagctgggcagcctcagccgcgacgagctgtggncgcagggtgntggngggaggccacctacgacctcgccaccgtgctcgcccttcctcgccgtcctcgccttcaccatctccgtctacatcatgtccaggccccaggcccgtgtacctcatcgacttcgcatggctacagcccggcgacgnagctcaaggtgtcccagggcggagttcatcgacctggcgcgcaaagtccggncaggttcgacgagaacagcctggcngttccaggcgcgc

SEQ ID NO: 27042 - protein, 167 aa, Zea mays
  misc_feature: Ceres CLONE 1400079-F
  misc_feature: SWISSPROT Homolog: EC 2.3.1.119 Icosanoyl-CoA synthase
  misc_feature (70)..(70): Xaa is any aa, unknown, or other
  misc_feature (88)..(88): Xaa is any aa, unknown, or other
  misc_feature (91)..(91): Xaa is any aa, unknown, or other
  misc_feature (93)..(93): Xaa is any aa, unknown, or other
  misc_feature (138)..(138): Xaa is any aa, unknown, or other
  misc_feature (155)..(155): Xaa is any aa, unknown, or other
MAREEQALLSTEIVNRGVEPRGPDAGSRAFSVRVRRRLPDFLQSVNLKYVRLGYHYLISHGVYLATIPVXRAGVRRRAGQPQPRRAVXAGXWXEATYDLATVLALPRRPRLHHLRLHHVQAPGPCTSSTSHGYSPATXLKVSQGGVHRPGAQSPXRFDENSLAVPGA

SEQ ID NO: 27043 - DNA, 716 bp, Zea mays
  misc_feature: Ceres CLONE 1400081-F
  misc_feature: Encodes the peptide sequence at SEQ ID NO. 27044
  misc_feature (363)..(363): n is a, c, t, g, unknown, or other
  misc_feature (375)..(375): n is a, c, t, g, unknown, or other
  misc_feature (381)..(381): n is a, c, t, g, unknown, or other
  misc_feature (384)..(384): n is a, c, t, g, unknown, or other
  misc_feature (385)..(385): n is a, c, t, g, unknown, or other
  misc_feature (389)..(389): n is a, c, t, g, unknown, or other
  misc_feature (392)..(392): n is a, c, t, g, unknown, or other
  misc_feature (589)..(589): n is a, c, t, g, unknown, or other
  misc_feature (667)..(667): n is a, c, t, g, unknown, or other
  misc_feature (673)..(673): n is a, c, t, g, unknown, or other
aaagctggagctccccgcggtggcggccgctctagaactagtggatcccccgggctgcagcaattcgcacgagaccattacctagaacatcctaatcgaaaaaccgcatacaccgctgcccgcgcgcagccgcgcaggtgcatctgcgccgccgccggcccgccgcacccgcacgtctccttatacccatccggccatctacacacggcagtccacgctcgtggcaccgcactcactccgaatcctgaagcaacaaacaccagaagcgcaccaactccccaaccaccggagaccgcaccccagcaaaggatgtcatctgactccacggccgccgtgacggtggacggcagcgcgcttgcgggnccgcgcgctggnccgcgncgnncacncgncacatgttcggggtggtgggcatccccggcacctccctcgcgtcccgtgccgccgcggccggggtccgcttcctcgcttttcggcacgagcagtccgcgggggtacgccgcccgccgcctaagggtttcctcaggggcttccccgggcgccctactcaccgtctccggcccaggaagggtccaccggggctcggggncctcttccaggccaacggcaaaggttggccggttcctaatggatccccggaatctggggataagggttgacgcccggnaggggnccaatttccagggggctgaaacaaaattgccccccctaaaccc

SEQ ID NO: 27044 - protein, 87 aa, Zea mays
  misc_feature: Ceres CLONE 1400081-F
  misc_feature: SWISSPROT Homolog: EC 4.1.1.8 Oxalyl-CoA decarboxylase
  misc_feature (65)..(65): Xaa is any aa, unknown, or other
MFGVVGIPGTSLASRAAAAGVRFLAFRHEQSAGVRRPPPKGFLRGFPGRPTHRLRPRKGPPGLGXLFQANGKGWPVPNGSPESGDKG

SEQ ID NO: 27045 - DNA, 709 bp, Zea mays
  misc_feature: Ceres CLONE 1400083-F
  misc_feature: Encodes the peptide sequence at SEQ ID NO. 27046
  misc_feature (389)..(389): n is a, c, t, g, unknown, or other
  misc_feature (441)..(441): n is a, c, t, g, unknown, or other
  misc_feature (597)..(597): n is a, c, t, g, unknown, or other
  misc_feature (646)..(646): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccattacctagaacatcctaatcgaaaaatccgccactacgccacaaaatcctctcctactccggcagttctgctcgccgccgcctccacgatgacggaagacgtgcagatgaacgactcggagccccagcctgcggcctcagctcccgccgtcggggcgccggcgctctccacactacaccatctgaaggagatcgcgtccgtgatcgaggccggttctctgtccaaggaggtccgccggatctcccgcgccttccgcctcaccgtcgcggtccgtcgccgcctcgccgcgcgggacgtctccgccttcctcgncttcgcgctacccgcgtcctctgaaaactaaagaaggctcactgccctggtngcccaggaagatgatactcgagatggataggtgatgctgcagcttcccccaactctaatttcaatcaaacatggtctccctgagattgaatatattggctacttgctcggactgatgattttctctaatgatacaaagaatatgattgaggtaggncctggcgcaagtgtgagcattggctccgctgaggatctaaaccgagaancatgttggatggtttggnaatgacgaacggagttctatttaactccttaaggagaatgagctc

SEQ ID NO: 27046 - protein, 84 aa, Zea mays
  misc_feature: Ceres CLONE 1400083-F
  misc_feature (75)..(75): Xaa is any aa, unknown, or other
MTEDVQMNDSEPQPAASAPAVGAPALSTLHHLKEIASVIEAGSLSKEVRRISRAFRLTVAVRRRLAARDVSAFLXFALPASSEN

SEQ ID NO: 27047 - DNA, 694 bp, Zea mays
  misc_feature: Ceres CLONE 1400084-F
  misc_feature: Encodes the peptide sequence at SEQ ID NO. 27048
  misc_feature (589)..(589): n is a, c, t, g, unknown, or other
  misc_feature (590)..(590): n is a, c, t, g, unknown, or other
  misc_feature (607)..(607): n is a, c, t, g, unknown, or other
aaagctggagctccccgcggtggcggccgctctagaactagtggatcccccgggctgcaggaattcgcacgagaccattacctagaacatcctaatcaaaaattcctcttgctcttcctcttccattcattagctgcactcgcctccctcgcgccaccgccttctcagccaccaccgccgcgggtgcctcagaaagtgcaggtgtggcccaagccggtgtccatctcgtggccgttgccggcatacgcgccgatctccccgtcgttcaacatccgcgcctcgccgtcgcacccgtcgctccgtcacgccatcgcgtactacacccgcctcatccgcaccgagcggtacacgccgattatcccccccgtcaactacaccgtctcgggcgtccccatccgcctgctcgcgctctccgtctccgatcccgacgtcccgctcggcccccggcgtcgacgagtcctacacgctctccgtgccacccaattccagctccgctgacatctctgccgccactccctggggaatcatccgcggtctcgagaccttctcccagctcgcctggagcagcggcgccgccgacgcgagcggnncagccgatcgtccccangcgagatagaaatctccgaccaccccctgtcaccccaaccggcgggatcctcctcgacaccgcacggaacaccaaccccccgtcgtg

SEQ ID NO: 27048 - protein, 165 aa, Zea mays
  misc_feature: Ceres CLONE 1400084-F
KAGAPRGGGRSRTSGSPGLQEFARDHYLEHPNQKFLLLFLFHSLAALASLAPPPSQPPPPRVPQKVQVWPKPVSISWPLPAYAPISPSFNIRASPSHPSLRHAIAYYTRLIRTERYTPIIPPVNYTVSGVPIRLLALSVSDPDVPLGPRRRRVLHALRATQFQLR

SEQ ID NO: 27049 - DNA, 694 bp, Zea mays; identical to SEQ ID NO: 27047
  misc_feature: Ceres CLONE 1400084-F2
  misc_feature: Pfam Name: Glyco_hydro_20b Pfam Description: Glycosyl hydrolase family 20, domain 2
  misc_feature: SWISSPROT Homolog: EC 3.2.1.52 Beta-N-acetylhexosaminidase
  misc_feature (589)..(589): n is a, c, t, g, unknown, or other
  misc_feature (590)..(590): n is a, c, t, g, unknown, or other
  misc_feature (607)..(607): n is a, c, t, g, unknown, or other

SEQ ID NO: 27050 - DNA, 722 bp, Zea mays
  misc_feature: Ceres CLONE 1400085-F
  misc_feature: Encodes the peptide sequence at SEQ ID NO. 27051
  misc_feature (474)..(474): n is a, c, t, g, unknown, or other
  misc_feature (527)..(527): n is a, c, t, g, unknown, or other
  misc_feature (625)..(625): n is a, c, t, g, unknown, or other
  misc_feature (629)..(629): n is a, c, t, g, unknown, or other
  misc_feature (633)..(633): n is a, c, t, g, unknown, or other
  misc_feature (652)..(652): n is a, c, t, g, unknown, or other
aaagctggagctccccgcggtggcggccgctctagaactagtggatcccccgggctgcaggaattcgcacgagaccattacctagaacatcctaatcgaaaaaaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgagacccgcatcggggacatggcccgcttcgcggacacgctgtcggacacctccccgggctcgcccgcgcagcgctncggtgtcgggaggacggcgtcatcaactcgcgcccgcgggtgctgggccccgncagctgcatcaacgccggtttctacacgcgggccagcgacgactacgtggcgggggcgtcgggtgggaacctgggcgccgcccgggccgcgtaccggntggntggnagaacgtggtggcgttccngccgagctgcgggccccggggcaggccccgctgcggggcggcctgctccgggggcgggggtcgcgccggg

SEQ ID NO: 27051 - protein, 192 aa, Zea mays
  misc_feature: Ceres CLONE 1400085-F
  misc_feature: SWISSPROT Homolog: EC 4.1.2.10 Mandelonitrile lyase
  misc_feature (110)..(110): Xaa is any aa, unknown, or other
  misc_feature (128)..(128): Xaa is any aa, unknown, or other
  misc_feature (162)..(162): Xaa is any aa, unknown, or other
  misc_feature (163)..(163): Xaa is any aa, unknown, or other
MSGRSRHFTMSTLLATSFFFVLLCSSLQVRGVNYTFVKDAALAPSVSYYDYIIVGGGTAGCPLAATLSERFRVLLLERGASPYDETRIGDMARFADTLSDTSPGSPAQRXGVGRTASSTRARGCWAPXAASTPVSTRGPATTTWRGRRVGTWAPPGPRTGWXXERGGVPAELRAPGQAPLRGGLLRGRGSRR

SEQ ID NO: 27052 - DNA, 734 bp, Zea mays
  misc_feature: Ceres CLONE 1400088-F
  misc_feature: Encodes the peptide sequence at SEQ ID NO. 27053
  misc_feature (317)..(317): n is a, c, t, g, unknown, or other
  misc_feature (361)..(361): n is a, c, t, g, unknown, or other
  misc_feature (407)..(407): n is a, c, t, g, unknown, or other
  misc_feature (422)..(422): n is a, c, t, g, unknown, or other
  misc_feature (497)..(497): n is a, c, t, g, unknown, or other
  misc_feature (650)..(650): n is a, c, t, g, unknown, or other
ctggagctccccgcggtggcggccgctctagaactagtggatcccccgggctgcaggaattcgcacgagaccattacctagaacatcctaatcaaaaaaagcaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttccctactacctcctcgtggctctcgaggncggcagcgtcctccgcgccgcgctgctgctcctgggtcgtgcgntcgtctacgtcacctacgccttctttctcgagtcgctggcatcagnacgctggtggacatntcccgtggcgggggttcagggtggcagcaatcgaggatgtggccggggttccggggtcccaggttttacgcgggncggacgtggacccggaagatttggaggggggttcgtttcctttgggggggggttaagttttaaggggcagcccccggggtttggggggagggctttttccagggggttttctgggggccaaaaagggctcccggaaccaaatggggggggtcnaagggaaagaaagggccccttttttttggggggggccggggggggtttctcgcaaaaaaaaaaaaaagggctctccaaaggggg

SEQ ID NO: 27053 - protein, 125 aa, Zea mays
  misc_feature: Ceres CLONE 1400088-F
  misc_feature: SWISSPROT Homolog: EC 2.3.1.15 Glycerol-3-phosphate O-acyltransferase
  misc_feature (48)..(48): Xaa is any aa, unknown, or other
  misc_feature (78)..(78): Xaa is any aa, unknown, or other
  misc_feature (83)..(83): Xaa is any aa, unknown, or other
  misc_feature (108)..(108): Xaa is any aa, unknown, or other
MVASPRFKPIEECCSEGRSEQTVAADLDGTLLISRSAFPTTSSWLSRXAASSAPRCCSWVVRSSTSPTPSFSSRWHQXAGGHXPWRGFRVAAIEDVAGVPGSQVLRGXDVDPEDLEGGSFPLGGG

SEQ ID NO: 27054 - DNA, 682 bp, Zea mays
  misc_feature: Ceres CLONE 1400089-F
  misc_feature: Encodes the peptide sequence at SEQ ID NO. 27055
  misc_feature (359)..(359): n is a, c, t, g, unknown, or other
  misc_feature (436)..(436): n is a, c, t, g, unknown, or other
  misc_feature (454)..(454): n is a, c, t, g, unknown, or other
  misc_feature (494)..(494): n is a, c, t, g, unknown, or other
aaagctggagctccccgcggtggcggccgctctagaactagtggatcccccgggctgcaggaattcgcacgagaccattacctagaacatcctaatcgaaaaagtcctctctgtcgcggagccgccgcaacccagcgtcccccgaagtctaaccctagatccggaccggccatggcgtcccgccgggtcgtctcctcgctcctccgctccgcgtcccgcctgcgggccgcctcgcccgctgcgccacgcccgcgcgcgccaccgcaccgcccgtccccggccgggtacctcttcaaccgcgctgccgcctacgcctcttccgccgcggcccaggcggcacctgccaccccgccgccggncaccgggaagaccgggggcggcaagatcaccgacgagtccaccggcgctggcgccatcgggccaggtgtgccagggnatcggcgcccgtcgttgnacgtgcgcttcgatgagggcctcccgcccatcctcagggngctcgaggtgctcgacaacaacatccgcctcgtgctcgaggtggcgcagcaccttggcgagaacatggtgcgcaccatcgctatgacgggcacggaggggctcgtccgcggccagcgcgtcctcacactggctccccatcaccgtgcctgttggcagggctacccttggagcatcataaatgttattg

SEQ ID NO: 27055 - protein, 170 aa, Zea mays
  misc_feature: Ceres CLONE 1400089-F
  misc_feature (86)..(152): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (63)..(63): Xaa is any aa, unknown, or other
  misc_feature (89)..(89): Xaa is any aa, unknown, or other
  misc_feature (95)..(95): Xaa is any aa, unknown, or other
  misc_feature (108)..(108): Xaa is any aa, unknown, or other
MASRRVVSSLLRSASRLRAASPAAPRPRAPPHRPSPAGYLFNRAAAYASSAAAQAAPATPPPXTGKTGGGKITDESTGAGAIGPGVPGXRRPSLXVRFDEGLPPILRXLEVLDNNIRLVLEVAQHLGENMVRTIAMTGTEGLVRGQRVLTLAPHHRACWQGYPWSIINVI

SEQ ID NO: 27056 - DNA, 710 bp, Zea mays
  misc_feature: Ceres CLONE 1400091-F
  misc_feature: Translation starting site: 262
aaagctggagctccccgcggtggcggccgctctagaactagtggatcccccgggctgcaggaattcgcacgagaccattacctagaacatcctaatcgaaaaacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcctgcgtccgagcgagcgggtcgaggtacggcggaaccgctacaaggtggcggttcacgcgtaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggttaagtggggtttattcggatgataataaccttcagcttgaggccaccacacagttccgcaaattgctctctatagagaggagtccccccatcgaagaagttatcaaaacaggtgtagttccaagatttgtgcagtctctcaccagagaggatttcccccagctgcagtttgaagctgcatgggctctcacaaatattgcttctggcacttcagaaaatacaaaggt

SEQ ID NO: 27057 - DNA, 698 bp, Zea mays
  misc_feature: Ceres CLONE 1400092-F
  misc_feature: Encodes the peptide sequence at SEQ ID NO. 27058
  misc_feature (617)..(617): n is a, c, t, g, unknown, or other
  misc_feature (618)..(618): n is a, c, t, g, unknown, or other
  misc_feature (668)..(668): n is a, c, t, g, unknown, or other
  misc_feature (698)..(698): n is a, c, t, g, unknown, or other
gctctagaactagtggatcccccgggctgcaggaattcgcacgagaccattacctagaacatcctaatcgaaaagcaggatattctagacgcactggcgcgcatggaggcacgcttgaccgatgcgctgatgggtcgctgcggcgagcagtacgcacgcgagcacacttcccccttcgacggatccgcgcctccttcttccatcgtcaacacacagtaccgcgacgaggtaatccttccgcctctcgtccacgacgacgctgcgaaggtggcgtccttggattcgggaaacgactttggcctgcagcagaccgccacggtgcttgcgtccctagggtccgacgagatgtcttcctcgaccatgcccctcgccggctccatatccgaccgctacattccgccgctctacgacgacgactgctacaccatgccacagccgtttgtcgatactctcgccaaccccgacgatgacctcctccaggagctcgacgtgttggacgaggatgccacgagcgccaacgcggctgacgacgattcaggcgctgtcctcgtctatgcgccgctcgactcgaacatcgacagcagcggatcaccgcgctaccgtggctccccgagggnngggcggtggtgttccatcgggaccgggacgagaaggcctcatcggcgggnacggagttggtcgggcgaagtccgcccgcn

SEQ ID NO: 27058 - protein, 198 aa, Zea mays
  misc_feature: Ceres CLONE 1400092-F
  misc_feature (172)..(172): Xaa is any aa, unknown, or other
  misc_feature (189)..(189): Xaa is any aa, unknown, or other
MEARLTDALMGRCGEQYAREHTSPFDGSAPPSSIVNTQYRDEVILPPLVHDDAAKVASLDSGNDFGLQQTATVLASLGSDEMSSSTMPLAGSISDRYIPPLYDDDCYTMPQPFVDTLANPDDDLLQELDVLDEDATSANAADDDSGAVLVYAPLDSNIDSSGSPRYRGSPRXGRWCSIGTGTRRPHRRXRSWSGEVRP

SEQ ID NO: 27059 - DNA, 859 bp, Zea mays
  misc_feature: Ceres CLONE 1400094-F
  misc_feature (101)..(101): n is a, c, t, g, unknown, or other
tttccccccccccccccctccggtgatggccccgggggggggcgtacaaaagtggagctccccgcggggggggacgcttctgcaaaagagagagccccggnctgcaggttttcccacgagaccattacctagaacatcctaatcgaaaaggaagtctgccttcttctctcctcttcctgctcagcatcgggacgaggtttatttgtatcatcgcagccgcacaccgccacgccacgaccagcacgttgcacaagaccctgggggcgatcaccgttgacgacctcaccgcggcggggctgggtcggacgccagacgcgatccacacagcgctccggcgcgggctcgagtccgacgcagccaccgacgttaggggtgaactctcgcaggacagagcgcagacccttgggagcccgtcgccgggcagacgcaggggcgaccacaaattctcgtaccaagtggctctggttttcccagtgccgacgagggggacggcagggtcggtcaaggtcgcgtggccatggctggattgtgtcccgccgcctctcgctagacgctactgggacgcgtacgcaactagggcttggcgagcagtggaaatcgccgcccgcctaatgcttctgttgaagaagagggtatcccgcccacaagagcccttaatcctgatcgggcggcgcgtttaagcgggacattttgcggcgaaaggacgatcgggaggtaggaacctgtccctggttgtgggccctttcgattaaccggaggagggacccttattgggaaaaagggggggggggggttgttcgcaccagcgaatgtccgcggagacaaaaagcggcgggagaatcggggagtagaggacgcg

SEQ ID NO: 27060 - DNA, 703 bp, Zea mays
  misc_feature: Ceres CLONE 1400099-F
  misc_feature: Encodes the peptide sequence at SEQ ID NO. 27061
  misc_feature (703)..(703): n is a, c, t, g, unknown, or other
aaagctggagctccccgcggtggcggccgctctacaactagtggatcccccgggctgcaggaattcgcacgagaccattacctagaacatcctaatcgaaaacttccgtccttggcaaccaggcccaggcatcgtttcaccgctattcctcctgccccatctcctcccgatccatccgagcccaaaccctagtccagccagatctccgccgccgccggcgagagcacggcatcagatccgccgcgatggcgttccgccgcatcttatccacagcggtgcgccgccgctcggccatcgccgcggcagcggccgggaacgcgcgcgaggcctccacggccgtcgccgcggcgcccggcgtgctagcccccgacgcgaccccggtgcgcgctcccgtgatgccgtacgatcgcatcgccgaagccgttaacgccaggctccggcggcttgagcacccagacccgcgcttcctccgctatgcaagccccgtgccgtcccacgccgaacacacggccatccttgcggcgccggagacccgggtcaccacgctgcccaacggcctgcgcgtgggcacggagtcgtccctcgccgcgcgcacggttacggggggtgggtggatcgatgcgggcagcaggtacgagaacgaggaggcggccggcggtccgcatttggccagcactggtggtcaagggcacgggaagcgaan

SEQ ID NO: 27061 - protein, 152 aa, Zea mays
  misc_feature: Ceres CLONE 1400099-F
  misc_feature: SWISSPROT Homolog: EC 3.4.24.64 Mitochondrial processing peptidase
MAFRRILSTAVRRRSAIAAAAAGNAREASTAVAAAPGVLAPDATPVRAPVMPYDRIAEAVNARLRRLEHPDPRFLRYASPVPSHAEHTAILAAPETRVTTLPNGLRVGTESSLAARTVTGGGWIDAGSRYENEEAAGGPHLASTGGQGHGKR

SEQ ID NO: 27062 - DNA, 670 bp, Zea mays
  misc_feature: Ceres CLONE 1400100-F
  misc_feature: Encodes the peptide sequence at SEQ ID NO. 27063
  misc_feature (433)..(433): n is a, c, t, g, unknown, or other
aagctggagctccccgcggtggcggccgctctagaactagtggatcccccgggctgcaggaattcgcacgagaccattacctagaacatcctaatcaaaactcgctccatttctaatccggtaatcccccctcccgagtccaaaccctaaacctaaacctctcaccgccgccaccgccgccgccccgaggccccatcccagcgcaaccgacttccgcctcggattgaagcaatgtcgtcggacgacgaggtcagggaggagaaggagctcgacctctcctccaacgatgtcgtcaccaagtacaagactgccgccgaaatcctgaacaacgctctgaagctggttgtgtctgagtgcaagccaaaagcaaagattgttgacctttgtgagaagggtgactctttcataagagagcaaactgggaatgtctacnagaatgcaaagaggaagattgaaaggggcattgctttcccaacctgtgtttctgtgaaacacacagtctgccacttctccccgcttaccacagatgatgcagttctgggagaaaatgatatggttaaaattgacatggggtgtcatattgatggctttatggctgtggtggcacatacacatgtaattggcaatggggcctgtcaccagaagaagcgcttgatgttcttgctgctgc

SEQ ID NO: 27063 - protein, 146 aa, Zea mays
  misc_feature: Ceres CLONE 1400100-F
  misc_feature (22)..(145): Pfam Name: Peptidase_M24 Pfam Description: metallopeptidase family M24
  misc_feature: SWISSPROT Homolog: EC 3.4.11.18 Methionyl aminopeptidase
  misc_feature (68)..(68): Xaa is any aa, unknown, or other
MSSDDEVREEKELDLSSNDVVTKYKTAAEILNNALKLVVSECKPKAKIVDLCEKGDSFIREQTGNVYXNAKRKIERGIAFPTCVSVKHTVCHFSPLTTDDAVLGENDMVKIDMGCHIDGFMAVVAHTHVIGNGACHQKKRLMFLLL

SEQ ID NO: 27064 - DNA, 720 bp, Zea mays
  misc_feature: Ceres CLONE 1400102-F
  misc_feature (486)..(486): n is a, c, t, g, unknown, or other
  misc_feature (492)..(492): n is a, c, t, g, unknown, or other
aaagctggagctccccgcggtggcggccgctctagaactagtggatcccccgggctgcaggaattcgcacgagaccattacctagaacatcctaatcgaaaaatttttaccgcacatctctccttcctcggcgtctcgcacaccccagcaccttcgtctcccctcccctcccctcccctcccccaacaatcggaaccggatagaaagttcggcttcctcccggacgactcggcgcaaggtcgcagcttttctctcgatttttcgcgcttccccgttttgacgcttgcttcgcatggggattctggagatctttggggcggatcgctgctgagatggttcgcctcatcacgcgctgctgtgactcccaacagttcttccgacccgaggagcccctggtatgaacggcatggcgatctctgcgtcctctgcggcaagcgtcaccggtgccgcggttgccgcccggcacacccatgaaaaatgcacggncggcgnacgctctcgccgagagggcgagaattttaccgtcggaacggaaaaacctttgggggcctgttggaagtcccccctgaaaaaaaaccaaaagggggttgggcctttggggtggaaagggggccctggcccccggggaaagagttggcccttggaacgggccccccgaaaagctcgggaacccccaccccccgggagggggcctgccccacaagggggccttgtcgcccg

SEQ ID NO: 27065 - DNA, 735 bp, Zea mays
  misc_feature: Ceres CLONE 1400103-F
  misc_feature: Encodes the peptide sequence at SEQ ID NO. 27066
  misc_feature (645)..(645): n is a, c, t, g, unknown, or other
  misc_feature (684)..(684): n is a, c, t, g, unknown, or other
aaagctggagctcaccgcggtggcggccgctctagaactagtggatcccccgggctgcaggaattcgcacgagaccattacctagaacatcctaatcgaaaagtcgagttaacaaagtcacctcatccaatcttgcatccccatctctgtctttgctcctccatggccatggccatggcccgaccttgtgctttccttctcttcttcctagttcttttctcctacgacggatccggtcctgggagcagcagcaggaggagtggcgtcgctcaggccacgcagagagtcttcctgtatccacaggctcccaaggtctcctccatcgtgagcagcaagtacaggaccgcgtaccacttccagcctcccaagaactggatcaacgatccaaatggaccaatgtactacaatggtatctaccaccagttctaccagtacaacccaaacggctcgctctggggcaacatagtctgggcgcactcgttctccacagatctcgtgaactggatccggctcgcgccggcgatagagcggacgactccgagcgacatcaatggcttgctggacaggttcagccaccatcctcaagaagcggccggcctgccatcataatacaccggcgccgacaccgagaaagcgtcaggtcanggaaacttggcgttccccaagaaacctgtccgaccgtanccttgggggggaaagtggttgaagccacacgaacaacccgttgatcccagg

SEQ ID NO: 27066 - protein, 148 aa, Zea mays
  misc_feature: Ceres CLONE 1400103-F
  misc_feature: SWISSPROT Homolog: EC 3.2.1.26 Beta-fructofuranosidase
MAMAMARPCAFLLFFLVLFSYDGSGPGSSSRRSGVAQATQRVFLYPQAPKVSSIVSSKYRTAYHFQPPKNWINDPNGPMYYNGIYHQFYQYNPNGSLWGNIVWAHSFSTDLVNWIRLAPAIERTTPSDINGLLDRFSHHPQEAAGLPS

SEQ ID NO: 27067 - DNA, 718 bp, Zea mays
  misc_feature: Ceres CLONE 1400106-F
  misc_feature: Encodes the peptide sequence at SEQ ID NO. 27068
  misc_feature (418)..(418): n is a, c, t, g, unknown, or other
  misc_feature (566)..(566): n is a, c, t, g, unknown, or other
  misc_feature (606)..(606): n is a, c, t, g, unknown, or other
  misc_feature (639)..(639): n is a, c, t, g, unknown, or other
  misc_feature (640)..(640): n is a, c, t, g, unknown, or other
  misc_feature (646)..(646): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (718)..(718): n is a, c, t, g, unknown, or other
tggagctccccgcggtggcggccgctctagaactagtggatcccccgggctgcaggaattcgcacgagaccattacctagaacatcctaatcgaaaaagctgaaagcagccaaaacgcagaagctgcactgcatacatcgagctaactatctgcagcgatgtctcgctcctgctgcgtcgccgtgtcggtgcttctcgctgtcgccgcgacagccagcgccaccgcgccggcatggctgcacgaggaggccatggccacgggcccgctggtcgcagagggtgcaagggtggcgccctccgcgtccacctgggctgccgacaaggcgtctccggcgaggccgagcggcggcatggccacgcagggcgacgaccagagctcgtcgggcggcagtggcagcagcggtgatcacgcgcaggnaggagggcgagaagcaggggcaagagctggctcaccacaaggagagtgcacaagaaaaaagatgatctgcggcaagggctgtactgctcttctggggacaagagtgcgccgccaagtgcaccccaagtctgtgtccccacctggtaangaagcgaggccggagccttgttcgcgcgcgagacctcccnatcgatcgagaggtccattaccttctttgggannaaaagnccctnnnnnggggtgccgttgcgtgcgttgcctaaacaaagnnnnnnnnnnnnnnnnnnnnnnnnngaaaan

SEQ ID NO: 27068 - protein, 186 aa, Zea mays
  misc_feature: Ceres CLONE 1400106-F
  misc_feature (87)..(87): Xaa is any aa, unknown, or other
  misc_feature (136)..(136): Xaa is any aa, unknown, or other
  misc_feature (150)..(150): Xaa is any aa, unknown, or other
  misc_feature (161)..(161): Xaa is any aa, unknown, or other
  misc_feature (163)..(163): Xaa is any aa, unknown, or other
  misc_feature (165)..(165): Xaa is any aa, unknown, or other
  misc_feature (166)..(166): Xaa is any aa, unknown, or other
  misc_feature (177)..(177): Xaa is any aa, unknown, or other
  misc_feature (178)..(178): Xaa is any aa, unknown, or other
  misc_feature (179)..(179): Xaa is any aa, unknown, or other
  misc_feature (180)..(180): Xaa is any aa, unknown, or other
  misc_feature (181)..(181): Xaa is any aa, unknown, or other
  misc_feature (182)..(182): Xaa is any aa, unknown, or other
  misc_feature (183)..(183): Xaa is any aa, unknown, or other
  misc_feature (184)..(184): Xaa is any aa, unknown, or other
  misc_feature (185)..(185): Xaa is any aa, unknown, or other
MSRSCCVAVSVLLAVAATASATAPAWLHEEAMATGPLVAEGARVAPSASTWAADKASPARPSGGMATQGDDQSSSGGSGSSGDHAQXGGREAGARAGSPQGECTRKKMICGKGCTALLGTRVRRQVHPKSVSPPGXEARPEPCSRARPPXRSRGPLPSLGXKXPXXGCRCVRCLNKXXXXXXXXXK

SEQ ID NO: 27069 - DNA, 634 bp, Zea mays
  misc_feature: Ceres CLONE 1400110-F
  misc_feature: Encodes the peptide sequence at SEQ ID NO. 27070
aaagctggagctccccgcggtggcggccgctctagaactagtggatcccccgggctgcaggaattcgcacgagaccattacctagaacatcctaatcgaaaaactgccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatcgagatggtggcgcgctccgtgctccccaggttctacgcgggcgacgtgcacccggagagctggagggtgttcagctccttcggcaggcgctacgtcgtcacggccagccccagggtcatggtcgagcccttcgccagggccttcctaggcgccgacaaggtcgtcgggaccgag

SEQ ID NO: 27070 - protein, 151 aa, Zea mays
  misc_feature: Ceres CLONE 1400110-F
  misc_feature: SWISSPROT Homolog: EC 2.3.1.15 Glycerol-3-phosphate O-acyltransferase
MVASPRFKPIEECCSEGRSEQTVAADLDGTLLISRSAFPYYLLVALEAGSVLRAALLLLSVPFVYVTYAFFSESLAISTLVYISVAGLKVRSIEMVARSVLPRFYAGDVHPESWRVFSSFGRRYVVTASPRVMVEPFARAFLGADKVVGTE

SEQ ID NO: 27071 - DNA, 640 bp, Zea mays
  misc_feature: Ceres CLONE 1400116-F
  misc_feature: Encodes the peptide sequence at SEQ ID NO. 27072
tggagctccccgcggtggcggccgctctagaactagtggatcccccgggctgcaggaattcgcacgagaccattacctagaacatcctaatcgaaaaagatcgttccgtaagggcacccatcgtcatagatacgattcatagcttctgccactacttgtgcgcgaagagccaagaaatgcgtcaggggttgtgaagggaaggagtgccgatggccggtggccacccggcgccgctgcggccggtggtggttgcgatgaaaggccacccagggtctggcaagtccacggcggcgcgcgccatcgcgaccgcgctttgctgtccgctcctggacaaggacgatgtgagggactgcatgttgcccctagagggcttggctgctgctgggatgctcaacgacctctcctacgccgtgctgtggcggatggctgagcgccaggtaaggctcggactgtctgtcgtcatcgattcaccgctgtcacgccgctctcacctcgacatgctgacacgcctagccggtgtgcttgtggtcgtcgtggagtgtcgccctggtgataacgaggaatggcgccggaggctggagagcgtgggtccaaaaaaaagaggggggggggggggggggaaaaaaaaaaaaaaaaaaaa

SEQ ID NO: 27072 - protein, 143 aa, Zea mays
  misc_feature: Ceres CLONE 1400116-F
  misc_feature: SWISSPROT Homolog: EC 2.7.4.14 Cytidylate kinase
MAGGHPAPLRPVVVAMKGHPGSGKSTAARAIATALCCPLLDKDDVRDCMLPLEGLAAAGMLNDLSYAVLWRMAERQVRLGLSVVIDSPLSRRSHLDMLTRLAGVLVVVVECRPGDNEEWRRRLESVGPKKRGGGGGGKKKKKK

SEQ ID NO: 27073 - DNA, 631 bp, Zea mays
  misc_feature: Ceres CLONE 1400134-F
  misc_feature: Encodes the peptide sequence at SEQ ID NO. 27074
aaagctggagctccccgcggtggcggccgctctagaactagtggatcccccgggctgcaggaattcgcacgagaccattacctagaacatcctaatcgaaaaagaagcatcacacactaatcaacaagcaggaccagctagctagctcctctcactgctatcacccgcccagccatctcgctgaaagagaaaagcgcagccatgaagactactagctcgggcattgcagtcgtcctactggtggccatgctggcagtccattccgcgttggccgacatctcgtgctccgacgtgctcaacgacctgtcgccgtgcctgcccttcctgcagggcaaggcagccaaacccagcgagagcaacaaccagtgctgcgacggcgtgagggccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttcccttaccagaatccatacgacgggatggtgatgttcagtgccctgctagcagtaggc

SEQ ID NO: 27074 - protein, 119 aa, Zea mays; identical to SEQ ID NO: 566
  misc_feature: Ceres CLONE 1400134-F
  misc_feature (28)..(115): Pfam Name: Tryp_alpha_amyl Pfam Description: Protease inhibitor/seed storage/LTP family

SEQ ID NO: 27075 - DNA, 639 bp, Zea mays
  misc_feature: Ceres CLONE 1400138-F
  misc_feature (639)..(639): n is a, c, t, g, unknown, or other
acagctggagctccccgcggtggcggccgctctataactagtggatcccccgggctgcaggaattcgcacgagaccattacctagaacatcctaatcaaaaagacgtccacagtgcgccgtgttctgccgcgcctgcgctcccaccgcgtgtccgcaactctgccccacctcacatccgcgtccgcaatccgcgcctccgccgccgcagcccttcctccgcgcagcgtccgtccatccatggctctccctacacgcagtgtcgtgccgctttccgcaatccgtgcctcaatccccttccttcgcgcagtgcccttccatccatggctcgcttccagaaatcccctacctacggcgcagcgtcgcagtcaggaatccgcccccaaaatcactacccgctctgcggcgatggaagggaatcaatccgtcaatggaaggaacacgtgcttcccccttccatcctcggcgctgcgcggattgcggattgcatggccatcgtttcgcgccccaatccgtcgatgcaaggaacgcgtgcttcccccttccatcctcggcgctgcgcgaattgcagattgcatggtcatcgtttcgccccagttcattggccgcatcagatggaagggtgccccgatccgcctcan

SEQ ID NO: 27076 - DNA, 597 bp, Zea mays
  misc_feature: Ceres CLONE 1400139-F
  misc_feature: Encodes the peptide sequence at SEQ ID NO. 27077
aaagctggagctccccgcggtggcggccgctctataactagtggatcccccgggctgcaggaattcgcacgagaccattacctagaacatcctaatcgaaaacacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggttagtggggtttattcggatgataataaccttcagcttgaggccaccacacagttccgcaaattgctctctatagagaggagtccccccatcgaagaagttatcaaaacagg

SEQ ID NO: 27077 - protein, 111 aa, Zea mays
  misc_feature: Ceres CLONE 1400139-F
  misc_feature (4)..(92): Pfam Name: IBB Pfam Description: Importin beta binding domain
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPIEEVIKT

SEQ ID NO: 27078 - DNA, 635 bp, Zea mays
  misc_feature: Ceres CLONE 1400151-F
aaagctggagctccccgcggtggcggccgctctagaactagtggatcccccgggctgcaggaattcgcacgagaccattacctagaacatcctaatcgaaaaagcctttccctctcttctctgctctttgcatctctctcttgttcctcccttcctctctaaaaaaagggttctgatccctttctagaagctcctgggtttctgttgccgacccgagctccccaggggcgctcaggaggcgccgagccggcgaccgctccggcggatctgaggagccgccgcggtcgctttgcctccgttgcgatactgcacaggttccttgtaaactattgattgggaaacactctgaagaagagtttgttggctgcataacatctcctgaagctggtttgaagtttgctgataggaaagatcatgggcgctctctgtgatttctgtggggagcagaggtctatggtttactgccgatcagatgcagcatccttgtgtttatcatgtgaccgtaatgtgcattcagctaatgctctttctcggcgtcatacaaggacacttttatgtgaccggtgtgcttcacagcctgctatggtccgctgtctagcagaaaatgcctcgctttgccaaaattgtgattggaa

SEQ ID NO: 27079 - DNA, 638 bp, Zea mays
  misc_feature: Ceres CLONE 1400156-F
aaagctggagctccccgcggtggcggccgctctagaactagtggatcccccgggctgcaggaattcgcacgagaccattacctagaacatcctaatcgaaaagttcctttcttccccactacaacatctggcaccgtgaaatctcggctacctccttctgacttctggtgcctctccgccggatacccaactccgatacccaccccaccatagcaaacccaccgcgagtgcgcgtgcctgttccgcatcatcaatggagctgatcactctcgtcccgcgactacatcaaccacatgctccacgacatccctgagatgagggtcctcgtcctcgacccccatgccgaatgagatgatgatcgtgccgaacagccacttcctatctgctgcaactaagattcattcctccttgagaccatgaacaacgcctccagctccatggagatcatgctgcacctcacggacgtactacttcctccgaccctccgctaacgacatccagaatctacgcatgcacctcgccatgatcgcgcttcgacgagaaccatctattcttctccacaatattgaagggcccgaacatttgaatacttgatgactactgatgaaaccatgcctgcgcagctagtgcaggacttc

SEQ ID NO: 27080 - DNA, 627 bp, Zea mays
  misc_feature: Ceres CLONE 1400160-F
  misc_feature: Translation starting site: 212
  misc_feature: SWISSPROT Homolog: EC 1.4.1.2 Glutamate dehydrogenase
  misc_feature (542)..(542): n is a, c, t, g, unknown, or other
tggagctccccgcggtggcggccgctctagaactagtggatcccccgggctgcaggaattcgcacgagaccattacctagaacatcctaatcgaaaaatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgatccgtcagtgcagagtgacatgaagctatggccgttcagggtcatcccagggcctggtgacaagcccatggatggtagggactacnagggcgagggagaacaagtttggttcttgaggaaatctccctccctggggccccctccaaaggaaggggattgggtgaaccctcc

SEQ ID NO: 27081 - DNA, 593 bp, Zea mays
  misc_feature: Ceres CLONE 1400161-F
  misc_feature (308)..(308): n is a, c, t, g, unknown, or other
  misc_feature (311)..(311): n is a, c, t, g, unknown, or other
  misc_feature (312)..(312): n is a, c, t, g, unknown, or other
  misc_feature (331)..(331): n is a, c, t, g, unknown, or other
  misc_feature (333)..(333): n is a, c, t, g, unknown, or other
  misc_feature (366)..(366): n is a, c, t, g, unknown, or other
  misc_feature (395)..(395): n is a, c, t, g, unknown, or other
  misc_feature (425)..(425): n is a, c, t, g, unknown, or other
aaagctggagctccccgcggtggcggccgctctagaactagtggatcccccgggctgcaggaattcgcacgagaccattacctagaacatcctaatcgaaaacactctcgctttcttctgtctcgcctcgccctcgcctttgttgatcttttcctctctcgcgttcccctctcgccttcttcttcctcccccacacccaccggtcgccgcccccgtcgccccgtcctcctcggtccagagacgagggggtccgcgccgttccgacgccacaccgcagccgcatcacatcacacaccgcctgctcccancgnntcgtcgccctacctcgatngngccccccggatcgctggtacctccgcgcgcggntccgaactcatcttcctccatcgactggnatcggcagcgtcggggtggtccgggccagncttccaaagggtatccatcgccagaacttttggaagtctggtgggggggaccggggggaaaagcccagttactggaaagggtaaactttccgttggccaagggaggggccaagggacaaactcccctgaatttatcgggccccggggggggcaagaaagggggggggg

SEQ ID NO: 27082 - DNA, 643 bp, Zea mays
  misc_feature: Ceres CLONE 1400171-F
  misc_feature: Translation starting site: 209
  misc_feature: SWISSPROT Homolog: EC 3.2.1.4 Cellulase
  misc_feature (526)..(526): n is a, c, t, g, unknown, or other
aaagctggagctccccgcggtggcggccgctctagaactagtggatcccccgggctgcaggaattcgcacgagaccattacctagaacatcctaattgaaaagaggaggcagtgcggagacgggagccagtggccagtgacagtgagcggcgacgttccagtgtccactgtccagtaggcgagcgaggaggtggtccattggccggccatggctcgtctccgctgcgtcttcgtcgtcttcgtcctgctctcgtctgccctccgccttccaggcgacgccattgcctcccgggggcaccatggccccgccgcacacgactacagggacgcgctcgtcaagtccatcctcttcttcgagggccagcggtcgggcaagctgccgccgtcgcagcgcgtgccctggcgcagggactcgggactctccgacggtcactccgccaaggggacctgggtgggcgggtaccacgacgctggtgacaacgtcaaagttcgggttccccgatggcgttcagcatgacgatgctgncgtggagcggggggtggaattttggcgggctcatgaagtcggagctgcagcacgcccaggacggccgtccggctggggcgccgactaccttctcaaggccacggcgcacccgaacac

SEQ ID NO: 27083 - DNA, 822 bp, Zea mays
  misc_feature: Ceres CLONE 1400177-F
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
tatggggcgggggggctgggggggggcgtataaaaaacgaccccgccgtgcgtatatagaggtggaaggggggggccggcnnnccccaagctggcgctccccgcggtggcggccgctctagaactagtggatcccccgggctgcaggaattcgcacgagaccattacctagaacatcctaatcgaaaaagcggaaggcccgccgcttccccttcttcattcccgtcccacacacgccgccgccgccggtgcggatcgcttccgtcccccccggtccgcgcgggctgcctgcgggagcagggtggcaggccactccggcaaccacgtggggtgggggatgcggacgacaccacccctatggctctggtcctcgccccgcagaagaaaggattggcgccaagcagggggaattttgggggaggcttggaaaggcatttccttcctggaaaaacatggggaaaaaaaaggggaatcctggcgtggggggagataattcttccccttgccaaaacggccaaagcccagtgttccttcccgaaaagagaaaaaaacttccttggggaattgggcgtgggggggacaataaaaccccggggggggggaaaaagactatcccggtctctttccctctccttgtcgggggggaacttaaaaacgaaaaaacaagcgggttaatataggctccccccctctataggctcacacaaaaaacaagaggagagggcggggagggcggcgaaattttttgggtggggagaggtattttataatttttttaagcgcctatttggggcggagaattgttggccgtggggtggccggg

SEQ ID NO: 27084 - DNA, 921 bp, Zea mays
  misc_feature: Ceres CLONE 1400188-F
  misc_feature (31)..(31): n is a, c, t, g, unknown, or other
  misc_feature (875)..(875): n is a, c, t, g, unknown, or other
ttgggggttggggggggcgtttcccctacanataatatcacacgggaacggcgcggaacaggagaaggggggcctatcggggagaatggcgctccccgcggtggaggccgctctagaatagtggatcccccgggctgcaggaatgcgcacgagaccattacctagaacatcctaatcgaaaaatctagcggcagagaccaaagtgcccatcggaccatgtcggccggccaaaccgctgtttctccgacgactacgccgcaggcgcaggtgcaatcggatccgaagggcgccggcgacgcgggcagttccaattctctctgggtggacgaccagacgcagacccctaaccgagggcctgctccaaccccaaccaaacgcagctgtcgacctcctcctctctggtgaaagggacccacggggaatcactggccctcgcggtgcctccttgttgggggcgggcacctccgagggtgattatgggtttgtgggtggggggggggggggggtgaacgggggagcgaagaggagagaaaccccgcctggaaagggtgggccggcggcggccccgccgagaggcggggtcccacccgggacgcggccgcaggagaagacactcacggaggggagaggaagcctccccgccccccctcgtgccgcaacttgcacccctcccgtgagatagaggagcgatgggcgccattcccctcacgccccgggccgccccgggctacagacctcccaagcgtgggtcatttgctcctccggcgctgggctcgaggcccccgatcatccctctcccggcagagaggcgggacaacgccgtcgtgtcccctcgcaacggaggcaggcggtcccagcaggaccgtggaggcgcnacgtgtgcaaggccagtggtgcgctgcggtcaaacaacgagaagag

SEQ ID NO: 27085 - DNA, 809 bp, Zea mays
  misc_feature: Ceres CLONE 1400192-F
  misc_feature: Encodes the peptide sequence at SEQ ID NO. 27086
  misc_feature (12)..(12): n is a, c, t, g, unknown, or other
  misc_feature (17)..(17): n is a, c, t, g, unknown, or other
  misc_feature (19)..(19): n is a, c, t, g, unknown, or other
tttttgtctttnccggntngcggggggcgctcgcccgggggcgggggggtgtggtggtggtggccccccccccccccccccacgctggggctccccgcggtggcggccgctctagaactagtggatcccccgggctgcaggaattcgcacgagaccattacctagaacatcctaatcgaaaaagtaatacggcacgccgttcaatctaccgggacggcgagacggagaatagaagacgtcagcactcagcagttcagcactgacccgtcggccgtcgccctcccggctcgcaaccgcatctctctcgggttctggcctcttcctagttcctaactaccaccgccacctctaccactggcctcaatctgcaaaccctagccctcgtcgccggggggcatggccgagaccgtcgacgaccaggtcagctactttcagggcggcacccggcatctccaaaacgggacctctgcaagggagatcgctcgccggggacaaacttggccaccttgcagctccggggggggtcaaccattaaccgggcgaacccgccttcttccggcccttccggtttcgggcctggggaccttccttcgcgggggaaccggggccctctttacgggttccggttgggggcgggagaatggcggatgtaaagttggggcgccccccgccccgcgggttggcgcattgcccggcttggcgggccccaagcaaggaggcccggggaaatcgcgggggggaaaaattggggggatagtctcccccgttcccacgcgggggatcctcgggggggggagaccctcggcccc

SEQ ID NO: 27086 - protein, 137 aa, Zea mays
  misc_feature: Ceres CLONE 1400192-F
MAETVDDQVSYFQGGTRHLQNGTSAREIARRGQTWPPCSSGGGQPLTGRTRLLPALPVSGLGTFLRGGTGALFTGSGWGRENGGCKVGAPPAPRVGALPGLAGPKQGGPGKSRGGKIGGIVSPVPTRGILGGGRPSA

SEQ ID NO: 27087 - DNA, 636 bp, Zea mays
  misc_feature: Ceres CLONE 1400194-F
  misc_feature: Encodes the peptide sequence at SEQ ID NO. 27088
  misc_feature (620)..(620): n is a, c, t, g, unknown, or other
  misc_feature (636)..(636): n is a, c, t, g, unknown, or other
gctctagaactagtggatcccccgggctgcaggaattcgcacgagaccattacctagaacatcctaatcgaaaagttagctgtgcctgctcccatttggagggacgaagttttatcctgtggttactgcctgtcgatgtcaagcaatttttatgtactctagagattagtttggctgcatcctccgtatctttaccttgttgaccagggatggagcttggtatacatggaaaggagaaacggatcgtacgacgatggcgcggttccagagttcagtggaaggggggctgggaggggatcagggatcaggacccgtccgctgctgcatccgaggtccagtctgactcgcgtcagacaccggacgagaagaagagcaagggctgccaatcatgccggggacccattctggtcatgcaggggcggcacaccccactcgggactggtccccccacagtcctgccaagatgatgatcctggaggtcctcgtcccgaagcctcaggcacccgaacaagaacccacaacatcgggggatttccacggacctgatccccgacgggggtccagccagggggaggggtgggaaaaacctcggcccctttttgagaagaaaaggggcttgngaatcctctggccccn

SEQ ID NO: 27088 - protein, 106 aa, Zea mays
  misc_feature: Ceres CLONE 1400194-F
MERRNGSYDDGAVPEFSGRGAGRGSGIRTRPLLHPRSSLTRVRHRTRRRARAANHAGDPFWSCRGGTPHSGLVPPQSCQDDDPGGPRPEASGTRTRTHNIGGFPRT

SEQ ID NO: 27089 - DNA, 722 bp, Zea mays
  misc_feature: Ceres CLONE 1400213-F
  misc_feature (574)..(574): n is a, c, t, g, unknown, or other
  misc_feature (641)..(641): n is a, c, t, g, unknown, or other
  misc_feature (722)..(722): n is a, c, t, g, unknown, or other
cgctctagaactagtggatcccccgggctgcaggaattcgcacgagaccattacctagaacatcctaatcgaaaaactgcgatgtggtcctctcctcctatcacctgacctccacacacacacacagacagacaggcacgcgcaagcaaaaattcattcatatatgcacgctcgttcgttgtcgatctcccccatcactgcacggcgcggcgcaacaagagcgagggattggagctcagctagtcgtctaatcagctagtaggtacgtgtagctaggctgcgctgcaccagctgccgtgcatgcagtgcatggcgcaggagggctctgaggcctccgtcgccagctccccgccgccccagccgccgccgtcggcctcctcctggtggcgcgacatgcagcacccggctgcctacggcgcgtggcctccgtcccccgcggcgaggtggccgcccccggtatcgatggcgccggcagcgacgcagcagcagcagcagcacggcggccgggcgacgacgtcctccgacggtctctcggcctccaacgccaccgtagcgtccttcaccaaccactccngggtccgggctcagcctggactcccgcggtgaagtttgaagcccgccggcgcttgcgccgccgcccncgaagagccacctctggaaaccagtcctcatgggcgcccgccgccaaggttggaaaggaacatgcaaggccgggcccgacn

SEQ ID NO: 27090 - DNA, 745 bp, Zea mays
  misc_feature: Ceres CLONE 1400215-F
  misc_feature (673)..(673): n is a, c, t, g, unknown, or other
aagctggagctcaccgcggtggcggccgctctagaactagtggatcccccgggctgcaggaattcgcacgagaccattacctagaacatcctaatcgaaaactcggcgcctccccgaccacagagtaaaacagttgcgccttcctccactactcagccctcttgcggaggaggtcctgctgatgcctcgcggcgtcgaatcggacgcggcgtacacgacacctagccgcttgcggaggagctcgcctacgcgcccaatccgccgacgctgctcctcggatcccccgagagattcaggccccgtctcgcctcgtcctgcctagagcctatgtgaggctctgtcctccaaaggtgcgtgggcgggatctgctgcctcgggttgcggtattccgaagtggcctgcccatactccaacagcggtccagtcgacttccccaagtgctcgacccctacgaggcagcgagcgtgcgtcacctcaaccccttgcatgcgctgacgctaaccctatctaggagacggagcggcggtacagcggctacgcggtcaaagataggaccagagcgtgcaataatagaaggcccgtgtcatgtgctgcttatacgtgcaaggatacgcaacagtgttcaagacacgtctgtggatcagtgacttgtattcagcctttcagtgacgantaaacgcagcttaagagcttgaaaattgtatctctcaagatacatggagtgcagatgccaaaataaagctat

SEQ ID NO: 27091 - DNA, 749 bp, Zea mays
  misc_feature: Ceres CLONE 1400217-F
  misc_feature: Encodes the peptide sequence at SEQ ID NO. 27092
  misc_feature (628)..(628): n is a, c, t, g, unknown, or other
  misc_feature (736)..(736): n is a, c, t, g, unknown, or other
aaagctggagctcatcgcggtggcggccgctctagaactagtggatcccccgggctgcaggaattcgcacgaaaccattacctagaacatcctaatcaaaatccaattctattttcgtgaaattaaatgacgtgcctagatgtttgggtgtgataaatcgagtctaaactctttgtcccttgcaggtgcagtttctactagcagcaatatcatggattctgaggtagtgcatgtggtagagtcgtcgtttgtagtgccgagcgagccgacaccgtcggaggggctctcgctctctccgctggacctcgttctgcccagcagaggccacaccccaacagtctacctgtacagccccagcgatgttgccgccgccgatggtttcttcgacgtggccaggctcaaggaggctatggccaagaccttggtggccttctaccccctcgctggccgcctcggcgtcaacaacgatggcaggggtagagatcacctgcaccggcgagggcgcacttctttgtggtcgctcatgctgaccctcagtgttggtgacatcgaggacgacttcaggccgtcgccggagctgagggaggctgtttggtccatgcgttgagccagcatccatcatattggncatacaggtgacttcctccaagttcgggaggtgtggtggctagggacggctctccaccacaccgccagcgatgccctcagcgcgtccacttccttcagacgtgtcagncttggggcaagta

SEQ ID NO: 27092 - protein, 155 aa, Zea mays
  misc_feature: Ceres CLONE 1400217-F
MFGCDKSSLNSLSLAGAVSTSSNIMDSEVVHVVESSFVVPSEPTPSEGLSLSPLDLVLPSRGHTPTVYLYSPSDVAAADGFFDVARLKEAMAKTLVAFYPLAGRLGVNNDGRGRDHLHRRGRTSLWSLMLTLSVGDIEDDFRPSPELREAVWSMR

SEQ ID NO: 27093 - DNA, 686 bp, Zea mays
  misc_feature: Ceres CLONE 1400218-F
  misc_feature: Encodes the peptide sequence at SEQ ID NO. 27094
aagctggagctccccgcggtggcggccgctctagaactagtggatcccccgggctgcaggaattcgcacgagaccattacctagaacatcctaatcgaaaaatttcttccccccttctctcgtcacgtccaataaaaaggggggaaaacttctctctctttttttccctcccccgcccgaatctgatgcttaaaccctcgccgggaggaggattccaatcccgacgcaccagcccgcgcccgccacctacagccgcgcccggatctccgccatggccgccgcgccgcaccaggcccagggccccgcagatagtgtgattccgctgcagtctgaacctgcacttgataataatcccctccagagtgcaaacgctagggaccagattctttctggtacggagaatgtgactacaggcaatgcacgcggcgggagctccttgaaatcgcaaaaggcccgccagagaaggctagctctgtcggaaaacctgaagaacaacttttttcctacatcaaaatgggtatgcaccacagccacaaccagtctatcttggagggtacatgaaccccttcaggacatggggaggaatatcccattatgtgagtatggagggggtcccattccgtatctcccggaatctacaatgacaaccagtccctcatgctatctccctggaaatgcaaacatcc

SEQ ID NO: 27094 - protein, 138 aa, Zea mays
  misc_feature: Ceres CLONE 1400218-F
MAAAPHQAQGPADSVIPLQSEPALDNNPLQSANARDQILSGTENVTTGNARGGSSLKSQKARQRRLALSENLKNNFFPTSKWVCTTATTSLSWRVHEPLQDMGRNIPLCEYGGGPIPYLPESTMTTSPSCYLPGNANI

SEQ ID NO: 27095 - DNA, 646 bp, Zea mays
  misc_feature: Ceres CLONE 1400219-F
  misc_feature: Encodes the peptide sequence at SEQ ID NO. 27096
  misc_feature (324)..(324): n is a, c, t, g, unknown, or other
  misc_feature (505)..(505): n is a, c, t, g, unknown, or other
  misc_feature (540)..(540): n is a, c, t, g, unknown, or other
  misc_feature (546)..(546): n is a, c, t, g, unknown, or other
  misc_feature (582)..(582): n is a, c, t, g, unknown, or other
  misc_feature (595)..(595): n is a, c, t, g, unknown, or other
  misc_feature (604)..(604): n is a, c, t, g, unknown, or other
aagctggagctccccgcggtggcggccgctctagaactagtggatcccccgggctgcaggaattcgcacgagaccattacctagaacatcctaatcgaaaacaaaatagcgagccgaagggggccacgaccacgagtcctccacctccctctccgccgcgtcgcacgcgcttgacgcgcgccgagagccgaatcggagccacgaggcagccgccccgggcggatcgatcctagggccagggcatgggcggaggggacgccgaccccggcggcgagcccgcggacgcgcaggccacgctccacatccggtgcaccaacggctccnagttcaccgtgcggaccgacctgggcgccaccgtcggggcgtttaaggcgatcgtcgcccacagctgcgacgtgccggcgccgcagcagcggctgatctacaaggggcggatctttgaggacgagcaaacccctagcagctacggtgtggagacagaccatacatccacatggtacgtggntgctgtgctatcaccaacatctactgcacctgcangcaccnagaaactaccactgctgctcctggcaagtcccgggnaacaggattgggngggcttggntgcaaatctgggtactaacggcgctggtgtaacagggggggg

SEQ ID NO: 27096 - protein, 134 aa, Zea mays
  misc_feature: Ceres CLONE 1400219-F
  misc_feature (22)..(91): Pfam Name: ubiquitin Pfam Description: Ubiquitin family
  misc_feature (28)..(28): Xaa is any aa, unknown, or other
  misc_feature (88)..(88): Xaa is any aa, unknown, or other
  misc_feature (100)..(100): Xaa is any aa, unknown, or other
  misc_feature (102)..(102): Xaa is any aa, unknown, or other
  misc_feature (114)..(114): Xaa is any aa, unknown, or other
  misc_feature (118)..(118): Xaa is any aa, unknown, or other
  misc_feature (121)..(121): Xaa is any aa, unknown, or other
MGGGDADPGGEPADAQATLHIRCTNGSXFTVRTDLGATVGAFKAIVAHSCDVPAPQQRLIYKGRIFEDEQTPSSYGVETDHTSTWYVXAVLSPTSTAPAXTXKLPLLLLASPGXQDWXGLXANLGTNGAGVTGG

SEQ ID NO: 27097 - DNA, 673 bp, Zea mays
  misc_feature: Ceres CLONE 1400225-F
  misc_feature: Encodes the peptide sequence at SEQ ID NO. 27098
  misc_feature (449)..(449): n is a, c, t, g, unknown, or other
  misc_feature (450)..(450): n is a, c, t, g, unknown, or other
aagctggagctccccgcggtggcggccgctctagaactagtggatcccccgggctgcaggaattcgcacgagaccattacctagaacatcctaatcggaaactccaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggagctggtggcgcactacctctgcgcgcgcgccgcggggcgccgcccgccggtgtccatcatcgccgaggtcgacctgtaccgcttcgacccctgggacctgccggagcgcgcccnntctcggcgccgcgagtggtacttcttcacgccgcggggacgcaggtaccccaacggttcccgccccaaccgcggcggcgggtcgggctactggaaagccacgggcggggacaagcccctggaagcacggggccggacggcggggaacaagaggggctcgtggttcaccacaggaagccgcccgggggggttaaaacggaagggataatgaccaaaaacccccc

SEQ ID NO: 27098 - protein, 139 aa, Zea mays
  misc_feature: Ceres CLONE 1400225-F
  misc_feature (21)..(133): Pfam Name: NAM Pfam Description: No apical meristem (NAM) protein
  misc_feature (71)..(71): Xaa is any aa, unknown, or other
MAAVQQQQQQQRRDAEAELNLPPGFRFHPTDEELVAHYLCARAAGRRPPVSIIAEVDLYRFDPWDLPERAXSRRREWYFFTPRGRRYPNGSRPNRGGGSGYWKATGGDKPLEARGRTAGNKRGSWFTTGSRPGGLKRKG

SEQ ID NO: 27099 - DNA, 627 bp, Zea mays
  misc_feature: Ceres CLONE 1400226-F
  misc_feature: Encodes the peptide sequence at SEQ ID NO. 27100
  misc_feature (155)..(155): n is a, c, t, g, unknown, or other
  misc_feature (166)..(166): n is a, c, t, g, unknown, or other
  misc_feature (167)..(167): n is a, c, t, g, unknown, or other
  misc_feature (390)..(390): n is a, c, t, g, unknown, or other
  misc_feature (482)..(482): n is a, c, t, g, unknown, or other
  misc_feature (483)..(483): n is a, c, t, g, unknown, or other
  misc_feature (495)..(495): n is a, c, t, g, unknown, or other
  misc_feature (517)..(517): n is a, c, t, g, unknown, or other
  misc_feature (597)..(597): n is a, c, t, g, unknown, or other
aaagctggagctccccgcggtggcggccgctctagaactagtggatcccccgggctgcaggaattcgcacgagaccattacctagaacatcctaatcgaaaaaaactccggacgagccttccgcgcgacgctgcacggctccgccagccacccgntaaaaccctanngacggctagccggcgcacggaagcgggcagcggagcggaggtgagcctctcctgcgtcggattgtccccgcccccgctaggcgccatgaagctgacggtgaagaccctcaagggaacgcacttcgagatccgggtgcagcccaacgacacgattatggctgtgaagaagaatattgaagagatacaagggaaagacagctatccatggggccaacaactgctngattttcaatgggaaggtcttgaaagatgaaagtacattggaagagaaataagtcatgaggatgggtttctagttgtcatgcttagtaaggnntaaacatctggntcaactggaacttcatcttccnagcactcaaacactcctgcaacaggcagggcacctcctctagaggccccacaacagctcctcacccccggtggcacccanttacacttctcagcctgaaagacttcctgc

SEQ ID NO: 27100 - protein, 55 aa, Zea mays
  misc_feature: Ceres CLONE 1400226-F
MKLTVKTLKGTHFEIRVQPNDTIMAVKKNIEEIQGKDSYPWGQQLLDFQWEGLER

SEQ ID NO: 27101 - DNA, 641 bp, Zea mays
  misc_feature: Ceres CLONE 1400228-F
  misc_feature: Encodes the peptide sequence at SEQ ID NO. 27102
  misc_feature (456)..(456): n is a, c, t, g, unknown, or other
  misc_feature (457)..(457): n is a, c, t, g, unknown, or other
tccccgcggtggcggccgctctagaactagtggatcccccgggctgcaggaattcccacgagaccattacctagaacatcctaatcgaaaaagcctgcgctccccttctttcccgttcggctcacagcgaagaaggaagccggttagggtttccacctcctttcccctcctctccttcagcgacgaccgcgggccacaccctcgatatccttcccctcggacccggaggcgagcagcagcctccagcgcctgccacgcctgcccgtctcgttattgggaggattcgccatgtctgacatggagtccgtcgcagctcttatgaactcgacaagctccaagatacagcagcttcaggaggcatttgctgagcttgagagccagagcacggtttccatgaacctcaagtggaagcagcttgaagaccactttcgtggtcttgaaacagtccctcagaannaagttgacgagctaaaagagcaggagaaggagttccaggagactgtcgcaaaatcagagcagattctggagcagcgggaggcagctgttgtggcaaaggactgacctctttgaaaaagttgcaggaaaaaaggaaactgcattaatatgatctttagcaaggccagctttcccttacgggtcca

SEQ ID NO: 27102 - protein, 90 aa, Zea mays
  misc_feature: Ceres CLONE 1400228-F
  misc_feature (56)..(56): Xaa is any aa, unknown, or other
  misc_feature (57)..(57): Xaa is any aa, unknown, or other
MSDMESVAALMNSTSSKIQQLQEAFAELESQSTVSMNLKWKQLEDHFRGLETVPQXXVDELKEQEKEFQETVAKSEQILEQREAAVVAKD

SEQ ID NO: 27103 - DNA, 686 bp, Zea mays
  misc_feature: Ceres CLONE 1400233-F
  misc_feature: Encodes the peptide sequence at SEQ ID NO. 27104
ggagctccccgcggtggcggccgctctagaactagtggatcccccgggctgcaggaattcgcacgagaccattacctagaacatcctaatcgaaaagtaagagaggattttgctaggtttttgcccccaaccgcccaactgcgcgtgctcctgccgacctcccacccctccactccccggcggttggcggctgtctcgccgaagcgacccagccgatatggcgaagggcgacgacgcgctggcgcggaagcgcaaccgtgtgcgccgcaagcgcctccgtagcagcgagaacgctgtttccgcgcgtgtcgcggcgatcatcgcctccaagcaccgccgcaagtcggggaagcgccgcgcctgcgagggcatgtgcttctcgcttcccacgcccgacgacccgttcaacgagcgccatggcaggaagcacaagctcgatgacgagccggccgacgacacagccgccgacgccgcttgagaacagcggcaccccaagaggaaagggcgcgacaaccaaaaagcaccaagccgttggcaaagtatgggcgccgaaggcaaatccaaagggcggttcccgaaaagggaaaacggttggcggaaggtgggcccggggggaaattccaagacggggccggccaaagttccctggggggggctggtcccaaacgcttattccgggaaagggg

SEQ ID NO: 27104 - protein, 86 aa, Zea mays
  misc_feature: Ceres CLONE 1400233-F
MAKGDDALARKRNRVRRKRLRSSENAVSARVAAIIASKHRRKSGKRRACEGMCFSLPTPDDPFNERHGRKHKLDDEPADDTAADAA

SEQ ID NO: 27105 - DNA, 671 bp, Zea mays
  misc_feature: Ceres CLONE 1400234-F
  misc_feature: Encodes the peptide sequence at SEQ ID NO. 27106
  misc_feature (580)..(580): n is a, c, t, g, unknown, or other
aaagctggagctccccgcggtggcggccgctctagaactagtggatcccccgggctgcaggaattcgcacgagaccattacctagaacatcctaatcgaaaaaacacaacaatctctctcccctcactccctctctgcagcgcgcagctttcaaagcgttgggagagatggcagaggagacgcaaccagaggccgcagccgccgccgcgcccgccgcggccgaggtagtcgtgaccgaagctgcgccggcggaggcggaggtgcctgcggcggcggaagctgaagccgaggccaaggatgagaagaaaggtgacgaggcggagctcaccgccgatgacgcgggggtggggaccggctcgttcaaggaggaaagcaacctggtggaagacctgcccgacccggagaagaaggcgctcgacgagttcaagcagctgatcgctgctgccctcgccgccggtgagttcaacctgcctcccccgccgccgccgccgaaggccaaggaaacaaaggtggaggaagccaaggcccaggtggctgcggatgccccggttgaggaggtcaagacggaggtgccgccggncgaggaggccaaggctgagacactggctgaggaagccaagccttccgagcccgagccgcaggagaagactgtcgtggtcactgaggaggag

SEQ ID NO: 27106 - protein, 168 aa, Zea mays
  misc_feature: Ceres CLONE 1400234-F
  misc_feature (138)..(138): Xaa is any aa, unknown, or other
MAEETQPEAAAAAAPAAAEVVVTEAAPAEAEVPAAAEAEAEAKDEKKGDEAELTADDAGVGTGSFKEESNLVEDLPDPEKKALDEFKQLIAAALAAGEFNLPPPPPPPKAKETKVEEAKAQVAADAPVEEVKTEVPPXEEAKAETLAEEAKPSEPEPQEKTVVVTEEE

SEQ ID NO: 27107 - DNA, 801 bp, Zea mays
  misc_feature: Ceres CLONE 1400237-F
caagctggagctcaccgcggtggcggccgctctacactagtggatcccccgggctgcaggaattcgcacgagaccattacctagaacatcctaatctaaaagacaaccagacgcgccagggtttcaggcttccacgaatctccccgccgccctcaattcccctcggcgccgccgcctcctcccctcgcttcggtcctcggttagttaaccatccaggttctgtcaagatgtctgatagccatgagactgacaggaacattgagatttggacaattaagaaactgatccaggcatctggaatcacccagacccactgtttttttgcttgatctccccgaccatgtctccacgagacaaggatgcccgtgtgttcaatatggccacccccccctcctctttgtgtccccaacaccctcccccctctagtctctcccactccccccgccccctcttaacatatatttcccccccccccccctaatcctgctccccattcccccgttccctccctgcgccccacttcactcggatgaatccttcctcctctctcaccaactctacctctcccttgatcccctctctcctcgtcttcgacacccgacctaaaataacttactttctgtctatatcccccgcagatcgccgtattacatacccccacctcacttattatgactcctccttttgttccttacctatccctatcccgtggtcgattccacctcacatacgcggcctatcttcattcttcctcgtactctcaccccaccactccctcctttgtcctacacctcatctgcc

SEQ ID NO: 27108 - DNA, 660 bp, Zea mays
  misc_feature: Ceres CLONE 1400240-F
  misc_feature: Encodes the peptide sequence at SEQ ID NO. 27109
  misc_feature (660)..(660): n is a, c, t, g, unknown, or other
tccccgcggtggcggccgctctagaactagtggatcccccgggctgcaggaattcgcacgagaccattacctagaacatcctaatcgaaaagtaagagaggattttgctaggtttttgcccccaaccgcccaactgcgcgtgctcctgccgacctcccacccctccactccccggcggttggcggctgtctcgccgaagcgacccagccgatatggcgaagggcgacgacgcgctggcgcggaagcgcaaccgtgtgcgccgcaagcgcctccgtatcaacgagaacgctgtttccgcgcgtgtcgcggcgatgatcgcctccaagcaccgccgcaagtcgcgaaagcgccccgcctgcgagggcatgtgcttctcgctccccacgcccgacagaccgttcaacgagcgccatgggcagaagcacaagctccaagacgagccgggcgacgacacaacccgccacgccgctgaagaaccgcgccaaccccaaaaaaaaacggcgccgaacaccaaaaaccaacaacacgttggcaaagcatgggcgcccaaggccaaataccaaaggccgctaccccaaaaaggaaaaaccggcgcgggcgagggggtcccccaagggaaactccccaccgggcccaccccaaattctccggtggcgagtn

SEQ ID NO: 27109 - protein, 149 aa, Zea mays
  misc_feature: Ceres CLONE 1400240-F
MAKGDDALARKRNRVRRKRLRINENAVSARVAAMIASKHRRKSRKRPACEGMCFSLPTPDRPFNERHGQKHKLQDEPGDDTTRHAAEEPRQPQKKTAPNTKNQQHVGKAWAPKAKYQRPLPQKGKTGAGEGVPQGKLPTGPTPNSPVAS

SEQ ID NO: 27110 - DNA, 698 bp, Zea mays
  misc_feature: Ceres CLONE 1400245-F
  misc_feature: Encodes the peptide sequence at SEQ ID NO. 27111
  misc_feature (444)..(444): n is a, c, t, g, unknown, or other
aaagctggagctccccgcggtggcggccgctctagaactagtggatcccccgggctgcaggaattcgcacgagaccattacctagaacatcctaaaaaaaaaacggttaaacccatgccgctaatcgacgccgccgcctcggcggtcgcgccgcccccaccccggcgagtggctcaactccgcttcttcagcactcgcagacccggaatcctatccctaactgccaccagctgctccccctcccctccgcccccggtcgctgcggaggtgcctgcggcgccacaggaagcgaagtcgaagccgaggccacggcggtacccgaagcagtaccccggcgagtcggtgggcgttgctgaggagatgcgctttgtcgccatgcgcctgcgtaaccccaagcgcaccaccataaaagacaagtcggggacggaggacgcggacgccggngcgggggtgtcggagggcgaggctgaggaggacgacggcggcggcgtgaaggaggaacacgaggaggaggatgagggcgagctcgaggaaggggaatggatgcccagcatggaggggttcgtgcgataactggtggacagcaggctcgtcttcggaaccatcgagcgggtcggggccgagtccaccgaaggcgcctggggagcacagatctaatccccattcttggttgggaggggcaattggattaattgccg

SEQ ID NO: 27111 - protein, 152 aa, Zea mays
  misc_feature: Ceres CLONE 1400245-F
MPLIDAAASAVAPPPPRRVAQLRFFSTRRPGILSLTATSCSPSPPPPVAAEVPAAPQEAKSKPRPRRYPKQYPGESVGVAEEMRFVAMRLRNPKRTTIKDKSGTEDADAGAGVSEGEAEEDDGGGVKEEHEEEDEGELEEGEWMPSMEGFVR

SEQ ID NO: 27112 - DNA, 775 bp, Zea mays
  misc_feature: Ceres CLONE 1400247-F
  misc_feature: Encodes the peptide sequence at SEQ ID NO. 27113
aaagctggagctccccgcggtggcggccgctctatcaactagtggatcccccgggctgcaggaattcgcacgagaccattacctagaacatcctaatcgaaaacttgccttcgtctccgcctcccgtctttcctcaagaagtcgattcccttccccaagaacccaagcccccaccatgacaagctcctcctctccttcccgaaaggcgctgagcaagatcgcttgcaatcggctgcagaaggaactcgccgagtggcaactcagcccccctgctggattcaagcacaaggtctccgataacctacaaaggtggctaattgaggttactggagcgcccgcacaccctttccgccgccaagacccaccagtcgccggctgcattccccgacccccaccccttgtgtcgcacccaaccccccccaatatcacctcccttgcttccctcctccccctaaaattttttcacctccccctccgcctgctccacatcctcctatccccttccgtccccctcccatacgttctctttcttcgtcctccgcacccaacccataaaacctacccctaccatcccacccccttattggcccaccaggtccaaacatttaggttctctccataatcccaccgccagcagcaaaacaacgcccgagcatcttagtaaccgcactttcttccgtcacaaaccctctcacgttatttttcaacaccaatcgccggggtgtaaaagtgaccggcacggaggaccaagtacactgttacggactacttcgcc

SEQ ID NO: 27113 - protein, 148 aa, Zea mays
  misc_feature: Ceres CLONE 1400247-F
  misc_feature: SWISSPROT Homolog: EC 6.3.2.19 Ubiquitin--protein ligase
MTSSSSPSRKALSKIACNRLQKELAEWQLSPPAGFKHKVSDNLQRWLIEVTGAPAHPFRRQDPPVAGCIPRPPPLVSHPTPPNITSLASLLPLKFFHLPLRLLHILLSPSVPLPYVLFLRPPHPTHKTYPYHPTPLLAHQVQTFRFSP

SEQ ID NO: 27114 - DNA, 716 bp, Zea mays
  misc_feature: Ceres CLONE 1400249-F
  misc_feature: Encodes the peptide sequence at SEQ ID NO. 27115
  misc_feature (461)..(461): n is a, c, t, g, unknown, or other
caagagctggagctccccgcggtggcggccgctctagaactagtggatcccccgggctgcaggaattcgcacgagaccattacctagaacatcctaatcaaaaagagcctgtttagcagcgctatccgcttggcccaattcgtctactgctcctccagctcctccgctgcgccgccggtcgccgcccgacaccgccgaagaagagcagacgccgagtccaggacgtcgccgcggggctcggggaacgcggtgttgccatcgcgaggaaggtcggaagttcgctgttcgcccgccggatcggcaccgtcgccaccgcccatggcaaccgtcgcccccgtcgtctccgacctcgtcgacttcctcaacgcgtcgcccaccgcctttcacgccgttgacgaggcgaagcggcggctgaaggcggcggggttcgtgcagctgtcggagcgggaggagtgggcggntctcgagcccgggcgcaagtacttcttcacacgcaaccactccactattgtcgcttttgccatcggcgcaaaatacgttgctggcaatgggttccacatcatcggtgcacacactgacagcccttgcctgaagctcaagcctgtctccaaggtaaccaaaggaggttaccttgaggttggggttcaacgtatggtgggtgggttgtgggacccatgggttgaccgggaactaactgtatctggcccagtgattat

SEQ ID NO: 27115 - protein, 132 aa, Zea mays
  misc_feature: Ceres CLONE 1400249-F
  misc_feature: SWISSPROT Homolog: EC 3.4.11.21 Aspartyl aminopeptidase
  misc_feature (48)..(48): Xaa is any aa, unknown, or other
MATVAPVVSDLVDFLNASPTAFHAVDEAKRRLKAAGFVQLSEREEWAXLEPGRKYFFTRNHSTIVAFAIGAKYVAGNGFHIIGAHTDSPCLKLKPVSKVTKGGYLEVGVQRMVGGLWDPWVDRELTVSGPVI

SEQ ID NO: 27116 - DNA, 718 bp, Zea mays
  misc_feature: Ceres CLONE 1400250-F
  misc_feature: Encodes the peptide sequence at SEQ ID NO. 27117
aaagctggagctccccgcggtggcggccgctctagaactagtggatcccccgggctgcaggaattcgcacgagaccattacctagaacatcctaatcgaaaagccaactcgcacgcagcagtacgacgtctctcctctgggtctggggccgagacacctagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtatacatctccgtggcggggctcaaggtgcgcagcatcgagatggtggcgcgctccgtgctcccaggttctacgcgggcgacgtgcacccggagagctggagggtgttcagctccttcgggaggggctacggcggtacggccagccccagggggaggggccgagccctgcgccgggcctttccggggggcgggaaggggcggcgggagcgggtgggagggggggagggcggggcggggccgcgtgcggagggccgtcgcggggggggggcctttcggggctcgagcgaggtgcgcggag

SEQ ID NO: 27117 - protein, 180 aa, Zea mays
  misc_feature: Ceres CLONE 1400250-F
  misc_feature: SWISSPROT Homolog: EC 2.3.1.15 Glycerol-3-phosphate O-acyltransferase
MVASPRFKPIEECCSEGRSEQTVAADLDGTLLISRSAFPYYLLVALEAGSVLRAALLLLSVPFVYVTYAFFSESLAISTLVYISVAGLKVRSIEMVARSVLPGSTRATCTRRAGGCSAPSGGATAVRPAPGGGAEPCAGPFRGAGRGGGSGWEGGRAGRGRVRRAVAGGGPFGARARCAE

SEQ ID NO: 27118 - DNA, 698 bp, Zea mays
  misc_feature: Ceres CLONE 1400252-F
  misc_feature: Encodes the peptide sequence at SEQ ID NO. 27119
  misc_feature (614)..(614): n is a, c, t, g, unknown, or other
  misc_feature (684)..(684): n is a, c, t, g, unknown, or other
aaagctggagctccccgcggtggcggccgctctagaactagtggatcccccgggctgcaggaattcgcacgagaccattacctagaacatcctaatcgaaaactccttcccctccctctttccacgacccctacagaaaccgaatgccatcgacgtgctccgtccactctcccttaccctgcgacctcctcccctacgcctcctagccgagtggtcaaagctaaccctatatgggcggcgacacctctacagtcgcggcgcgctttgcctttttcccgccgagcccgccatcgtacgggttcgagcagccggcgccgcttccggcccctgccacacccgagcctccggccccggacacatccaaggcgccgcctcctggcccggccacatgcaagacgacgcctccggcccgggctgcacccgagccgcctgcagtgcaagaggataagggcgtggttgcgacgagtgagctcatggacgtgccgcggaggcataacgtggaggcgcgacggatgcggacgaagcggttctcggaggtgttcgtgatgcatgtgcgactggcggcggtcaagctcacgctgctctactcccagcggaacgccgccaacctcggncagatgtactaggtcttcgtcaagatcagcgatcatcttagcgcaagcttggtggtatgactattctggntatgagcatctact

SEQ ID NO: 27119 - protein, 131 aa, Zea mays
  misc_feature: Ceres CLONE 1400252-F
MGGDTSTVAARFAFFPPSPPSYGFEQPAPLPAPATPEPPAPDTSKAPPPGPATCKTTPPARAAPEPPAVQEDKGVVATSELMDVPRRHNVEARRMRTKRFSEVFVMHVRLAAVKLTLLYSQRNAANLGQMY

SEQ ID NO: 27120 - DNA, 720 bp, Zea mays
  misc_feature: Ceres CLONE 1400253-F
  misc_feature: Encodes the peptide sequence at SEQ ID NO. 27121
  misc_feature (652)..(652): n is a, c, t, g, unknown, or other
aagctggagctccccgcggtggcggccgctctagaactagtggatcccccgggctgcaggaattcgcacgagaccattacctagaacatcctaatcgaaaaatcttgtcttgatcctctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggccgcggcgggcgccgacggaggcgaagctgaaggtggccatcaatgggttcggccgcatcgggcgcaacttcctgcggtgctggcacgggcgcggcgacgcctcgcccctcgacgtcatcgccatcaacgacaccggaggcgtcaagcaggcgtcccacctgctcaagtacgactccacgctcggcatcttcgatgccgacgtcaagcccgtcggcgacaacgccatctccgtcgacggcaaggtcatcaaggtcgtgtccgaccgcaacctcagcaacctgccgtggggcgagctcggcatcgacctcgtcatcgagggcaccggcgtcttcgtcgacccgcgaggncgcgtgaagcacatccaggcggggggccaagaggtgctcatcacggcgcccggcaggtcgacatcccc

SEQ ID NO: 27121 - protein, 196 aa, Zea mays
  misc_feature: Ceres CLONE 1400253-F
  misc_feature (68)..(196): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
MASSMLSATTVPLQQGGGLSEFSGLRSSASLPMRRNATSDDFMSAVSFRTHAVGTSGGPRRAPTEAKLKVAINGFGRIGRNFLRCWHGRGDASPLDVIAINDTGGVKQASHLLKYDSTLGIFDADVKPVGDNAISVDGKVIKVVSDRNLSNLPWGELGIDLVIEGTGVFVDPRGRVKHIQAGGQEVLITAPGRSTS

SEQ ID NO: 27122 - DNA, 731 bp, Zea mays
  misc_feature: Ceres CLONE 1400254-F
  misc_feature: Pfam Name: GATase_2 Pfam Description: Glutamine amidotransferases class-II
  misc_feature: SWISSPROT Homolog: EC 6.3.5.4 Asparagine synthase (glutamine-hydrolyzing)
  misc_feature (549)..(549): n is a, c, t, g, unknown, or other
aagctggagctcaccgcggtggcggccgctctagaactagtggatcccccgggctgcaggaattcgcacgagaccattacctagaacatcctaatcgaaaaaataagatttaccgagaactagcgagtatgtcgcgacatacttgctgtgctcggatgtcccaacaatggcaacgaacccagcactacttcccgagtgctggagctgacaagtcggctaattcacgtacctgctgactgcaccgtgctccggcagatgggcgatagctacctctctcacaagcgcgtaggcatcatcaactggggctctggggactactccctctactactagtacgagtcctggatcatcgccgtgaatcacagatctacaactgcatggagctcacgagccgcctcagctggtgaagccacagattcagtaccggcagcgactgcgaggtcataactcacctgaacgagtatgatgcagaagatcctcgtgaatggtgcacgacctattctgcttcgtgctgatacacactcgctatggcgcacgcacgggcaccancttattcatggctgctcgcgaggccctgggggtgacgctactatagtctgatcgggagctgatgcatcagttcgtatactccggtaactgaggcactgcacgactagcgtggcacttagagatcttctctcggatcatctctattcagaacaccgggtattcacatgggtacaccctcctgc

SEQ ID NO: 27123 - DNA, 724 bp, Zea mays
  misc_feature: Ceres CLONE 1400256-F
aaagctggagctccccgcggtggcggccgctctataactagtggatcccccgggctgcaggaattcgcacgagaccattacctagaacatcctaatcgaaaaccaaaaagcccaatcttttactcgtgctcttttcttcctttctttgtcccggtgcggcgtgtgctcgcgtggcgtcaagagcggcggcagctcggcggtgttcacggccgagtgctcccacgccttccacttcccctgcatcgcagcccacgcgcgctcctcctccgccaacggcgttctgtcctgccccgtctgcgcctcgccgtggcgccaggcgcccttcctcgcctccctccgcctccactgctccttccacgacgacaagcaccgaggaggaggcgacggccgcaagacgccgccgcccgccaagctatacgacgacgacgagccgctgctggcgcccaaggccgcggccaacggtggcggcttcaacccgatcccggaggccgacgaggacgacgagtaggagcagggcgccgccgagttcaggggcttcttcccatgccccaggagtaggaccacctcgggcctggccatcaccgtggcgcccgaggccgcgctcgtgtcgtcgggccgccgccacggcaagtacgtggtggccgtcaaggtcaggcgcccgggctgcgctcgtcggcggcggccccgcggcgcgcgccatcgacctggtcaccgtgctggacgt

SEQ ID NO: 27124 - DNA, 716 bp, Zea mays
  misc_feature: Ceres CLONE 1400261-F
  misc_feature: Encodes the peptide sequence at SEQ ID NO. 27125
aaagctggagctccccgcggtggcggccgctctagaactagtggatcccccgggctgcaggaattcgcacgagaccattacctagaacatcctaatcgaaaaacacaacaacaacaaccatctccaacgcagcaagcagacagaaggacaggcaggcagcgagtgcaaccgcgagagcgatcagcgatgggctccttcttctcgaccttagtgacgccccctccggccgccgacgacccgaactgcgccgtggtggccgcgcactccaaggccacctacgacgagcagtgggcggcccacaagagcagcagcaagctgatggtgatcgacttctcggcgtcctggtgcgggccctgccgcttcatcgagccggccttcaaggagctggcctcccgcttcaccgatgccatcttcgtcaaggttgacgtcgacgagctcgcggaggtcgcaaggacatggaaggtagaggcgatgcccacgttcgtgctggtcaaggatggcaaggaggtagcccgggcgattggccctaccaccgccgagctttacccgaagattccgccgctcgccacattttgttttcctcgtctaaattaacagggcatacccgctatctttcttctggttcctctccccccttggcccgccccggcgaaggcttatcgagaatccttcccttcccctaccgtcgacgccccctattccgccccccctcccct

SEQ ID NO: 27125 - protein, 135 aa, Zea mays
  misc_feature: Ceres CLONE 1400261-F
  misc_feature (22)..(123): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MGSFFSTLVTPPPAADDPNCAVVAAHSKATYDEQWAAHKSSSKLMVIDFSASWCGPCRFIEPAFKELASRFTDAIFVKVDVDELAEVARTWKVEAMPTFVLVKDGKEVARAIGPTTAELYPKIPPLATFCFPRLN

SEQ ID NO: 27126 - DNA, 686 bp, Zea mays
  misc_feature: Ceres CLONE 1400263-F
  misc_feature: Translation starting site: 390
aaagctggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgccccgggagatggcagcggaggttgccgccgctgcggcgctcgggtgccgacgtggcggagctccaggtcggctgcctcgacagcttcgagccatgcagggacctgcccgtgcttctcgcccagccccgctcgctccccgtcatcgtcactacaggcccgatttggggaggggagccagtacgcaggcgaagatgagccacggtttgaggcgcttctactgg

SEQ ID NO: 27127 - DNA, 641 bp, Zea mays
  misc_feature: Ceres CLONE 1400267-F
  misc_feature (182)..(182): n is a, c, t, g, unknown, or other
  misc_feature (183)..(183): n is a, c, t, g, unknown, or other
aagctggagctccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctnngacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacgggcttcgtgtgggctccggcagcggcggcagggtggaccactactttcccccagggcgggccggcaccgtgtcctacgggggccaagggggcggcggggggccgaaaaagggcccgggttcaagaaaatcccgggccgggcaaggccaaggaaaaaggcttgcttggggggccacccccccccccgaaaaatttggggggtgaaagaaacccgcccccaggggggaaagcccccccgggagggggcctttggggggggctgggccccccaaaatttccccccgggggggggcctttaggggggg

SEQ ID NO: 27128 - DNA, 730 bp, Zea mays
  misc_feature: Ceres CLONE 1400268-F
  misc_feature: Encodes the peptide sequence at SEQ ID NO. 27129
  misc_feature (485)..(485): n is a, c, t, g, unknown, or other
  misc_feature (494)..(494): n is a, c, t, g, unknown, or other
  misc_feature (524)..(524): n is a, c, t, g, unknown, or other
  misc_feature (684)..(684): n is a, c, t, g, unknown, or other
tggagctccccgcggtggcggccgctctagaactagtggatcccccgggctgcaggaattcgcacgagaccattacctagaacatcctaatcaaaaattttccaaatccgtctacgccctcacgcacgcggcccaactagcctaacaaaccctagctagatttagaaaaaaagtttgtccccaatccgaaccgacgaggagctcgccgccgtgagatgtccgagtacgacgagcgctaccagggcaacgccgacatgcccgcagccgaaggcggctatccgcaggccgagtacgccgccgccgccgcgcctgccgccgggggttcgccgcccgcagacagcaagccctccgggttctccgaccacgccgacggccgctcctcccagcaccagcatgagacacaatcacatggacagtggttcctcgaaatctcgagaaagggaccgagaacgcgataagggcaaggatagggagcgtgacagggnatcgtgggncgagaaaaaggggagggaccgagacagggnataagggatcgtgaaagaagtgacagagacagagatcgcgatcgccaccacagggaccatcgagagcgcagcgagaaagggaaccacccgtgatcgttctgatgatcgtgacgtcacccggtgatggtcgtgacgccacccggtgatgatcgtgattctnaaaggaaaaagagatcgtggaagagatgggtcatcgtaggcatcgc

SEQ ID NO: 27129 - protein, 80 aa, Zea mays; identical to SEQ ID NO: 21080
  misc_feature: Ceres CLONE 1400268-F

SEQ ID NO: 27130 - DNA, 695 bp, Zea mays
  misc_feature: Ceres CLONE 1400272-F
  misc_feature: Encodes the peptide sequence at SEQ ID NO. 27131
  misc_feature (228)..(228): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (491)..(491): n is a, c, t, g, unknown, or other
  misc_feature (555)..(555): n is a, c, t, g, unknown, or other
  misc_feature (556)..(556): n is a, c, t, g, unknown, or other
  misc_feature (579)..(579): n is a, c, t, g, unknown, or other
  misc_feature (604)..(604): n is a, c, t, g, unknown, or other
  misc_feature (613)..(613): n is a, c, t, g, unknown, or other
  misc_feature (649)..(649): n is a, c, t, g, unknown, or other
  misc_feature (669)..(669): n is a, c, t, g, unknown, or other
aaagctggagctccccgcggtggcggccgctctagaactagtggatcccccgggctgcaggaattcgcacgagaccattacctagaacatcctaatcgaaaaccgtcgatctcgtcggcgacgccactacctctcgccgtccggtgccaccatccgcctccgactcctgcgacccagccacggttcccgaggatacgggccgagtccgggatgggggtggtggtagangcgggaggagtgnnnactcnnncccttcgcctacccgctcctctccgccgccgccctcgccgcggggctcctcctcccttacctttccccgaggactgcgccgcacgccaccggaccctcgtctcccttcgacgtgggcgccgcacccttcctccggttccgccgcgccttcctcgtcctcttctccctcgcgtccgtggttgaaggtatccattccgtgtttggggaggatgagttcgtgcggggtgggtttggcagaaagnagacgaccgcgcgccttgcctctaccactgcagctgcgctggtccccggtggcatttctggcgnnatctccgacaaaataggatcacngaagggcttgcatattgtactgggnaccttctgntggcagtttgtgttgtgcaaaatttcagtggccttnactgtatctggatccctctnttccttcttgccttttgcccctttaa

SEQ ID NO: 27131 - protein, 37 aa, Zea mays
  misc_feature: Ceres CLONE 1400272-F
  misc_feature (11)..(11): Xaa is any aa, unknown, or other
  misc_feature (33)..(33): Xaa is any aa, unknown, or other
MSSCGVGLAEXRRPRALPLPLQLRWSPVAFLAXSPTK

SEQ ID NO: 27132 - DNA, 643 bp, Zea mays
  misc_feature: Ceres CLONE 1400275-F
  misc_feature: Encodes the peptide sequence at SEQ ID NO. 27133
  misc_feature (329)..(329): n is a, c, t, g, unknown, or other
cgctctagaactagtggatcccccgggctgcaggaattcgcacgagaccattacctagaacatcctaatcgaaaaagcacctccgttcccagccacgagacgacaaacccctagcctccctccccctctctcaccaggccaccacctcgccggaacccggcgcctcgaatgatcacgggatcatcggccgccgccggccgcggctgctcaggatcgtcgaatatggtgaacgtcgctgccgcagaccggaataagcgcatcacgaagatcgagccctatcgggaccgcgtatagaccgactcacagttcttcgacaagtcgtggcggangctacgtgacgccgatcgcgagatctacgacccacacgccagcgggctctccatcgatgagctctacagaactggctataagctggtattgacaggtttgctcctcagctcttttagaccctccaggaaacctgaaggagcatcctggacagttccgccctggattggggcggctcaaggggggttggtccgggaaaaattccattttatctggaatggccctccctggggttggccattggtaagggtaaccccggtgttatggaaaggggctatttcccctctaaaaaaaagaacctggctccaaaagggaa

SEQ ID NO: 27133 - protein, 41 aa, Zea mays
  misc_feature: Ceres CLONE 1400275-F
MITGSSAAAGRGCSGSSNMVNVAAADRNKRITKIEPYRDRV

SEQ ID NO: 27134 - DNA, 723 bp, Zea mays
  misc_feature: Ceres CLONE 1400278-F
  misc_feature: Encodes the peptide sequence at SEQ ID NO. 27135
  misc_feature (578)..(578): n is a, c, t, g, unknown, or other
cgctcttaactagtggatcccccgggctgcaggaattcgcacgagaccattacctagaacatcctaatcaaaaaacacgcgcgcacgtaaaaacgaaaaaaggtccccggccgagaccgagagccgcggtccagagcggggggcggccggcaaggacgaaacggcccaacgccaccacctccaccacctcgtcctcgatcgacacctcccccgtcgccgtcccgtgactccccgtccagccgtccaggcccagctgcccccgcgacccagacgaccacgtccgcctcggcctgcgcctccccgctacaagagtccgtccgcccgccagcgctgcggtgccagcgagcccctccctcctccactctctgcggcgcggagatcccgtcctttctctgtgcccccggtaccgcgaggagccactgccaggcgccggcgtttttggaactgggcatggaggcggcggcggcggcttcggcggcggtcgggggttcgggcgctggactgaccaggtggcaggcggcggcgcttgcggcggtgcccggctgggtgtgggcggcctcctttctacgactcacgcngcgggggcgcgcgctcgtccaggcgtgggtcacgcgccgggtgcacgccgagacgcccggcatcctcagggtccagaagttggagccacagttgctgggacatttcttcccgtgctggcaggcgttgcctccgtgcccttctaca

SEQ ID NO: 27135 - protein, 91 aa, Zea mays
  misc_feature: Ceres CLONE 1400278-F
  misc_feature (43)..(43): Xaa is any aa, unknown, or other
MEAAAAASAAVGGSGAGLTRWQAAALAAVPGWVWAASFLRLTXRGRALVQAWVTRRVHAETPGILRVQKLEPQLLGHFFPCWQALPPCPST

SEQ ID NO: 27136 - DNA, 713 bp, Zea mays
  misc_feature: Ceres CLONE 1400279-F
  misc_feature: Encodes the peptide sequence at SEQ ID NO. 27137
  misc_feature (331)..(331): n is a, c, t, g, unknown, or other
  misc_feature (434)..(434): n is a, c, t, g, unknown, or other
gagctccccgcggtggcggccgctctagaactagtggatcccccgggctgcaggaattcgcacgagaccattacctagaacatcctaatcgaaaaatatctagccacggccttatcgggtcacaccaggtgacaaccagacgcgccagggtttcaggcttccacgaatctccccgccgccctcaattcccctcggcgccgccgccctcaattcccctcggagccgccgcctcctcccctcgcttcggtcctcggtgagttaaccatccaggttctgtctagatgtctgatagctatgagactgacaggaacattgagatctgcaacattangaaactgatcaagtcatcggaatcagccagcatgcatggggacagcatgatctctctaatcatgcctccacgggatcaggttggtcgagtggctaagaggtanggggatgataatggactgcctcagaaatcaagaagaaaggaaatccgaactctgggtggctggcatccctcactcaagaaggggtggaagtttaaaaaaagggcctctaaggggttgggtctggacccgggaatttgtggttgggaggggaagggaaaaaaaatttcttttgtttttgggcccttccggccttaagggggccccccccctttgggaaaaaaggccccccgggggtttaaagggccttggagtaggaaaaaaattggtgttctttttggg

SEQ ID NO: 27137 - protein, 115 aa, Zea mays
  misc_feature: Ceres CLONE 1400279-F
  misc_feature (17)..(17): Xaa is any aa, unknown, or other
  misc_feature (51)..(51): Xaa is any aa, unknown, or other
MSDSYETDRNIEICNIXKLIKSSESASMHGDSMISLIMPPRDQVGRVAKRXGDDNGLPQKSRRKEIRTLGGWHPSLKKGWKFKKRASKGLGLDPGICGWEGKGKKISFVFGPFRP

SEQ ID NO: 27138 - DNA, 790 bp, Zea mays
  misc_feature: Ceres CLONE 1400279-R
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
accccttgacaaatcatcttttcctccccactttcnnnnttataaccacaannnnaaacgaattgggtaccgggccccccctcgaggtcgacggtatcgataagctttttttttttttttttttacacacacacgcttttctttttatatcatgacgctaatcaaagatcagtcaaacttaagtcctgagatgaatagcatcagtcccctattcaaacagttggccacccggcggcaataccttcgtcaagactccgttgagtacaacaacaacacctaggaagggagcccttaattttcgacggaacagagttgcagcaagaaaaactccaatgtgagcacccatacagtatgcaaacctcagagggcaaccacgaactggctacaaacacatcactggtataagtctttgcgcctatttggacgggcctgcataactgaggtcctggcatccctccataacagctgctgcccgatgacatgaaacccactcgccgggatttcgttgtcctaaccccagggggggatgaaagattacccggttgcgccaatagcgccaacccatttctttgtaaaaaacgcggaaagtacctcctgacttcctaccctagcgtaaattcccatgggcctacgtcaatggggcgcgcttttcttccggagatgggggctctttgcgccaccttattgttgccgaggaagcgaggggccctcattttagcagcccccacttttttttcactgagttttctgtcgggtaactcttcccggatgcctccatcttttttttttt

SEQ ID NO: 27139 - DNA, 676 bp, Zea mays
  misc_feature: Ceres CLONE 1400281-F
  misc_feature: Encodes the peptide sequence at SEQ ID NO. 27140
cgcggtggcggccgctctagaactagtggatcccccgggctgcaggaattcgcacgagaccattacctagaacatcctaatcaaaaaatcagcgaattttcccaccgctcagcagtgacctcgttcccgtcctcctcgcatccctctcgtccgccgccgcctggctcgcgccgccgacagtttctcggcccagatcgagacacgcccgccatcctacaccaggtgccgaggccttcgccgatcaaagagatcccagacagcagatccgtccgtgccctgctcctcgaaccatggggacctctgcccaggaatcgcctctctgtaagcgtatcgacgatgccgagtactatctagtcagtggatcatttgaccaggcggtgttgactgctttatccgtcgccgatgaaatacacatggcttctttggagagcgctagcgaccaggatgagctcctggagatgcttgaatcggctgggatggtcttgtgcaggtactaaaagaactccggagggccctctgagatgcttgctcagcttaaagatgatgctttggttccgtgccctccagtgcccggctaaagatttttccttacacggagcttcccctttcaaatgtccaaaaagggttcatttatcttgtacctccagaccacattctctttgagggtgagtacccg

SEQ ID NO: 27140 - protein, 68 aa, Zea mays
  misc_feature: Ceres CLONE 1400281-F
MGTSAQESPLCKRIDDAEYYLVSGSFDQAVLTALSVADEIHMASLESASDQDELLEMLESAGMVLCRY

SEQ ID NO: 27141 - DNA, 706 bp, Zea mays
  misc_feature: Ceres CLONE 1400282-F
  misc_feature: Encodes the peptide sequence at SEQ ID NO. 27142
  misc_feature (431)..(431): n is a, c, t, g, unknown, or other
  misc_feature (455)..(455): n is a, c, t, g, unknown, or other
  misc_feature (494)..(494): n is a, c, t, g, unknown, or other
  misc_feature (501)..(501): n is a, c, t, g, unknown, or other
  misc_feature (502)..(502): n is a, c, t, g, unknown, or other
  misc_feature (516)..(516): n is a, c, t, g, unknown, or other
  misc_feature (624)..(624): n is a, c, t, g, unknown, or other
  misc_feature (641)..(641): n is a, c, t, g, unknown, or other
  misc_feature (665)..(665): n is a, c, t, g, unknown, or other
  misc_feature (689)..(689): n is a, c, t, g, unknown, or other
aaagctggagctccccgcggtggcggccgctctagaactagtggatcccccgggctgcaggaattcgcacgagaccattacctagaacatcctaatagaaaaactgccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacattntccgtggcgggggctcaaggtgcngcagcatcgagatgggtggcgcgctccgtgctccccagnttctacnncgggcgacggcacncggagagaattggaagggtgttcagctccttcggcaggcgctacgtcgtcacggccagccccaggggtcatggtcgagcccttcgccagggccttcctagcgccgacnaaggtcgtcgggacccnagctggaggtccgcagggacggcnaggccacgggcttcatggccaggncagggcgtgctcgtcgg

SEQ ID NO: 27142 - protein, 144 aa, Zea mays
  misc_feature: Ceres CLONE 1400282-F
  misc_feature: SWISSPROT Homolog: EC 2.3.1.15 Glycerol-3-phosphate O-acyltransferase
  misc_feature (84)..(84): Xaa is any aa, unknown, or other
  misc_feature (92)..(92): Xaa is any aa, unknown, or other
  misc_feature (105)..(105): Xaa is any aa, unknown, or other
  misc_feature (107)..(107): Xaa is any aa, unknown, or other
  misc_feature (112)..(112): Xaa is any aa, unknown, or other
MVASPRFKPIEECCSEGRSEQTVAADLDGTLLISRSAFPYYLLVALEAGSVLRAALLLLSVPFVYVTYAFFSESLAISTLVYIXRGGGSRCXSIEMGGALRAPQXLXRATAXGENWKGVQLLRQALRRHGQPQGSWSSPSPGPS

SEQ ID NO: 27143 - DNA, 711 bp, Zea mays
  misc_feature: Ceres CLONE 1400283-F
  misc_feature: Encodes the peptide sequence at SEQ ID NO. 27144
cgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtggtacctggccacccatccccgtcatcgtgctgggtgtgcggcgccgagctgggcagcctcagccgcgacgagctgtggcgcaaggtgtgggggggaggcacctacgacctcgcccacgtggtcgcctccctcggcgggctcggcctcaccattccgggttacataagggcagggcccagggccgggaccccatcgactcccgatggtaaaagccggccagagacttagggggcccaaggggggatttttcaccggggcggaaatcccggaaatttcaaaggaacaccggggggtcccagcggggtgggggcaaaaccggatttgggaaaatataaagggcgggtg

SEQ ID NO: 27144 - protein, 137 aa, Zea mays
  misc_feature: Ceres CLONE 1400283-F
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVVPGHPSPSSCWVCGAELGSLSRDELWRKVWGGGTYDLAHVVASLGGLGLTIPGYIRAGPRAGTPSTPDGKSRPET

SEQ ID NO: 27145 - DNA, 554 bp, Zea mays
  misc_feature: Ceres CLONE 1400288-F
  misc_feature (156)..(156): n is a, c, t, g, unknown, or other
  misc_feature (168)..(168): n is a, c, t, g, unknown, or other
ggagctcaccgcggtggcggccgctctagaatagtggatcccccgggctgcaggaattcgcacgagaccattacctagaacatcctaatcaaaagcagtcgccattgacgaccccctctcactctcccctcccttaatccctcctctccccgcgtncttctccccatncacgcttcattcgctccagtctcatcgaaatcaattcacagccagccagaatggggcgggagatctcccaagaagctatctgtgaaatcggagaacaccttggatttcggggccagtcaaagtatcccaaatcttgaaggaaggaggtccccccggccaaaaaaagacgaaaatttttccggaaaaattcgggggggggtccccgcaaccggagggaaaccccggggggattaaaggaaggggcaaaaaaggggggggtgtgtttaaaaaaagggggttgaacccgcggttgaaaaaaagaggggggtttttttccccctcggcgaaacaaggggttttttttccccccaaagattcccccgggggggtaagggggaaaaaaaaaa

SEQ ID NO: 27146 - DNA, 722 bp, Zea mays
  misc_feature: Ceres CLONE 1400289-F
  misc_feature (416)..(416): n is a, c, t, g, unknown, or other
aagctggagctccccgcggtggcggccgctctagaactagtggatcccccgggctgcaggaattcgcacgagaccattacctagaacatcctaatcgaaaagttccaaaaagaaaaaagaaaaactcagccgccggccgctgcccctctcggctgcacgacgtccgtgagggcgtgccccctggccccgtcccttgtcgcctgcccgccggtgcccgcacaggctgccagtgccatactgccatccctccgtccggccgtctgcccaggctgcctgcccggcgccctggcctcccggtcgctggctctctgccccagcgccaggccgcaggtcccaccgcccccagacaccgcgaaccagtccgctgcaggctgcaggccaccgtccctccagtcgcccgtcagattataaccatncagataccccagctcccgctagacgcgaatcctcgccactatgggggaagcgtgtccttgccgacccagcaaaggcgggtttgggagcggtttgggaacccgggttaatccattccgcctcagaagtccctgggccctaatacggaaggtgaaaaccttgcccagtttggttccagggtggaaaaatatttcccccctttggcccccccggggggggaaaaaacggggggccaaatgttctttgtgttttagggggggccccccaagggttttccgggaaaaaaaagggggggcccaataggccca

SEQ ID NO: 27147 - DNA, 679 bp, Zea mays
  misc_feature: Ceres CLONE 1400290-F
  misc_feature: Encodes the peptide sequence at SEQ ID NO. 27148
aaagctggagctccccgcggtggcggccgctctatcaactagtggatcccccgggctgcaggaattcgcacgagaccattacctagaacatcctaatcgaaaaatccctcctcctaactccaaactacccactggttcgactcgcgttcgcatcgcaagcagcagcgttccatcgaggcaatggcggtgatggccgaagtagtgtcgaccaccggggcggcgctccggagcccggactcgcagcagccggcggcggcgggcgcggcgaagggcaccgacgctgagaagctccagttcatcgaggacatgacctccaacgtggacgccgtgcaggagcgcgtgctgggggagatcctcgcccgcaacgcggacaccgagtacctcgccggcaggtgcggcctcgccggcgctacggaccgcgccaccttccgcgccaaggtgtcgatggcgacgtacgaggatctgcagccgtacatccggcgcatcgccgacggcgaccgctcggccatcctgtcggggcacccgggctccgagtttctcaccagttccggcaccgtccggggggtgaacggaacctcatggccccttcgggggacaagattcaaccggctgcccacgctggtgtaaccgccctccaaagggccccgcacttagacaccgaaccgggtcctaggatggt

SEQ ID NO: 27148 - protein, 148 aa, Zea mays
  misc_feature: Ceres CLONE 1400290-F
MAVMAEVVSTTGAALRSPDSQQPAAAGAAKGTDAEKLQFIEDMTSNVDAVQERVLGEILARNADTEYLAGRCGLAGATDRATFRAKVSMATYEDLQPYIRRIADGDRSAILSGHPGSEFLTSSGTVRGVNGTSWPLRGTRFNRLPTLV

SEQ ID NO: 27149 - DNA, 667 bp, Zea mays
  misc_feature: Ceres CLONE 1400291-F
  misc_feature: Encodes the peptide sequence at SEQ ID NO. 27150
  misc_feature (217)..(217): n is a, c, t, g, unknown, or other
  misc_feature (262)..(262): n is a, c, t, g, unknown, or other
  misc_feature (384)..(384): n is a, c, t, g, unknown, or other
  misc_feature (403)..(403): n is a, c, t, g, unknown, or other
  misc_feature (407)..(407): n is a, c, t, g, unknown, or other
aaagctggagctccccgcggtggcggccgctctagaactagtggatcccccgggctgcaggaattcgcacgagaccattacctagaacatcctaatcgaaaataccctctggcattggttgtcgatttcttcgttcgtgcttgcttgcgtaaaatatttaaataaatgaaggcaaatatgggcacaaaagctcgtccaccatctgctgatgcagaanaaggggagattggcgaaatagatacaagggctcccaattcaatcntgttaaagctgcagtgagtttatttggtgaggtccgcttttcatctgacaaatcagctgaaagaaagcccaaggctctcaaacagagagggttttagccaaggagacagagttgcacatggnccagaaagagttgaataantacnagaaacagctcagtaatgctgagacaacgagagtacagcctctctctgagctagagaaagctaaaaaaactgttgaggagctacagccaagcttgatctgattaacagcccaaacggtgggcatccggggaacgagggaggaaaaactcaatccggctttttgaagggggcccccaagggaaggctaagaaacaagtgggctttaaaacaaaattggaaaagggcagggacaatttttggtgttttttggaaaaccttaa

SEQ ID NO: 27150 - protein, 42 aa, Zea mays
  misc_feature: Ceres CLONE 1400291-F
  misc_feature (2)..(2): Xaa is any aa, unknown, or other
  misc_feature (8)..(8): Xaa is any aa, unknown, or other
  misc_feature (10)..(10): Xaa is any aa, unknown, or other
MXQKELNXYXKQLSNAETTRVQPLSELEKAKKTVEELQPSLI

SEQ ID NO: 27151 - DNA, 722 bp, Zea mays
  misc_feature: Ceres CLONE 1400296-F
  misc_feature: Encodes the peptide sequence at SEQ ID NO. 27152
  misc_feature (529)..(529): n is a, c, t, g, unknown, or other
aaagctggagctccccgcggtggcggccgctctagaactagtggatcccccgggctgcaggaattcgcacgagaccattacctagaacatcctaatcgaaaaatcgatcccagccccaggccatggcgacgaggtggaggaggtcgctgctctgggtcgccgtcgtccagttcctgaccctgtgcgtcgccgagcatctcgtagtggaagcatacaaaaagtcctacattgtgtatctgggatcacatgcatatggccgtgatgcgtcggcggaggagcatgctcgcgcaacccagtctcaccaccacctcctggcatcgatcctcggcggcgacgaccaccaccaccatgagacggcgcggcagtccatcttctactcctacaccaagagcagcatcaatggcttcgcggcgcacctggaggagtcggtcgcgcaccagatcgcggaccaccttgaggtggtggctgggatggatagttttatgctctacttgccccccccgcgccctctgtgatccatgatccctgnatcggcgtggtccccctcattctctggctccttcttgtcacgcccttgtttcgaacaaccactcccttctcccacgattttgtccgtgaagaggggcttttgacttgctcttcgtcctagatgactctggaccctcttgccgccctcttatcaacttcctcctatctccgtttcccttctttacctccttact

SEQ ID NO: 27152 - protein, 130 aa, Zea mays
  misc_feature: Ceres CLONE 1400296-F
  misc_feature (33)..(125): Pfam Name: Subtilisin_N Pfam Description: Subtilisin N-terminal Region
MATRWRRSLLWVAVVQFLTLCVAEHLVVEAYKKSYIVYLGSHAYGRDASAEEHARATQSHHHLLASILGGDDHHHHETARQSIFYSYTKSSINGFAAHLEESVAHQIADHLEVVAGMDSFMLYLPPPRPL

SEQ ID NO: 27153 - DNA, 634 bp, Zea mays
  misc_feature: Ceres CLONE 1400298-F
  misc_feature: Encodes the peptide sequence at SEQ ID NO. 27154
  misc_feature (190)..(190): n is a, c, t, g, unknown, or other
  misc_feature (262)..(262): n is a, c, t, g, unknown, or other
  misc_feature (311)..(311): n is a, c, t, g, unknown, or other
tggagctccccgcggtggcggccgctctagaactagtggatcccccgggctgcaggaattcgcacgagaccattacctagaacatcctaatcgaaaagcacaatcctagagacagaacacgcgaggggagagagagaggcgcccggcatgccgagcgcgacgtccccagcgatggtcgcgaatctgtcgntcaagtcgcgcgtgcggtgcgtcgtgatcggcgaccctggcactggcatgtcaggctcatcgtcgccttcgncagcgagcagtttcccgagtacgtgcatcgggtcagggcccccagccgnctccccggcggataatttccccgacggggtccgcctgagcatcaatcgaaacgtcttgaagccccgggaggagaaaccccgagtgttcgcccaggggtcgggcggccatgggggggtgggtaacctacccctgggcacgggccgcccaagttggggggggtctttttgggtttgggtttcccgggttcgcggggttcccgggggagggccccatatttggggtgggggggggaattgggaccctgggccccaaaacacaaaaaaccccctggggcgggtatgggggcccccttgggggagctttttcggggggatgagagggg

SEQ ID NO: 27154 - protein, 69 aa, Zea mays
  misc_feature: Ceres CLONE 1400298-F
MGGWVTYPWARAAQVGGGLFGFGFPGFAGFPGEGPIFGVGGGIGTLGPKTQKTPWGGYGGPLGGAFSGG

SEQ ID NO: 27155 - DNA, 628 bp, Zea mays
  misc_feature: Ceres CLONE 1400300-F
  misc_feature (109)..(109): n is a, c, t, g, unknown, or other
  misc_feature (245)..(245): n is a, c, t, g, unknown, or other
  misc_feature (263)..(263): n is a, c, t, g, unknown, or other
  misc_feature (264)..(264): n is a, c, t, g, unknown, or other
  misc_feature (270)..(270): n is a, c, t, g, unknown, or other
  misc_feature (288)..(288): n is a, c, t, g, unknown, or other
  misc_feature (289)..(289): n is a, c, t, g, unknown, or other
  misc_feature (321)..(321): n is a, c, t, g, unknown, or other
tggagctccccgcggtggcggccgctctagaactagtggatcccccgggctgcaggaattcgcacgagaccattacctagaacatcctaatcaaaaaatctccatcggncatcgctgcctccccagtccccacatccgcacacatttttacacctcgcggcggccccaccgaccgccgaggcgcagcggcgtcgccgcgggcaacgccgtcacgtcacgtgcatcacgacaatctcctcctacgnctcgtcttcctggcaggnncgcggnagcacccagcccagcggnnagaatcagtccaggggggccgaattccagggnttaaaaaaaggacgggaaataggtgaaggccatcccaggggcgccccggcccaaaatggggttcccgaaatgtccgggggaaagggaaacccccacaaaaaaagggctggaagggaaaggccccgaacgccccaaaaaactgggagggggaaaaggtggggcccccctccaaaagattttggcaaaaaagggagagggcccctttaacaagttgaaccccccccccttttttggggagggggcgccaagacccccccaaacccccccagtggggttattaaaaaaaacaacccccgtgggggggtga

SEQ ID NO: 27156 - DNA, 748 bp, Zea mays
  misc_feature: Ceres CLONE 1400302-F
  misc_feature: Pfam Name: Glyco_hydro_18 Pfam Description: Glycosyl hydrolases family 18
  misc_feature (24)..(24): n is a, c, t, g, unknown, or other
  misc_feature (28)..(28): n is a, c, t, g, unknown, or other
  misc_feature (29)..(29): n is a, c, t, g, unknown, or other
  misc_feature (37)..(37): n is a, c, t, g, unknown, or other
  misc_feature (38)..(38): n is a, c, t, g, unknown, or other
  misc_feature (42)..(42): n is a, c, t, g, unknown, or other
ggtgggtgtgggttggggttttanattnntatttttnntttngcacaaccagcaaagctggagctccccgcggcggcggccgctctagaactagtggatcccccgggctgcaggaattcgcacgagaccattacctagaacatcctaatcaaaaaaaagcgatgcgcagctccgtaaccacttcgtcctcacttctcagtccaccttcccaccgcaaccacttcaccacctcctcacagtcccagcaatggagctagtagcgtggctcgtcatcgtgtcctcagtatccctcgctgggctcctgccagtggcctcggagtcgacaacgacaccgcagcagcaatgtggcggcaataatgtcggacctgccggagtgagagcaggctactggtcgccgtcctcgaaccgctactccgcggacggcagcatcgacgcgtccctgtacacgcacctctactacagcggggtgaccatcgacgagacgagctgcgcggtcgcgccgcctccgccgacggccgaaggcgcctcgcctgctcgccgccttctctggggcgggcaagtccgcgaggcccgtccaccaggaaccgcgctgcccgccggccccggcaccgatcacagggccgggccaagcccgaaccgcccccccttctcccggaatggccgtccgggacggggggtcccttcccgggcgggtggattaatccaacctcccctcccttggaaccctgggaccccggggtcaaaacgg

SEQ ID NO: 27157 - DNA, 681 bp, Zea mays
  misc_feature: Ceres CLONE 1400305-F
  misc_feature: Encodes the peptide sequence at SEQ ID NO. 27158
  misc_feature (444)..(444): n is a, c, t, g, unknown, or other
  misc_feature (576)..(576): n is a, c, t, g, unknown, or other
  misc_feature (662)..(662): n is a, c, t, g, unknown, or other
aaagctggagctccccgcggtggcggccgctctagaactagtggatcccccgggctgcaggaattcgcacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttaaacggccaaaccagcccaaaccccaaacccacagtagtaacaggggcacactagctaagctaaacctcgccacggcacagcaatggcgccgctccccgcttccctcacgccctgcctctggctcttcctctgcctcctcgctgcgccgtgccccgcgggcgcggggcggcngcggttcgcgtgcaacgccacggcgccgcgagcgtccacgtgccaggcgctcgtctcctacgcgccgcccaacgggacggccacgcccacgctggccgccgtgcgggcgctcttccagctccgctcccacgncgcgctgctggccgccaacggcctcccgctctccacgccgcccacggcgcccgcgcccgtggccgctgcgggtccgcctgcccggnctctgctcgggggggcgcc

SEQ ID NO: 27158 - protein, 108 aa, Zea mays
  misc_feature: Ceres CLONE 1400305-F
  misc_feature (30)..(30): Xaa is any aa, unknown, or other
  misc_feature (74)..(74): Xaa is any aa, unknown, or other
  misc_feature (103)..(103): Xaa is any aa, unknown, or other
MAPLPASLTPCLWLFLCLLAAPCPAGAGRXRFACNATAPRASTCQALVSYAPPNGTATPTLAAVRALFQLRSHXALLAANGLPLSTPPTAPAPVAAAGPPARXLLGGA

SEQ ID NO: 27159 - DNA, 767 bp, Zea mays
  misc_feature: Ceres CLONE 1400308-F
  misc_feature: Encodes the peptide sequence at SEQ ID NO. 27160
aaagctggagctccccgcggtggcggccgctctagaactagtggatcccccgggctgcaggaattcgcacgagaccattacctagaacatcctaatcgaaaactctattagaatagccaggggcctcgctcctctccaccacgtactccactccatccatccatcatcgtctatccatgaagagcttgcaggaggagagggcggcgttggtgccgtcgccgtggccccagcaacagagaaaggacggcggcgagcatgatccggagcagctaatggatgaggatgacggtgacgatgaggaggatctgcaggatgagcagcacacaagaacaattaggacgtcgaccaagacggcggaagcatcgtcatcagcggagcggcgggtgccggcgtggtggaggcggcgctgttcccacaagctggtgcccaccagaggtgttggtctggccctcgccgctttcatcgtgctgcgcctgctccccttctccgtgcgccgctgcccactccctccttgtccgttggaatcaccctcgcctcatgccacccccaacctcaggctacgctcccgtcctccgccgcgctgtttgcgaaccctccactccgaatctcctcccacccaatccgcacacccaccctcacaaactccgccgcacctcatattccccatttggtgcggcgccaacggcttcgcgcaatgcgaccggatcaccgctaggatgaaacaacaccgcgccttctccgacacccgcgtttacgtacacacaccc

SEQ ID NO: 27160 - protein, 197 aa, Zea mays
  misc_feature: Ceres CLONE 1400308-F
MKSLQEERAALVPSPWPQQQRKDGGEHDPEQLMDEDDGDDEEDLQDEQHTRTIRTSTKTAEASSSAERRVPAWWRRRCSHKLVPTRGVGLALAAFIVLRLLPFSVRRCPLPPCPLESPSPHATPNLRLRSRPPPRCLRTLHSESPPTQSAHPPSQTPPHLIFPIWCGANGFAQCDRITARMKQHRAFSDTRVYVHTP

SEQ ID NO: 27161 - DNA, 730 bp, Zea mays
  misc_feature: Ceres CLONE 1400310-F
  misc_feature: Encodes the peptide sequence at SEQ ID NO. 27162
  misc_feature (689)..(689): n is a, c, t, g, unknown, or other
ggagctccccgcggtggcggccgctctagaactagtggatcccccgggctgcaggaattcgcacgagaccattacctagaacatcctaatcgaaaaagcactgcactgcacgcctccgccatactgcgacgacgccgtgcatcgcttcacgcagagcagagatggaatcccatcacggcgttcacggtaaggtgcggcacaagttctcggtgaaccagaacccgtccctcacccgcgccctatactcccgcagcgcccgcccctccgtcacagtcctcctcgtcctcgcgggcatatccttcgcctccgcatcctccttcctcgccctcacctcccgggaggagcagctcaccaagctcgccggacgagcgggtatctctggccttgctgctgcttttgtcattaggatgatggaagcatcactcaggtcttggtgtacttttcacactgctggctctcttcagggcactgatgttatacaatgggcacaaggcactgggcaaggtcgacaaggttgtcttgtctgatcgccaactggcgcttcttcgtttagagatggcacgttcagaacgaggtggcaaaggtgagcagatcagaaggcctcccaagaccaagccatcaacaccatcggcaccattgtgcctatcaggatgtcttcgatcagctatacacatctcggccttcggggnaatctaggattggttcagccattgcagccctggtggtgaca

SEQ ID NO: 27162 - protein, 121 aa, Zea mays
  misc_feature: Ceres CLONE 1400310-F
MESHHGVHGKVRHKFSVNQNPSLTRALYSRSARPSVTVLLVLAGISFASASSFLALTSREEQLTKLAGRAGISGLAAAFVIRMMEASLRSWCTFHTAGSLQGTDVIQWAQGTGQGRQGCLV

SEQ ID NO: 27163 - DNA, 711 bp, Zea mays
  misc_feature: Ceres CLONE 1400312-F
acagctggagctcaccgcggtggcggccgctctagaactagtggatcccccgggctgcaggaattcgcacgagaccattacctagaacatcctaatcgaaaaaacagcaaagcccaggctgcccagcacacgcgacgcgaaccagctgccgaggaaccctagcggagcactgtgcaggcgaccgcggcgcgctatcacttacggggggatacggcggcatcgtccccctcggcccctcctccatccctggtgcggcggcgccagcctgcaggtgttgaatgctgatttgttgtggctgattaattgggttgatcgtcgattaatcgtgattagtccgctgatcgcccttctggcgatcagaaacgataacgtaatctgaaaacattggccgccaaccctccagagcgactcccgcgagccgtgacccccatacccatatcaacgcaccagaagctttccgggagctgcctcgtccacgagtgttcccgctgacttcctattccccggcgtcatgacgagcctctcgctcgaagaagagagcgaggtgcccgcccccgccctcagtccgaaccccccgctttgatcaccccgctaaccacgttgctgctgtacccatctcccgacccccccccgcccggactgccataaagaaaacaatctccacccctcaccccgaccctactcccccggattcccccccgccgctctctc

SEQ ID NO: 27164 - DNA, 744 bp, Zea mays
  misc_feature: Ceres CLONE 1400316-F
  misc_feature: Encodes the peptide sequence at SEQ ID NO. 27165
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (39)..(39): n is a, c, t, g, unknown, or other
  misc_feature (40)..(40): n is a, c, t, g, unknown, or other
taaaaataaataagnnntagaaaacaaaaaaaaggggannggccgcggaccaacaaagctggggctccccgcggtggcggccgctctagaactagtggatcccccgggctgcaggaattcgcacgagaccattacctagaacatcctaatcgaaaaaagaagagccgccctacctattccttctccccgccgtcgagctgcccaacccagagcaccagcagccctcacctccttcctctcggccggtccttccaacgagcccgctggtcttggagccgccgccggtctcgttctggacgaacgttcaaggagattgcatttgtggatgctctaatggagtcgaaaggtggcaagaagtctagtagtagtaatagtaatttcatgtacgaagctccccttggctacaagatcgaggaccgttcgcccagccggaggaatcaagaagttccagactgctgcttattccaactgcgtccgccaggcatcctgatatcgcctcacatgcaattcgcagtagagtaggattttaattccagtttcctcttgtgacggtagatctccgttggctctggctgccatccctctgcttctgagattccaacttgacttaaccatctcctccttttcctctctcagcctctcctttcttggcaaaaccgtcatcccaatggcggatggtcttacaccaagattcgttgggggtctccttccccccggccctccccctaatttgaccttttggag

SEQ ID NO: 27165 - protein, 62 aa, Zea mays
  misc_feature: Ceres CLONE 1400316-F
  misc_feature (1)..(50): Pfam Name: AdoMetDC_leader Pfam Description: S-adenosyl-l-methionine decarboxylase leader peptide
MESKGGKKSSSSNSNFMYEAPLGYKIEDRSPSRRNQEVPDCCLFQLRPPGILISPHMQFAVE

SEQ ID NO: 27166 - DNA, 762 bp, Zea mays
  misc_feature: Ceres CLONE 1400319-F
  misc_feature: Translation starting site: 188
  misc_feature (332)..(332): n is a, c, t, g, unknown, or other
  misc_feature (362)..(362): n is a, c, t, g, unknown, or other
  misc_feature (371)..(371): n is a, c, t, g, unknown, or other
  misc_feature (456)..(456): n is a, c, t, g, unknown, or other
  misc_feature (457)..(457): n is a, c, t, g, unknown, or other
  misc_feature (459)..(459): n is a, c, t, g, unknown, or other
  misc_feature (460)..(460): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (498)..(498): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (530)..(530): n is a, c, t, g, unknown, or other
  misc_feature (541)..(541): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (578)..(578): n is a, c, t, g, unknown, or other
  misc_feature (592)..(592): n is a, c, t, g, unknown, or other
  misc_feature (604)..(604): n is a, c, t, g, unknown, or other
  misc_feature (614)..(614): n is a, c, t, g, unknown, or other
  misc_feature (615)..(615): n is a, c, t, g, unknown, or other
  misc_feature (630)..(630): n is a, c, t, g, unknown, or other
  misc_feature (631)..(631): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (665)..(665): n is a, c, t, g, unknown, or other
  misc_feature (688)..(688): n is a, c, t, g, unknown, or other
  misc_feature (689)..(689): n is a, c, t, g, unknown, or other
  misc_feature (705)..(705): n is a, c, t, g, unknown, or other
  misc_feature (731)..(731): n is a, c, t, g, unknown, or other
  misc_feature (732)..(732): n is a, c, t, g, unknown, or other
  misc_feature (746)..(746): n is a, c, t, g, unknown, or other
aaagctggagctccccgcggtggcggccgctctagaactagtgatcccccgggctgcaggaattcgcacgagaccattacctagaacatcctaatcgaaaaattccatcggtcgtgaaaagaaaaagggaaacaaaccaagctagagaaaagaagaaggtactacatactagctagctagcttagctatgggcaccatcgtcgacgctgacgtcgggttctcggtgaagaggacgagcaggtcgctggtgccgcctgcgtcggcgacgccgcgggagacgctgcggctgtcggtgatcgaccgcgtggcggggctgcgccacctggtgcggncgctgcacgtgttcgccgcgggcggcgacnagaagcggnagcaggcgacggcgacgccggccaaggcgctgcgggaggcgctggggaaaggggctgggggactactacccggtcgcgggggggnncnnggcggggggccggcggacggcgccgcnnnnncgggggngggcgtcnnntgcgcccgggagccccggccgncgggggggganagacgccgccnnnnnnnntgggccgcgcgcacgggcngacggggccgggtntcccggtggctngtgggatggnncctgggcgccccagnncnnnnggcgtcggtggcgactcggcgaccatganatgtcccgcgcaagtagcgaggnnccgccgcgccgcgctngcgcggccagaggacccgccgccggnncgccggcgggacanacaggcgggttcacaa

SEQ ID NO: 27167 - DNA, 701 bp, Zea mays
  misc_feature: Ceres CLONE 1400320-F
  misc_feature: Encodes the peptide sequence at SEQ ID NO. 27168
gctctagaactagtggatcccccgggctgcaggaattcgcacgagaccattacctagaacatcctaatcgaaaaagtatcacagccgcacagcgcccgctgctacgcacgccgccgtctacccccactcccccagcacgtgcgtgcacgcgcaggtgctcgaggacttctcccccgtttccgcccacatccgccgacctgcctcgccattccgccgcgccttcgcatcgtccgcgcgcccggcccttctcgttctaccccggtacgactcgacggtggtcgtgggcgccgaaggtgcggctccgaggcgccaggtggttcgtttgctgtttgcgcgatcgccggaggagtctgtgcaagctgtgctggctaagggtttggggggtcggattcagtggaggggctgcggcaggagggagctagagatgtacgggacgccgtcccgaggcggccggggagctggcactgccggagagcagcctaggggtttaccaagttgggcgagaaagcaacgagtttttcttgcagggccggtcatattgggactggaggggagatcattggttctcacattatcctcattctggggccatggggggcttctggaatttgggggccaaacatctaacaaggattttctggacatgggggaggttaggtatgggcaaaggggtgggttcccgggaaacaataaaatggggg

SEQ ID NO: 27168 - protein, 92 aa, Zea mays
  misc_feature: Ceres CLONE 1400320-F
MYGTPSRGGRGAGTAGEQPRGLPSWARKQRVFLAGPVILGLEGRSLVLTLSSFWGHGGLLEFGGQTSNKDFLDMGEVRYGQRGGFPGNNKMG

SEQ ID NO: 27169 - DNA, 661 bp, Zea mays
  misc_feature: Ceres CLONE 1400322-F
  misc_feature: Encodes the peptide sequence at SEQ ID NO. 27170
gctctagaactagtggatcccccgggctgcaggaattcgcacgagaccattacctagaacatcctaatcgaaaaattctcctcccgaattcccgatcctgtcctcaaatcccattgctctatcttctctcacgccgagtctaggcggggaagacgagctagcgctgaggatgttgtgggtagataagctgcggccgagcaccctagacatggtcaccgtgcacgaccaggttgttcagaacctcgagcatgtcgtgtagtacaacgattgtccgcacctgttgttctatgtgtcgctggggtccgggcagaaaagcgtagtcctagcgctcatcaagtagatgttcggcgccggcgcggacaaagttacgctgtacaacaagacctggaacaccgttagtggaacaaggtcttttgagatacaattggcgaagatgtcacgccgttcacacgtggggatgaccccccagcgctgctggtttttaggaaacagtatgttgtcccgtgagcaaatcatagagatggctatcaaccggccaattgatgccaatggcgggggaggttttaaaagtccttgtggtttgatggagaactaacatctcctaccaagaagcgccggtatttctctccgcgcggaactaagggagattgggtagcgtcat

SEQ ID NO: 27170 - protein, 29 aa, Zea mays
  misc_feature: Ceres CLONE 1400322-F
MLWVDKLRPSTLDMVTVHDQVVQNLEHVV

SEQ ID NO: 27171 - DNA, 806 bp, Zea mays
  misc_feature: Ceres CLONE 1400326-F
  misc_feature (715)..(715): n is a, c, t, g, unknown, or other
acagctggagctcaccgcggtggcggccgctcttgcaatagtggatcccccgggctgcaggaattcgcacgagaccattacctagaacatcctaatcaaaaaactactaccagctgctccctccctccttcccttccctcctacctctctctctctcttcctccgttcgtctcttgactcttctcttctccccatcagccagcagtctctctctctctcacacacacaagtagcgacttgctcacagtagtgctccccggacagaatgaccaaagacgaggagttcaagctggtcaagatccagaaccatgcgctggaagtgaacatacactgtgacgggcgcgagcataagcgccagaagcttccttaaaagatcccccgcgttgccctcccccgttcgtgaccagttgagccgcgccccacatacccgagaaacccgttccccccgtatcccccataaaccgtaaccccgtaccacgcgccccggcggcggaagcggccgggaatgcacacttgcgggtggatatcccaacggctggggtcccgggcgcaatcgcgcattggctgagccagctgcgtatattattcgcccgcatgtatccacgagccgcccgcgaaaaattacgaatagcccccacccatccgtaaaccccgcccaataacttggatcgccctcctgtgcatgaatatccgcgtacccgccgtcctcaggccnccggcccgggtaagttcaagccgtagagtgcaccccgcccacgccccaaccccgcaatccaccgagtatctccccgccccccaccccggcg

SEQ ID NO: 27172 - DNA, 699 bp, Zea mays
  misc_feature: Ceres CLONE 1400328-F
  misc_feature: Encodes the peptide sequence at SEQ ID NO. 27173
  misc_feature (594)..(594): n is a, c, t, g, unknown, or other
  misc_feature (617)..(617): n is a, c, t, g, unknown, or other
  misc_feature (630)..(630): n is a, c, t, g, unknown, or other
  misc_feature (633)..(633): n is a, c, t, g, unknown, or other
  misc_feature (670)..(670): n is a, c, t, g, unknown, or other
  misc_feature (699)..(699): n is a, c, t, g, unknown, or other
cgctctagaactagtggatcccccgggctgcaggaattcgcacgagaccattacctagaacatcctaatcgaaaaaaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagcaaatggtttctggtgcgggtcatggtgggtacggcggcggcgacgacgggcaggccgtcgacttccggggcaacccggcggacaagtcgaggaccggaggctggctgggcgccgggctgatcctgggcacggagctggcggagcgcgtgtgcgtgatggacatctccatgaacctggtgacgtacctcgtcggcgagctgcacctctacaactccaagtccgccaccgtggtgaccaacttcatgggcacgctcaacctgctcgccctcgtcggcggcttcctcgacgacgacaagctcggccgctaccctcacatcgacatctccgccacaatcgacgacacggacgtgagcttgctgtacgtggacacgancgtgccgagcatgcgtcccgcgncgtgctggaacgnccngcgggtcgcgcgcgcactagtgcgtgccggcgccggncggcaacttgcgctgctgtacgcgcgctn

SEQ ID NO: 27173 - protein, 158 aa, Zea mays
  misc_feature: Ceres CLONE 1400328-F
  misc_feature (124)..(124): Xaa is any aa, unknown, or other
  misc_feature (132)..(132): Xaa is any aa, unknown, or other
  misc_feature (136)..(136): Xaa is any aa, unknown, or other
  misc_feature (137)..(137): Xaa is any aa, unknown, or other
MVSGAGHGGYGGGDDGQAVDFRGNPADKSRTGGWLGAGLILGTELAERVCVMDISMNLVTYLVGELHLYNSKSATVVTNFMGTLNLLALVGGFLDDDKLGRYPHIDISATIDDTDVSLLYVDTXVPSMRPAXCWNXXRVARALVRAGAGRQLALLYAR

SEQ ID NO: 27174 - DNA, 643 bp, Zea mays
  misc_feature: Ceres CLONE 1400330-F
  misc_feature: Encodes the peptide sequence at SEQ ID NO. 27175
  misc_feature (478)..(478): n is a, c, t, g, unknown, or other
  misc_feature (643)..(643): n is a, c, t, g, unknown, or other
ggagctccccgcggtggcggccgctctagaactagtggatcccccgggctgcaggaattcgcacgagaccattacctagaacatcctaatcgaaaaacattattcaggtccaggtcacatgatgcacagacagcccgtccgacgccgcgttagctacttgcctacttcagctatatgaaacggcaaaagtcttcccctcgttccccaatctcctctccatcgaaaccctagcacgacgcaattcccgtcttcccacgccgtgtcgccgttgctatgggcaagaagcggaagctcgagcccaaatcggcggcagggttcacgccggttaaggcctccccgaccaccaggtctgccaccgctaaggccgctggtctatccgaggtcctcgcccccgtcgaggctacgatggagaagctgccgcagggggcaggcggcgaggatgtagaggaaatcgaggaggtggaggtcgaggaggaangtggaagtggaagaggaagaagaaggcgagagcgaccaggcttcgatccaggcgctgctggattcgttccccaaggaccagctcgtcgagctgttacgcgacgctgccatcgctcacggcgacgtgctaaccaccatccggcgcgtggccgacgccgacccggcn

SEQ ID NO: 27175 - protein, 123 aa, Zea mays
  misc_feature: Ceres CLONE 1400330-F
  misc_feature (69)..(69): Xaa is any aa, unknown, or other
MGKKRKLEPKSAAGFTPVKASPTTRSATAKAAGLSEVLAPVEATMEKLPQGAGGEDVEEIEEVEVEEEXGSGRGRRRRERPGFDPGAAGFVPQGPARRAVTRRCHRSRRRANHHPARGRRRPG

SEQ ID NO: 27176 - DNA, 669 bp, Zea mays
  misc_feature: Ceres CLONE 1400335-F
  misc_feature: Encodes the peptide sequence at SEQ ID NO. 27177
  misc_feature (391)..(391): n is a, c, t, g, unknown, or other
aagctggagctccccgcggtggcggccgctctagaactagtggatcccccgggctgcaggaattcgcacgagaccattacctagaacttcctaatcgaaaactcctctcctctccctccctccctccttccccgccgccgtctaccagtacagctcgagcgaacgacgtctcgacagtcccgggccgctgagaacttgccgcgggagggagagcagcagcggcagcatcagacatgtcgtcggggcggtacatggcctactcgccctcgccgtcgaccaccccccactccccccgcatcgccggcctccgcgccccgtctgccgccatggccgaacaggagaagtaccttgccgaactgctcgcggagaggcagaagcttggcccgttcgntccagtgatcccgcatagtgtacgcttgctgaatcaggaaattttacgtgtttccacactattggagaacgctcccttttaaatcaaagggccctgaacatggaatcccctaacaacgggaggattattttcaaatggagcacctacggacatgatggggggaacttcagatttcacccaaaaggtccccactttaaactgggttggagggtcccagggaagtcccctgggttttttggcaaaaaaaaatggaggggccatttcccgagaaaaaaatt

SEQ ID NO: 27177 - protein, 79 aa, Zea mays
  misc_feature: Ceres CLONE 1400335-F
  misc_feature (53)..(53): Xaa is any aa, unknown, or other
MSSGRYMAYSPSPSTTPHSPRIAGLRAPSAAMAEQEKYLAELLAERQKLGPFXPVIPHSVRLLNQEILRVSTLLENAPF

SEQ ID NO: 27178 - DNA, 709 bp, Zea mays
  misc_feature: Ceres CLONE 1400337-F
  misc_feature: Encodes the peptide sequence at SEQ ID NO. 27179
  misc_feature (350)..(350): n is a, c, t, g, unknown, or other
  misc_feature (353)..(353): n is a, c, t, g, unknown, or other
gctctagaactagtggatcccccgggctgcaggaattcgcacgagaccattacctagaacatcctaatcgaaaaaaagctcaaaccgagcaatagcagtccttgctcctccaacttccctcctggcttctgcccctttgtctgcgctcctcacgccgccccccgccccagccccacacccgcattccccagatctccatggactcgacccctcccacggacccggcggcctcctgcttggcctccgcctctgcggcggtggcatcgggggacgtcgccgcgatgctgccggactcgccgccgcggcgtggggcgggccaccgccgcgcacagtcggagatcctcctcggnggngccgcgctccccgacgacctcaacttcgacgcggacctcggcgttgtccgggaagcctgcgtggccggcgacgaggatgaggaggatgaccaccaccaccagggaaggggtcgggggggcttggcggcaaccggatgttcaaaattgtcctccaaaaaaggggggaagtttccgggaaccgccgaacccgttgggaatcccaatttaaagccccccgggccccgggaaccatccggatgggaatgggaggggcccccctttttttttggttcccccccccccggaaccctgggggggccggggcgttttgccaaaaaggtttttttgggcttaaatcccccaatcccccttgtgta

SEQ ID NO: 27179 - protein, 170 aa, Zea mays
  misc_feature: Ceres CLONE 1400337-F
MDSTPPTDPAASCLASASAAVASGDVAAMLPDSPPRRGAGHRRAQSEILLGGAALPDDLNFDADLGVVREACVAGDEDEEDDHHHQGRGRGGLAATGCSKLSSKKGGKFPGTAEPVGNPNLKPPGPREPSGWEWEGPPFFFGSPPPGTLGGPGRFAKKVFLGLNPPIPLV

SEQ ID NO: 27180 - DNA, 668 bp, Zea mays
  misc_feature: Ceres CLONE 1400344-F
ggagctcaccgcggtggcggccgctctagaactagtggatcccccgggctgcaggaattcgcacgagaccattacctagaacatcctaatcgaaaaaatcaagtcggttcactccgattggtcctccgagtttgagactttgtttatctcacgaatctaccgacgtgtgatcctcaataagagcaatgcctcacctcggctccgaaacgctacccctcctgtgacgggcgtgggcatgaaccggtgatctgttacctggtctcgtatgtctgcgcacgcgcgagagcagtgagtgatcattgccgtcggcctgcatccgtccgggtcctccgatgcggcttgtgccgctatggcgcgaacgcgctggcggatggcctggtggcgtgaacagtcacttttagactgccgaggatcgcgacaagctgcgacaccagaatacgcactcactccgccgtggtgtagtacaaccacatacggctagaccgtcttcgcacatgacagctgccatatttggaaggagaagccagccaggccagggttccacgcctttcacacctaaatgctggtatgcgcgatgcgtgactgccatctgcgatcactgcttgtgacttggtcaatgggaaccgggacacttaggcttccgggagcgatggaaccctgcaggggtt

SEQ ID NO: 27181 - DNA, 695 bp, Zea mays
  misc_feature: Ceres CLONE 1400347-F
  misc_feature: Translation starting site: 429
  misc_feature (458)..(458): n is a, c, t, g, unknown, or other
  misc_feature (477)..(477): n is a, c, t, g, unknown, or other
  misc_feature (480)..(480): n is a, c, t, g, unknown, or other
  misc_feature (481)..(481): n is a, c, t, g, unknown, or other
  misc_feature (483)..(483): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (494)..(494): n is a, c, t, g, unknown, or other
  misc_feature (497)..(497): n is a, c, t, g, unknown, or other
  misc_feature (515)..(515): n is a, c, t, g, unknown, or other
  misc_feature (516)..(516): n is a, c, t, g, unknown, or other
  misc_feature (521)..(521): n is a, c, t, g, unknown, or other
  misc_feature (559)..(559): n is a, c, t, g, unknown, or other
  misc_feature (610)..(610): n is a, c, t, g, unknown, or other
  misc_feature (612)..(612): n is a, c, t, g, unknown, or other
  misc_feature (613)..(613): n is a, c, t, g, unknown, or other
aaagctggagctccccgcggtggcggccgctctagaactagtggatcccccgggctgcaggaattcgcacgagaccattacctagaacatcctaatcgaaaagttcttctggaccgatgactttttctggttggttccaagttccaacatgacaggcacgaaggcaagtcgagcagacagcaacatctagcacgaagcaccggccttgtacgcatcctcccttcgcatcgaggaatcgcgggcccaccgcggcaccaaggccccccgcattccgtcccgccgcggcgtcgctcccttgttctctcccgagccgtccgcgaaccaacccgtgctacctccgattcttcgcctcgtcgttctttctagaacctccgctccgcctaatcccgaacgagactagggaggttccagcgccgccggtgggggagatggcgctggagctgagcctggcccgcttncccgccggggggggggggnggnntngnnnnnnnccnccncccctcgccccccccggnnccggngccgcgcggggccgcgcgggcggccgtctcctggcgcntctccgtgctgcgtgctctccgttcgtcctcgggccccgtccttgtggcgncnnccggcttctgctttcctcccccggggggccggggcctcgctttcttctttgcctttcgttggttggccgggcctcggctctt

SEQ ID NO: 27182 - DNA, 661 bp, Zea mays
  misc_feature: Ceres CLONE 1400352-F
aagctggagctccccgcggtggcggccgctctagaactagtggatcccccgggctgcaggaattcgcacgagaccattacctagaacatcctaatcgaaaactacatgccaaatctggaggcaagagaaccgggagagggcgtgttgggttgctcgtcgtgatcccggacggcaatacctgcccttgcctacttgccactgcttgcgtacactgatgtccttgttcaatcccctctagaaagtagaaacattgcttaattggcttggctattgctgttagctccacacaaaagagagaaccggcggcgagctaggagctagccatggacggacacggcgcggtctcaccgtggagcgtgctaggcggggcggcgactgtgctgctcctgtggttggcgtcgcaggtgctgcagtgggcctggtgggcgccccggcgcgtgaaccgtgcgctgagggcgcagggcctgagggggcacccggtaccgcctcctctgcggcgacctcatccaggagcagcgtctccccgcggcggccctggcaagggccgtcccccgggatcggccacacgacttcggcccctcgcgtcgcggcctttcctttccccgggccctccaggagcacggcaaggctctccctttacttgggtttgggcccaccccca

SEQ ID NO: 27183 - DNA, 730 bp, Zea mays
  misc_feature: Ceres CLONE 1400357-F
  misc_feature: Encodes the peptide sequence at SEQ ID NO. 27184
  misc_feature (278)..(278): n is a, c, t, g, unknown, or other
  misc_feature (287)..(287): n is a, c, t, g, unknown, or other
  misc_feature (540)..(540): n is a, c, t, g, unknown, or other
  misc_feature (560)..(560): n is a, c, t, g, unknown, or other
aaagctggagctccccgcggtggcggccgctctagaactagtggatcccccgggctgcaggaattcgcacgagaccattacctagaacatcctaatcgaaaagtatctcgcccgcctccttttgctttgctttgctttgctttccctgctgcatgggcacgcaacgcagcggagcagagcatcacgtgcagctccggctggagtactccctgctcccgcctcccatggatgggtgggctcatggcctgtatccgattccgaggaccgagacgacgacnactacgacnaacacggaggtcctatacttacgtggccggttggcgggtacggctgaacccaattatcacatgcgtggtgcggctgtgcgccgccgctacactcgccggcgacgagccttcgtgtcggctcagagaaacagacagacatgcagagtccagaaatccaacagagaaacagggctccgacccactcgcgcgctggctcgctggcaccgcgcgtccctcgccacctccgcaccgccgccgcgctcgccgccgcggngcagggcctcatcgacgcgncccctgcgcggggggaggcgcagaccatccacgcgcagctcccagcgtcgggactcgtcggcagtgccgacctctctgtcaagctccccgttttggcaatacggggcggctccctgcacaatgcccgcgccctggtccacgaaatgccgagccgaagccccgccccgaaa

SEQ ID NO: 27184 - protein, 102 aa, Zea mays
  misc_feature: Ceres CLONE 1400357-F
  misc_feature (39)..(39): Xaa is any aa, unknown, or other
  misc_feature (46)..(46): Xaa is any aa, unknown, or other
MQSPEIQQRNRAPTHSRAGSLAPRVPRHLRTAAALAAAXQGLIDAXPARGEAQTIHAQLPASGLVGSADLSVKLPVLAIRGGSLHNARALVHEMPSRSPAPK

SEQ ID NO: 27185 - DNA, 760 bp, Zea mays
  misc_feature: Ceres CLONE 1400360-R
  misc_feature (38)..(38): n is a, c, t, g, unknown, or other
  misc_feature (39)..(39): n is a, c, t, g, unknown, or other
  misc_feature (55)..(55): n is a, c, t, g, unknown, or other
  misc_feature (56)..(56): n is a, c, t, g, unknown, or other
aactccattatacttcttataactacaccacaacaacnnttccacaatataaacnncccccccgattgggtaccgggccccccctcgaggtcgattgcatcgataagcttttttttttttttttttacaggatacacgttccctgcttactaccgccatgccaattaatatctagtacactcaacacagcacccgaaactacattatttgatgttgatatattatcaaaaattatgaacttctcacgactgtgccgcaaatgaatgaggcaaaatgcagaatctacatcaacatctatacccctccatcagaatgttaaataactctacccgaaacagactaaatcgttgcaccgagaacaaaacgactatccaacccgcacttgccaagaacaaaatcaacacaatgtgtttttttccgaggtactgcatcaagttgtcttcgactcccatagtcatgccaattcatcgaacttaatcttcggactactgaaaggaaggactcttgaaaggaagagatacgaaagagctgtctccggccctcatctaataaatgggtcgaccatgaatctgctggccgggtcttccccatatttattgtaatcaaaaactgcacacttgccgtgcctgtaggggcatacctatatagaattcctttccgtgcgcccagttgtttccttttattcccccccctattagggtatccttggctttcaagttcaataaaatataaattttgagactgttctttttttttctgg

SEQ ID NO: 27186 - DNA, 706 bp, Zea mays
  misc_feature: Ceres CLONE 1400360-F
  misc_feature: Encodes the peptide sequence at SEQ ID NO. 27187
aaagctggagctccccgcggtggcggccgctctagaactagtggatcccccgggctgcaggaattcgcacgagaccattacctagaacatcctaattgaaaacttccaatttgtcttccaaatatagaaccaggcgcagcgaccagatgtcgccgcatccgaacctagccaccgtgggaagccggccgcaaagattctcctctcggattccggcgacgcgaaccgtcccctcgacgaggctgctgcgatagatttttcttaccattcgaatagttgatgagcgatgaatacagagcaagaatcttgatggtgcgtgtgatacaacttgctaaaggagagctgactgcttgaagtgaccatgttggaccatcttgctatcattgcgtctgagttaggggacgacgcaacggattttgaggttgatggtatcgacaacctcagcgagaacgatgtcagcgactaggagatcgatgctgacgagctcgcccgacgaatgtgcaaggacaaggccaagctaaagaggattaaggacagggtagaaaagcttggccctgcagggttggaagctggagaaaaccaccacaaaagaagatttccaactaaggcccctcggtaaaacactggagggggctcggggaaggttttcctagagcacatcaccagccctgacgcgcgtcccccctatcgccccaacgatcaccgacca

SEQ ID NO: 27187 - protein, 34 aa, Zea mays; identical to SEQ ID NO: 21831
  misc_feature: Ceres CLONE 1400360-F

SEQ ID NO: 27188 - DNA, 701 bp, Zea mays
  misc_feature: Ceres CLONE 1400363-F
  misc_feature (433)..(433): n is a, c, t, g, unknown, or other
  misc_feature (578)..(578): n is a, c, t, g, unknown, or other
  misc_feature (588)..(588): n is a, c, t, g, unknown, or other
aaagctggagctccccgcggtggcggccgctctagaactagtggatcccccgggctgcaggaattcgcacgagaccattacctaagaacatcctaatcgaaaacccactagtaccgccacacgaattcccgaccccgatggcgacatcgccaccgcagaacccttagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggcaacagccggccccgccgccgcaggcgctccgctctacctctccctctccgcccggtggccgcgcactctgctcggattgctggtgagatgcccaaagcctttgtgatcttangatgatgttgtgcaacacaccctgactaatttgcacagtattcacaaaagcttactattttggcaggccaaggctgagggaacaaattctcagaaagtgtactttatgatattttgagagaagtcccaagggcctttgttgatgncacatatcanacactcactagactcgggagcaatggacgcccctgtccatacattttgcatctgcatcctgatatggtgtcacaaactcgctgccctgacagtatgcacactgcttggcgctt

SEQ ID NO: 27189 - DNA, 754 bp, Zea mays
  misc_feature: Ceres CLONE 1400364-F
  misc_feature (323)..(323): n is a, c, t, g, unknown, or other
gttttgggtgtggatggtgggatagaaggagagaaaaaaaaaaaaagaaacgaaaaagctggagctccaccgcggtggcggccgctctagaactagtggatcccccgggctgcaggaattcgcacgagaccattacctagaacatcctaatcgaaaagcaagaggtaacactcgcgtctcattctcccgttcttgaggggcaatcgcgaatcgcgctcctcgcggtagcggtcgattacccggctccgcccagatccgccgcggctgcgctccagttccctgtcgcgtgcgtagggctcctcgtccctccctctatccccggntgtgtacggactggggatcggggatccctccggaccgggataggattttcgttttgctggcgaggaagggagcttcccccgatagatgtctcacctccgataccctggatttcgtccgtggcgagcggctaccgcttctgctccttttgtgacagctgaatctttgtggttcgaaggcgatttgacttgcgttcacctgacgcggtgacgcccaatgagctcccacgtctccacatcgcgggggtcttcatcccccaggcaagcttgggaacgctgagactcaccccgggggcgtggcagcccgcccaagcacctatgggctccaacccggacaacagggccgcgggtggattgaccagggaaggttcaggcccgttcggccgggaaggcttcggaaaatccaggacctgggggagaatgccttcccactg

SEQ ID NO: 27190 - DNA, 723 bp, Zea mays
  misc_feature: Ceres CLONE 1400365-F
  misc_feature (670)..(670): n is a, c, t, g, unknown, or other
tggagctccccgcggtggcggccgctctagaactagtggatcccccgggctgcaggaattcgcacgagaccattacctagaacatcctaatcgaaaacttggatagtccgtagccgcttgccctgttcgcatcttcgcgcgtggcgcacaccgctccagctctccttcgacgggcacggccgagccgccttcgtcttggccgcagcggtgcgcgctctccatggcgtcctaattagcctagccgcaacgccgcgcccgtgcctgcgaagtagggtgtaaagttttgtatatgatgccaggcatggatgaaccccttcttggcaatggtcttaagaccagcgggaaaagagagagcctggtagtggccgaggtcagaaaacagatgtaccttgctgggccactcatcgctgcatggatcctacagaacattgtccagatgatatctatcatgttttgtcgtcacctttggtgagcttgccctctccagtgcctccatcgccacctccttttgcaggcgtactggcttcagcttattgtctggcatggcgagcagctggaccactgtgtggcatcgtcggggcagcatactatctctgcatctacagcaaggcatcctgggtcctcagccagctggggtgcgatattggcaacctggcaatctccacttggncagatcaaattgcgtgggaggatatcggggaatccgcttggatgccccaggcc

SEQ ID NO: 27191 - DNA, 724 bp, Zea mays
  misc_feature: Ceres CLONE 1400367-F
  misc_feature: Encodes the peptide sequence at SEQ ID NO. 27192
  misc_feature (534)..(534): n is a, c, t, g, unknown, or other
  misc_feature (676)..(676): n is a, c, t, g, unknown, or other
aagctggagctccccgcggtggcggccgctctagaactagtggatcccccgggctgcaggaattcgcacgagaccattacctagaacatcctaatcgaaaagccaagctttcctcaaaaactcgaaaaaggaacggagaaggcgtcctcgacgactgcccatggccgccgcccggacctagccagggattgttgtctcctgagtcccgacctaccaaggcggaaagggagagggggcgctgtggcgtcaggaaataactggaagccgagggctgagggcgagcgcagagtcgggtggttatcgctttctttttcgttttctttttccggaggggagagtattagggatgccggttgctaggccggagccgcaggagccccgggtgatcgcccatgtcgacatggactgcttctatgttcaagtcgagcagcggaggaacccggcgctcaggggacagccgaccgccgtggtgcagtacaacggctggaaaggcggcggcttgattgccgtcagctacgaggctcgtggatttgntgtgaagaagtccatgcgcggagatgaggccaagagtatgtcctggtattaatctttgtcaggtcccagtggcgcgtggcaagctgaccttatctttacagaagtgctggtgctgaggttgttgcaatctttgcagcaaggnaagtgcgagcggcatccatcgacgaagttatcttgacctactgatgaa

SEQ ID NO: 27192 - protein, 79 aa, Zea mays
  misc_feature: Ceres CLONE 1400367-F
  misc_feature: SWISSPROT Homolog: EC 2.7.7.7 DNA-directed DNA polymerase
  misc_feature (63)..(63): Xaa is any aa, unknown, or other
MPVARPEPQEPRVIAHVDMDCFYVQVEQRRNPALRGQPTAVVQYNGWKGGGLIAVSYEARGFXVKKSMRGDEAKSMSWY

SEQ ID NO: 27193 - DNA, 750 bp, Zea mays
  misc_feature: Ceres CLONE 1400369-F
  misc_feature: Encodes the peptide sequence at SEQ ID NO. 27194
  misc_feature (412)..(412): n is a, c, t, g, unknown, or other
  misc_feature (419)..(419): n is a, c, t, g, unknown, or other
  misc_feature (432)..(432): n is a, c, t, g, unknown, or other
  misc_feature (445)..(445): n is a, c, t, g, unknown, or other
  misc_feature (456)..(456): n is a, c, t, g, unknown, or other
  misc_feature (472)..(472): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (560)..(560): n is a, c, t, g, unknown, or other
  misc_feature (561)..(561): n is a, c, t, g, unknown, or other
  misc_feature (624)..(624): n is a, c, t, g, unknown, or other
  misc_feature (625)..(625): n is a, c, t, g, unknown, or other
aaagctggagctccccgcggtggcggccgctctagaactagtggatcccccgggctgcaggaattcgcacgagaccattacctagaacatcctaatcgaaaaacatcccagtgccgagtgtccccacacaaccaagcggaagcttcggtcgaacagagggagtaagcagttgcgtttcgcattgcgcggcgccgatgggggcgtcgtggaagtggatcaagtcgctggtggccctgaaggcgcccgagaaggcggcggggcacaagggcggtcgcaaatggcgtctctggcggagctcgtcggccacgtccagggccagcgccggcgagggcagtgcgctggcgtccgagtcttcttcggcgtcggccgactcgttcaactcggtacctcgccgccgtggtccgcgcgccgncccaggngatttcctgctcnatcaggcaggaantggggccgccngtccgcatccataccnccccttccgcggattcttgggcgagacnnngcgttgacaggcgcttgaggggcatcagtccggctggcaggcgcctgggtgcgcgggnncggcgcgtgcgcaaggcaactggccggtcacgctcaagtgcatgcacgcacctgctggcgggnnggcaggaacggcgccccggggaggcgccgggcgcgctccctccgctgatggccacggctcacagggccaggacgcgactcaagggctgtgccagttctaccaaagacgctatgggaaacaatggg

SEQ ID NO: 27194 - protein, 104 aa, Zea mays
  misc_feature: Ceres CLONE 1400369-F
  misc_feature (73)..(73): Xaa is any aa, unknown, or other
  misc_feature (80)..(80): Xaa is any aa, unknown, or other
  misc_feature (84)..(84): Xaa is any aa, unknown, or other
  misc_feature (88)..(88): Xaa is any aa, unknown, or other
  misc_feature (93)..(93): Xaa is any aa, unknown, or other
  misc_feature (103)..(103): Xaa is any aa, unknown, or other
MGASWKWIKSLVALKAPEKAAGHKGGRKWRLWRSSSATSRASAGEGSALASESSSASADSFNSVPRRRGPRAXPGDFLLXQAGXGAAXPHPYXPFRGFLGETXR

SEQ ID NO: 27195 - DNA, 522 bp, Zea mays
  misc_feature: Ceres CLONE 1400372-F
  misc_feature: Encodes the peptide sequence at SEQ ID NO. 27196
  misc_feature (268)..(268): n is a, c, t, g, unknown, or other
aaagtggagtcccgcggtggcggcgctctagaactagtggacccccgggctgcaggaatcgacgagaccattacctagaacatcctaatcgaaaaattcgtccatcccacctaccatggccaccgcctcctggactgacgccggtgcccagtcgtgcgatgaccccagtctcctcgccttcgggtccttctcgctcggccgctccaaccgcgggccggacacctacacactagagtgcgtcagctcgagcctacagctcgccactcanatctctacagctcggccgtgtggcatcacacctccgacgcgtagcccctcgtcccggcgcaccaacgcgtgctgaagtgcggtcatctttccttcggtcattcgttccccgatggccctcccttccaaacggcccggggcccttcttcccgctccctttttcccccctttcgggggggggggggcccggggcccggaaaaaaaaggggggggcccccccccgaaaagggtttcgggtctggggggattccccgg

SEQ ID NO: 27196 - protein, 75 aa, Zea mays
  misc_feature: Ceres CLONE 1400372-F
  misc_feature (51)..(51): Xaa is any aa, unknown, or other
MATASWTDAGAQSCDDPSLLAFGSFSLGRSNRGPDTYTLECVSSSLQLATXISTARPCGITPPTRSPSSRRTNAC

SEQ ID NO: 27197 - DNA, 711 bp, Zea mays
  misc_feature: Ceres CLONE 1400376-F
  misc_feature: Translation starting site: 178
  misc_feature (330)..(330): n is a, c, t, g, unknown, or other
  misc_feature (582)..(582): n is a, c, t, g, unknown, or other
aaagctggagctccccgcggtggcggccgctctagaactagtggatcccccgggctgcaggaattcgcacgagaccattacctagaacatcctaatcgaaaagaccctcgcttcacttgtcacggactcgcgtccacaaaccacaaccagctcactcaagaacaaagaacccaacccatggcttctcccaagccgctcctcctgctcgccacctcgttcctgagctgcggcctcctggtggccgccgactacgccccaatgaccctgaccgtggtgaacaactgcccctacccggtgtggccgggcatccaggccaactccgggcacacngtcctgggagggcggcggcttcttcctcccgccgctctcccacaagtccttcccggcgccggcccacccctggtccggccgcatctgggcgcgcacggggctgcgcgggcgccggcgcgcagctccactgcgccacggcgaactgcggcgggcgtccccaatgcggcggggctccgggcgggggcgacgcccgcgaccgctgggtgcaggtgaaacctccaccagcggaaacgaccagaacctcgtaccggngtgtagcgctgggggaccggctacaacgtggggccctagtccgtgaccccggcacgaaggggccgggggaaattgacccggtccctcgccttgccgtaaggaacctcacccgagaccctggccccgggg

SEQ ID NO: 27198 - DNA, 750 bp, Zea mays
  misc_feature: Ceres CLONE 1400380-F
  misc_feature: Encodes the peptide sequence at SEQ ID NO. 27199
ggagctccccgcggtggcggccgctctagaactagtggatcccccgggctgcaggaattcgcacgagaccattacctagaacatcctaatcgaaaaaatccactccactccatcatcccgtgcctcacgagtcacgagtcactccaggtccaggctgagcagcaatggcgccgcgaacgctcggcttcaacgcggccccgctcctccagattctgcggtccctgtgcctcctggccctcgccgcggcggcggcggtgtccgggcggcgccacggggcctccccggcgcgcggcagcgggcagagcatgtacctggcgccggcctgccgggcgcacacggcgtccttgccggacttctgtggcttgggcgacgccaccaatccctacaccgcggcgttcaggtccgcggcgcacctcctgtcgtactttccgcccaagcgccgtaccgtgacattgccccacgcccccggaaccgccggctaaacccctactttaaaaccgaccgagcgattcggcctttagcccccccaaccaccccgattatattccccctctatcccacccccccgcgaagctccagactgggccaccgttttatatttcaccccacacaaagcaagtgatcatatcacgaaatcaccaccccccttacgcgcacggccggcgggtaggcatctcgcaggagttaatactcgtcccccgcgtccccaacatacccaccaaaaacacacgggtacgcggtcgcgccccg

SEQ ID NO: 27199 - protein, 105 aa, Zea mays
  misc_feature: Ceres CLONE 1400380-F
MAPRTLGFNAAPLLQILRSLCLLALAAAAAVSGRRHGASPARGSGQSMYLAPACRAHTASLPDFCGLGDATNPYTAAFRSAAHLLSYFPPKRRTVTLPHAPGTAG

SEQ ID NO: 27200 - DNA, 685 bp, Zea mays
  misc_feature: Ceres CLONE 1400382-F
  misc_feature: Encodes the peptide sequence at SEQ ID NO. 27201
  misc_feature (279)..(279): n is a, c, t, g, unknown, or other
  misc_feature (329)..(329): n is a, c, t, g, unknown, or other
  misc_feature (331)..(331): n is a, c, t, g, unknown, or other
  misc_feature (414)..(414): n is a, c, t, g, unknown, or other
  misc_feature (461)..(461): n is a, c, t, g, unknown, or other
aaaagctggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgangtcatctccaccctcatcttcgtcttcgccggccagggctccggcatggncnttcagcagctgaccggcgggcgcccgacgacccccgcggggctgatcgcggcgggcgtggcgcacgcgttcgcgctggtcgtnggcgtgtctgtgggcgcgaacatctcggggggcacgggaaacttggncgggacttccgggcctttcgtggggggaaaatccccgtgttcggggggctcctgaactggggggccaaattggtggggcccacccgggggggggtcccgggtcccctttcccaaggggggggaaggcacgggccccctccggattaaggggtgttgtttttggggaaacacctttgttctaaaaaaaaaagaaaaccctctgggggggggaaacacgggaaacc

SEQ ID NO: 27201 - protein, 104 aa, Zea mays
  misc_feature: Ceres CLONE 1400382-F
  misc_feature (26)..(26): Xaa is any aa, unknown, or other
  misc_feature (43)..(43): Xaa is any aa, unknown, or other
  misc_feature (44)..(44): Xaa is any aa, unknown, or other
  misc_feature (87)..(87): Xaa is any aa, unknown, or other
MPINRIALGSHQEVYHPGALKAAFAXVISTLIFVFAGQGSGMXXQQLTGGRPTTPAGLIAAGVAHAFALVVGVSVGANISGGTGNLXGTSGPFVGGKSPCSGGS

SEQ ID NO: 27202 - DNA, 705 bp, Zea mays
  misc_feature: Ceres CLONE 1400383-F
  misc_feature: Encodes the peptide sequence at SEQ ID NO. 27203
  misc_feature (578)..(578): n is a, c, t, g, unknown, or other
gcggtggcggccgctctagaactagtggatcccccgggctgcaggaattcgcacgagaccattacctagaacatcctaatcgaaaaatgctctgatccccatttagagctgatcgtcgcgtcgaggtactctactcatgcacccagccactacgtactatttgctcatcaagctaccaaggatttcttggttacgctagctcgccggtttcttggttgttactagcacccggcggcgtctgttcgtccacagctagccaatctctctctccgggggacgagacgatggacatcatcaacggggccgtgctccctcgctgccacgccgcccccgtcacgggcgccgcggcggcctccgtcgccgacgcgagagtgagcggacacctccagcttctccggcgcgtgcgctgcagaggaagcggaagcgccagtgccgggctgctgcatgcgacgacgccccgagccggcgtggcagcgcgcaggttcttctccccaccgctggggaacgggaacgggaatgggaggaccatcggctggcggccggctcgctgcacccacggcggctcctcctccgacggngacggcgccgccgccgcggacttcgacgccggtgaggaggagtccggtgactccgcggcttggagggcgttgagttaggagcgtgtaagacgagggttcaccatcaaaaggccgcagccacgcaccc

SEQ ID NO: 27203 - protein, 123 aa, Zea mays
  misc_feature: Ceres CLONE 1400383-F
MDIINGAVLPRCHAAPVTGAAAASVADARVSGHLQLLRRVRCRGSGSASAGLLHATTPRAGVAARRFFSPPLGNGNGNGRTIGWRPARCTHGGSSSDGDGAAAADFDAGEEESGDSAAWRALS

SEQ ID NO: 27204 - DNA, 668 bp, Zea mays
  misc_feature: Ceres CLONE 1400384-F
  misc_feature: SWISSPROT Homolog: EC 1.14.13.21 Flavonoid 3'-monooxygenase
  misc_feature (308)..(308): n is a, c, t, g, unknown, or other
tggagctcaccgcggtggcggccgctctagaactagtggatcccccgggctgcaggaattcgcacgagaccattacttagaacatcctaatcgaaaactcattctttcttcctcctgagaaagcaatgcataccctctccttactgttgcagggcaaaagcaatctgacatctcttccccctgccacgatggaggatgcttaccgaataattcgatccgaagctggcaccgggacagaggtggagggacgaggcgaataacatgttctactcgcatctctcgctgtgtctgtgctacaaaaagtagtnggcgacggtacgggcccatcatgacggagtggctgggtacgccgcccacggtgatgtaatccaagtcggagctggccaaggaggagctcaagacccacgaccaggagctcgccgaccgctgccgggaccgctccaccgagagcttcagccgcggcggccaggacctcatctgggccgactacggcccccactacatcaaggtgcgcaatctctgcaacctcgagctcttcacgcagcgccgcctcgaggcgctcaggcccatccgcgaggacgaggtcaccgccatggtcgagtccgtctacaaggacgtcaccgcgcctggcagtgcagggaagccgttggtggtaaagaaccacctct

SEQ ID NO: 27205 - DNA, 731 bp, Zea mays
  misc_feature: Ceres CLONE 1400386-F
  misc_feature: Encodes the peptide sequence at SEQ ID NO. 27206
  misc_feature (678)..(678): n is a, c, t, g, unknown, or other
  misc_feature (679)..(679): n is a, c, t, g, unknown, or other
  misc_feature (709)..(709): n is a, c, t, g, unknown, or other
aaagctggagctccccgcggtggcggccgctctagaactagtggatcccccgggctgcaggaattcgcacgagaccattacctagaacatcctaatcgaaaaatctccccttccttcctttcctactcccacactcccccaccctccactagtactagtactagtaccacaaccaccccaccgggaaaaaacccaacaaggggtaggggcgccgccgccgccagcgccggcgtgcagatcgcggccggatctacggcgctggggcacgggggtccccgtgatcgacgacgcctccgccgagggttcggatggctatgcgaaaagaaaaccctgtgcttaatgcttgtcaagcatcctatggccggatcacgcgagctcaagttgctgcaaatcgtcgaagctttggagctttcccttctgttccattgcctgcaaaaaccgagcgaaaacagactgcacaagggaaggtaaaacgaggttcttcatatgacaacaccagtgcaagcgttgcactttcaggcccccagcctaaaaggcgcacaggtagtcagggatgtgaccaatttgagcaatgctaactctaacagaagttttggctgctgcaaccgaagcttccagacaaagcccttctctaaggactgggaagaaccgtgagcaaaagcaagccggtgcgcaaannaagattcctaaaaaaccaccaccagctggntaatggaagtggcattggacta

SEQ ID NO: 27206 - protein, 89 aa, Zea mays
  misc_feature: Ceres CLONE 1400386-F
MAMRKENPVLNACQASYGRITRAQVAANRRSFGAFPSVPLPAKTERKQTAQGKVKRGSSYDNTSASVALSGPQPKRRTGSQGCDQFEQC

SEQ ID NO: 27207 - DNA, 686 bp, Zea mays
  misc_feature: Ceres CLONE 1400391-F
  misc_feature: Encodes the peptide sequence at SEQ ID NO. 27208
  misc_feature (348)..(348): n is a, c, t, g, unknown, or other
aaagctggagctccccgcggtggcggccgctctagaactagtggatcccccgggctgcaggaattcgcacgagaccattacctagaacatcctaatcgaaaagaccctcgcttcacttgtcacggactcgcgtccacaaaccacaaccagctcactcaagaacaaagaacccaacccatggcttctcccaagccgctcctcctgctcgccacctcgttcctgagctgcggcctcctggtggccgccgactacgccccaatgaccctgaccgtggtgaacaactgcccctacccggtgtggccgggcatccaggccaactccgggcacgacgtcctggagggcgggggnttcttcctcccgccgctctcccacaagtccttcccggcgccggcccacccctggtacggccgcatctgggcgcgcacgggctgcgcgggcgcggcgcgcagctccactgcgccacgagcaactgcggcggccgctccagtgcggcgggctccggctgtaccggcccccccaaccttggcgtaagggaaacttcccccagggaaaagaacaaacctcctaagggggggaacccgtgttggaacggtttcaaacgggggggccggtcccggaaaccccccaagaaagggcccggagaaaatatgccccggttctttgcttggttgaaagaaaacccaccc

SEQ ID NO: 27208 - protein, 117 aa, Zea mays
  misc_feature: Ceres CLONE 1400391-F
MASPKPLLLLATSFLSCGLLVAADYAPMTLTVVNNCPYPVWPGIQANSGHDVLEGGGFFLPPLSHKSFPAPAHPWYGRIWARTGCAGAARSSTAPRATAAAAPVRRAPAVPAPPTLA

SEQ ID NO: 27209 - DNA, 640 bp, Zea mays
  misc_feature: Ceres CLONE 1400393-F
  misc_feature: SWISSPROT Homolog: EC 2.6.1.2 Alanine transaminase
tccccgcggtggcggccgctctagaactagtggatcccccgggctgcaggaattcgcacgagaccattacctagaacatcctaatcgaaaacactcgctttccggcgggcgactggcctaaaatcgcctcttgtttgtttgcttccgtcgtcccctctccacgtagagcacgcccccggaccaccttttataagcaccaaccatctggccttgccgcgccgattcgccacgaagccgcactgtgagagagggacgcggcctgttgtcccggcttttagacgcaacttccatcgctgcgaagctatccattcgtgttcgtcatgcccgccagcgtcaccgtggaaaacctcaaccccaggtcttaaaatgtgagtatgcagtccgtggggagattgtcatccatgctcagcgcctggaggaacaactacaaccccacccggggccccttcctttttgaaggaaaaacctctatttgcaaccttggggaaatcccaaattctctgggcaagaaaccgggggacattttttccgggggagggtctttggccctttggggaacaccccccgggccctcttggagaaaaaaagggaacccccaatttctttgtgtccaagggtggggagggaaatttttccccaa

SEQ ID NO: 27210 - DNA, 662 bp, Zea mays
  misc_feature: Ceres CLONE 1400395-F
  misc_feature (641)..(641): n is a, c, t, g, unknown, or other
  misc_feature (662)..(662): n is a, c, t, g, unknown, or other
tggagctccccgcggtggcggccgctctagaactagtggatcccccgggctgcaggaattcgcacgagaccattacctagaacatcctaatcgaaaaaaaatttctctcctaccttatcctctgggctgctcaccaccccagtcctctccctcccctcaacctagcgccgccactcgtgcccaccatgccgccgcaccgccgctggtgaacggatccgtgcatcccgtacaccggccttggcctcctcccccctcccctcaacctagctccaccactcgcgcccacctccgtccgccggcggcgcaggggaggagccggccatccttagtgcgccatggcgtggccggtgtggtggaagcccagcctctgcgcgtggcgagcgccgccggcttgcagtgcgccggcggcggcagggactgcctctgcgtggtggggagcgagtgcgcggacacgacgaggcggcggacgccggagcgcaccctgtagaggacgtggccccagccccaggtgcccctgccgtggcggccctcgtcctcgttcatcttgaggtcgcccgcgaaccccggcttccaggataggagccagccgacgatgccccgccgccaccactgcctcagggagccgcctcccgggcgagggnaagggcgccggccgggagcgn

SEQ ID NO: 27211 - DNA, 831 bp, Zea mays
  misc_feature: Ceres CLONE 1400400-F
  misc_feature: Encodes the peptide sequence at SEQ ID NO. 27212
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (24)..(24): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (45)..(45): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
gaaaggggggccccccccnnnccntgggccaaccccnnnggcttnaaaannnagggcaaaactggagctccccgcggtggcggccgctctagaactagtggatcccccgggctgcaggaattcgcacgagaccattacctagaacatcctaatcgaaaaaaaaggtcttttccctctccaccggtccaccccaaccaacctcctcccaccctccctccaggcctctccactccccggcaacctcgccgccggcgccggggccatggaccggtggaccggcggcgtctacgtcccactctccagaggaggacccgtcttccgcgtcactgccgcgctcctcctatcgccagtcaaaacgctcgccgttcccctagccaacggccatccttttcccgcgcggaccgcgttccgaggccacggaccgaatccggggaacccgagcgggttcttcttgacgcccggcccacctggggttgggggtccctcctccggggcaacccctcccctggcggtaatgccagaaccgccggggggtgggccccaaacgtccggccggaggactttttaactgggcgccaaatcgggcgggggggacccccaaagcgcctggttttcccgacccggtctaaagctgcggcttgagaatcccccccgaaggggggaaacatacaaccccccccctccccggggggtaacgccccggacaaaaaggaatttggaatttggtgcaggtggagcacatccgcagccagtgagctatgggggacaatatcgtaaactcattcccggtgggtgtaccggattaatatgttctcgatgggatctccacgc

SEQ ID NO: 27212 - protein, 101 aa, Zea mays
  misc_feature: Ceres CLONE 1400400-F
MDRWTGGVYVPLSRGGPVFRVTAALLLSPVKTLAVPLANGHPFPARTAFRGHGPNPGNPSGFFLTPGPPGVGGPSSGATPPLAVMPEPPGGGPQTSGRRTF

SEQ ID NO: 27213 - DNA, 668 bp, Zea mays
  misc_feature: Ceres CLONE 1400401-F
  misc_feature: Encodes the peptide sequence at SEQ ID NO. 27214
aaagctggagctccccgcggtggcggccgctctagaactagtggatcccccgggctgcaggaattcgcacgagaccattacctagaacatcctaatcaaaaaaggacctactttacacctcctcttcttcttcttcctcgtgcagcagctgtccatcgccgctgggttttctttgttggcattgggttttggaggagaggtcaaggctgagactcggagacgaaatgggtcataggatgttcagtcccttgggattccttcttcttgccatcgtcgtcctctatggtggaacagagcagaggcgagcggaggcagcagaaggagggagcccgcacaggctgctggccaccatctcggtgtccaagccgtcctaccccacggtcaccacgcccatgtcggcctacggcgacccggtctccacgccagccaccccgtactcaacgttcccgtcgctggcgaccgggaacggcggtgccggtgccggtgcaggcggcggtgctggtgtatgcggaggcggcggcggcggcgggacgtggtgcgtggccagccagagcgcgagcccgaccgcgctgcaggtcgcgctggactacgcctgcggctatggcgccgactgctccccgatccagcagggcgggagctgcttctaccccgacaccgtccacgaccag

SEQ ID NO: 27214 - protein, 148 aa, Zea mays
  misc_feature: Ceres CLONE 1400401-F
  misc_feature (103)..(148): Pfam Name: X8 Pfam Description: X8 domain
  misc_feature: SWISSPROT Homolog: EC 3.2.1.39 Glucan endo-1,3-beta-D-glucosidase
MGHRMFSPLGFLLLAIVVLYGGTEQRRAEAAEGGSPHRLLATISVSKPSYPTVTTPMSAYGDPVSTPATPYSTFPSLATGNGGAGAGAGGGAGVCGGGGGGGTWCVASQSASPTALQVALDYACGYGADCSPIQQGGSCFYPDTVHDQ

SEQ ID NO: 27215 - DNA, 698 bp, Zea mays
  misc_feature: Ceres CLONE 1400402-F
  misc_feature: Encodes the peptide sequence at SEQ ID NO. 27216
  misc_feature (681)..(681): n is a, c, t, g, unknown, or other
  misc_feature (695)..(695): n is a, c, t, g, unknown, or other
  misc_feature (698)..(698): n is a, c, t, g, unknown, or other
aaagctggagctccccgcggtggcggccgctctagaactagtggatcccccgggctgcaggaattcgcacgagaccattacctagaacatcctaaaaaaaaaccaaaacctccactcttcctcccaccaaggcaccaacccgacgcaaagccgccggctttccccgatggcgacgacgatgtcagtttcggcggtgtccccgcccgccgcggctgtcacgcggccccggacgatggtctgcgtgccggcgacggcgcgggcgccgcgggagatggcggctgagctggccgccgccgccgcgctcggcgccgacgtggcggagcttcgcctcgactgcctcgccggtttcacgccgcgcagggacctgcccgtcatcctcgccaagccccgtccgctccccgccctcgtcaccttcaggcccaagtgggaaggaggcgaatacgaaggcgatgacgaatcccggtttgaggctctgctattggcaatggagctgggagctgaatatgtggatgtcgagcttaaggtggctgacaaatttatgaaacttatttctgggaggaacctgataactgtaaacttatagtttcatcccacaactatgagaccactccatcgtccgaggaacttgcaaattggtggctcagattcaagcaacgggggctgatatcgtgaaatagctancaccgctactgaanttn

SEQ ID NO: 27216 - protein, 138 aa, Zea mays
  misc_feature: Ceres CLONE 1400402-F
  misc_feature: SWISSPROT Homolog: EC 4.2.1.10 3-dehydroquinate dehydratase
MATTMSVSAVSPPAAAVTRPRTMVCVPATARAPREMAAELAAAAALGADVAELRLDCLAGFTPRRDLPVILAKPRPLPALVTFRPKWEGGEYEGDDESRFEALLLAMELGAEYVDVELKVADKFMKLISGRNLITVNL

SEQ ID NO: 27217 - DNA, 636 bp, Zea mays
  misc_feature: Ceres CLONE 1400405-F
  misc_feature: Encodes the peptide sequence at SEQ ID NO. 27218
tccccgcggtggcggccgctctagaactagtggatcccccgggctgcaggaattcgcacgagaccattacctagaacatcctaatcgaaaaatctcgtccacgaaacgtacggacttcgggcatcggccccaacgccagcggcaccgcaccaccacgcccgtcggcgacatgaatccgcccgcagcagccgcgtccaccggcgcaggaggccacgccgcggcgcctgcggcagcccgggagtacgtgcactacccgaggctctcgccagaggaggtggccccgcccccgcccccgccttatcacgccgccaccgccgcgccgtccgcctacggaggcaacccctacatctactcccccgccggcggcgccgccacctccccgaagaatacgatggactccgtgaaggacgtgctcggcaagatggggaagaggtttggcgaggcggcccgcaagaccgagaccatcaccggcaatttctggcagcactgtgagcttttcgatttcgttgccgtattttcacgaaatcgggttccgaagttgtttctgtgtgtttttcatcaaattgctaatcgtgttgtgcatttttcatgtacattttgttattgtaatatgaaattaggttgtcgttaagctgg

SEQ ID NO: 27218 - protein, 153 aa, Zea mays
  misc_feature: Ceres CLONE 1400405-F
MNPPAAAASTGAGGHAAAPAAAREYVHYPRLSPEEVAPPPPPPYHAATAAPSAYGGNPYIYSPAGGAATSPKNTMDSVKDVLGKMGKRFGEAARKTETITGNFWQHCELFDFVAVFSRNRVPKLFLCVFHQIANRVVHFSCTFCYCNMKLGCR

SEQ ID NO: 27219 - DNA, 725 bp, Zea mays
  misc_feature: Ceres CLONE 1400407-F
  misc_feature (22)..(22): n is a, c, t, g, unknown, or other
  misc_feature (34)..(34): n is a, c, t, g, unknown, or other
  misc_feature (725)..(725): n is a, c, t, g, unknown, or other
ggggggtgggggaggggggggnaggagggaaaangggtaaaaaaatggtaaaatcccccccccccaaagctggagctccccgcggtggcggccgctctagaactagtggatcccccgggctgcaggaattcgcacgagaccattacctagaacatcctaatcgaaaagacccaggcaagaggcaacacagcaagcagcagaaaacatctccgggagtccgaaccacccacaggcggcaggccacaccacaggttccgcttccgcacagctgctagctagctagcgttcgcaagtagcagtagcgttccatcgaggtcgagggcaatgaacgggggaatgggcccaaagtagtctcccaaccaccgggggggggggggttcccggaaagcccggggcctcccaaaaacccctttgggccgggcccccgggggggggaaaaaaaaaaggcgaaaaaaacccttttgaaaaaaaaaaaaccccccccccgggttcctccacctcccgcgggaggaggaaaaaaaaaaaaaagacaccccccccccccaaaagaggtgggaggggagacaccccccccccgggagaatagacgagagaaaccctccccgggggggtgatgaggaaggggggcagggaaaaaaaacaaaaatgtaattctgcccccgcccccccagccaaaaaaaaagggcggcggccgcaaacccggggggggagcaaaaaaaaaaaan

SEQ ID NO: 27220 - DNA, 723 bp, Zea mays
  misc_feature: Ceres CLONE 1400408-F
  misc_feature: Encodes the peptide sequence at SEQ ID NO. 27221
  misc_feature (433)..(433): n is a, c, t, g, unknown, or other
  misc_feature (434)..(434): n is a, c, t, g, unknown, or other
  misc_feature (457)..(457): n is a, c, t, g, unknown, or other
aagctggagctccccgcggtggcggccgctctagaactagtggatcccccgggctgcaggaattcgcacgagaccattacctagaacatcctaatcgaaaaacgttgccatcgcgcgcggcgcccgccggccaaggccaaccatgctggcgagggctcctccgccgcggccgtgctccagcggcgtttgcatcgcccgcgcacatcccagagccgccgccgtcgcggccaggccggggacgacgaggacgacgacgacggtcgcggcggcggcggcagaggccgcttctaacgggtcagcggcggcggccgtcgcagggatcagcagcagcagcagcgcgctggtgacctcgaccgtcgggaaatcgacgaacatcctgtggcatgagtgcgcccatcggcagaaagagcgacagggtctgctgaaccagaannggctgcgtcgtggggatcctggnctaaagcgttcagggaaagcacgctcgcgggcgcgctgagccgcagctgcacggaaaaggccactcagtacggcctcgacgggacaactcaggaagggttgaaaggaactcagtttccgaacaaagaccccgccaaaactcccaaaaaaaggggaattacgaaatttttcccccaaatttggcttctttggatccccgccccaattcgccataaaaaaaaccaaaggggggggggaaattggttgcaaacaccctcttttacgggg

SEQ ID NO: 27221 - protein, 117 aa, Zea mays
  misc_feature: Ceres CLONE 1400408-F
  misc_feature (97)..(97): Xaa is any aa, unknown, or other
  misc_feature (98)..(98): Xaa is any aa, unknown, or other
MLARAPPPRPCSSGVCIARAHPRAAAVAARPGTTRTTTTVAAAAAEAASNGSAAAAVAGISSSSSALVTSTVGKSTNILWHECAHRQKERQGLLNQXXLRRGDPGLKRSGKARSRAR

SEQ ID NO: 27222 - DNA, 710 bp, Zea mays
  misc_feature: Ceres CLONE 1400410-F
  misc_feature (371)..(371): n is a, c, t, g, unknown, or other
  misc_feature (517)..(517): n is a, c, t, g, unknown, or other
  misc_feature (597)..(597): n is a, c, t, g, unknown, or other
ggagctccccgcggtggcggccgctctagaactagtggatcccccgggctgcaggaattcgcacgagaccattacctagaacatcctaatcgaaaaccaaaaagaccaatcttttactcgcgatcttttcttcctttctttgtcccggcgcggcgtgtgctctcgtggtgtcaagagtggcgtcagctcggcggtgttcacggccgagtgctcccacgccttccacttcccctgcatcgcagcccacgcgcgctcctcctccgccaacggcgttctgtcctgccccgtctgcgcctcgccgtggcgccaggcgaccttcctcgcctccctccgcctccactgctccttccacgacgacaagcaccgagganggaggcgacggacgcaatacgtcgccggccggcaagctatacgacgacgacgagccgctgctgatgcccaagggcgcaggcaatgatgtcagattcaacccgatcccggtagtcgacgaggacgacgagtaagagcagggcgtcgncgagttcaggggctactaccatgcgccatgagtaggagcacctcggtcctgatcatcaccgtggcgccgatgacgtgatncccgtcgtcggatctcactacgtaagtagcgtgctcctcgccgggatagagttccagatgtagcctcgtcggcacagttctggaaacgccccaatgactgttcagctcgtagc

SEQ ID NO: 27223 - DNA, 749 bp, Zea mays
  misc_feature: Ceres CLONE 1400411-F
acagctggagctcaccgcggtggcggccgctctagaactagtggatcccccgggctgcaggaattcgcacgagaccattacctagaacatcctaatcgaaaagccgccaccgtcaccgtggcccgccgccatataagtaaaccctcgcctcgtcctcctcccaggctcgccaccctccgcctccgacacatggcccacccgcacctcgtgctcccctccccgaagtccctcctccccgccgccgcaactccatcgcgccgcgccgtctccatccgcgcggcgctctacaccactttgactcccggcagggctgtcgctgccacacatgccccgccacgtgattcgcgccccgccttccccgtgcaccccccgccggtcccctccacatccctctcattaccccggtcacatcacccaggaccgttcccccctatccgattatcggtaatctctaccccatgccaacggtaagccgctgattcccctattacattacgcctcgttcgatccactacctgtcctcgcaccccccccgaatattatccccctatacccccccccccgccacttcactaaacccccacttttaattcctccgccccaaatgccttgccatttcataacaatttcccagcacgccaatgccccgccaggaggcccaaaatggacttatgttgagtcctgcacctgtatcccccgtatcccttcaaatcgcacctcatacctccccctcgccgtaacccgtaccc

SEQ ID NO: 27224 - DNA, 665 bp, Zea mays
  misc_feature: Ceres CLONE 1400413-F
  misc_feature: Translation starting site: 167
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
aagctggagctccccgcggtggcggccgctctagaactagtggatcccccgggctgcaggaattcgcacgagaccattacctagaacatcctaatcaaaaagttagtagttcaccagagttcacacaaaaatcacaagcaagcagtcgcgtgtgtagctcgcaacaatggcgacgaaccccggcctcttcaccgagtggccgtggaagaagctcggcaacttcaagtacctgctgctggcgccgtgggtggcgcacggcggctaccaagcggcgaccaaggggtggagggcggccgacctggggtacgtggccatcctcccgtcgctgctcctccgggcgctgcacaaccaggcgtggatcaccgcgtcccgcctgcagagcgcgcgcggccggcggcaggtcgtggaccgcggcatcgagttcgagcaggtggaccgcgagcgcaactgggacgaccagatcctgctcagcggcatcctcctgtacctgggctccctacccttggcgggggggcagcacctgccgctgttgnnncgcgcgaacggcgccgcgctcatcgccctgctgcacgccgggcccccgtcgagctcgtctactactggctgcaccgcgcgctgcaccaccacttcctctactcccgctaccactcccaccaccacgcctc

SEQ ID NO: 27225 - DNA, 759 bp, Zea mays
  misc_feature: Ceres CLONE 1400414-F
  misc_feature: Encodes the peptide sequence at SEQ ID NO. 27226
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (29)..(29): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
aatttgtccccnncnnnnnnnnncccccnccccttcccccccccanannnacaaagctggactccccgcggtggcggccgctctagaactagtggatcccccgggctgcaggaattcgcacgagaccattacctagaacatcctaatcgaaaatcccacgagcgcccgccctgccctggccatttcgctctcgtccctacgcaactaaacgccgcgctcccgcagacggtaccagccgccgcgatggggtcctcgtcctcgccaccgccaccaccgccgctgccactgcccatgattgggcggggcgggaacctcaccatcttcatcacgccgccatccccccctagcacgccccggggcgctgggggcacgccgccgctcgagtccccgggctcggatatctccactcccatcccggagcacggcagccccgtcgccgctccctttctccctctccgcggaaccacgaaagccagcgtcgtgactgcctgcggtggtgttcaccccgacccccgccgcctgctcctgggaatgtcgcgctgcccccggcgcccgtgcccgccgcccgcggcacccctaccctccccccgccggtctgagacgcgcgtacccgccgccacgacttcctttggggcaccccgtcccgccgcccccccggacatcccacccccaagcctccgggcgagaaccccgccgcaccctggcctccggcgttgggctcactcgccgcatgcccacacggggcccccccgcacccct

SEQ ID NO: 27226 - protein, 172 aa, Zea mays
  misc_feature: Ceres CLONE 1400414-F
MGSSSSPPPPPPLPLPMIGRGGNLTIFITPPSPPSTPRGAGGTPPLESPGSDISTPIPEHGSPVAAPFLPLRGTTKASVVTACGGVHPDPRRLLLGMSRCPRRPCPPPAAPLPSPRRSETRVPAATTSFGAPRPAAPPDIPPPSLRARTPPHPGLRRWAHSPHAHTGPPRTP

SEQ ID NO: 27227 - DNA, 682 bp, Zea mays
  misc_feature: Ceres CLONE 1400418-F
  misc_feature (453)..(453): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (508)..(508): n is a, c, t, g, unknown, or other
  misc_feature (566)..(566): n is a, c, t, g, unknown, or other
  misc_feature (567)..(567): n is a, c, t, g, unknown, or other
  misc_feature (582)..(582): n is a, c, t, g, unknown, or other
aaagctggagctccccgcggtggcggccgcttctagaacaagtggatcccccgggctgcaggaattcgcacgagaaccattacctagaacatcctaatcgaaaaaaacaacgccgcgacgagaagagagaagagggcgggcatcggccagtgggggcttcggaggccgagggaggcgaggaaagcggcgggtgccgggccgcccgcgccggtgccgaggccctcaccagtcaccaccccctcccctctttccgtctgtcccccgcttgccgccaccgccgctgcctgctcgcgacccttcccccttttaacgctcccgcggccccgcgtcgtgctcccttttgtcgccgctgccttcgtgcccgtactcgcgggttctcctcgctcctcaatctccgcgcctgggcgcggcgttcgccgccggatctgggcgcgggacgtgcccgaaacgtcnattgnnncgcgggtggccgctccggttgggcgccgcggcgctcgcggttctcgtncttcgtgtcagtggctctgctcccacttgtcagttccgacgatggaacaacacctgcnnagggtgttgtcaggngctgggcggattcctccacggggcgcgtgaaggacggggacaaatgagcctcaaggatttgctcttcttcctcccattcctaggactggaggccgcccta

SEQ ID NO: 27228 - DNA, 679 bp, Zea mays
  misc_feature: Ceres CLONE 1400420-F
  misc_feature: Encodes the peptide sequence at SEQ ID NO. 27229
  misc_feature (568)..(568): n is a, c, t, g, unknown, or other
  misc_feature (587)..(587): n is a, c, t, g, unknown, or other
  misc_feature (649)..(649): n is a, c, t, g, unknown, or other
  misc_feature (650)..(650): n is a, c, t, g, unknown, or other
  misc_feature (657)..(657): n is a, c, t, g, unknown, or other
aaagctggagctccccgcggtggcggccgctctagaactagtggatcccccgggctgcaggaattcgcacgagaccattacctagaacatcctaatcgaaaaacttgcgcatcggatcgcatcagctgctgcttttgtccaccaagcaacgattccctttccttccgccgcccaaatgccagtggccaccttcctcctcgtcgcgcttctctcgtgcggcgcacgagccatccggacgcacggcggctatgtctccgcggtcggggaccccggcatgcggcgcgacggcctccgcgtggcatgggaggcgtggaacttctgcaacgaggtcggccaggaggcccccggcatgggcagcccccgcggtgccgattgcttcgatcttctcggtccgtccattccatctctttctctcctctttcgccggggtggttgagtgggttgccaccaagattaggtttttgaggaagcgtggatctctgttccgttccgcagagacgagctcccgacgaagagggggcggccggtgttactcggtggcgcacctggtgagcgacgccgacaccgncctgggcgcggggaccccnttcccgggttcccccggccgggcggcggcccggggtcacggacgccgacctctacgcgccgnncccaggnagctgggtacctcggcgacggc

SEQ ID NO: 27229 - protein, 86 aa, Zea mays; identical to SEQ ID NO: 24620
  misc_feature: Ceres CLONE 1400420-F

SEQ ID NO: 27230 - DNA, 741 bp, Zea mays
  misc_feature: Ceres CLONE 1400421-F
  misc_feature: Encodes the peptide sequence at SEQ ID NO. 27231
  misc_feature (85)..(85): n is a, c, t, g, unknown, or other
  misc_feature (87)..(87): n is a, c, t, g, unknown, or other
  misc_feature (90)..(90): n is a, c, t, g, unknown, or other
  misc_feature (310)..(310): n is a, c, t, g, unknown, or other
  misc_feature (382)..(382): n is a, c, t, g, unknown, or other
  misc_feature (404)..(404): n is a, c, t, g, unknown, or other
  misc_feature (424)..(424): n is a, c, t, g, unknown, or other
  misc_feature (441)..(441): n is a, c, t, g, unknown, or other
  misc_feature (442)..(442): n is a, c, t, g, unknown, or other
acaagctggagctccccgcggtggcggccgctctagaactagtggatcccccgggctgcaggaattcgcacgagaccattacccntnagnaacatcctaatcgaaaaacgcccaggcagactccaacatagcagagaagccatggccggtccgccgctcttgagcttccccttcttcttccttctctgcgtcgccctcgcctggagcgaggcgtatggagcaagcggtggctacgggctcggcgtcaactacggccgggtggcggacgacatcccttcgccgtggcgctccgtggagctgctccgcgcgncggtggccgggtcggtcaagatctacgacgtcaacccgggcgtgctccgcgcgctggctgggacgcgctggnccgtctccatcatggtgccaancaaatcataccggacctcgncccctctgctgccgcgnnggaccggtggggtcgcaagaaactggcccttactaccggggaacctggtcaaggtcctttcccgggggaacgaaatcctctccaattgtggcatgggaaatccccctgcccaaccttgtcccgggggtgggaaaactcccccggaccctcccgaagggggcaatcaaccggctaaaagcggccccccctttcctggggggtttttccccgaagggcttttccccgcccaccgggggggccggggttccggcgaaatttaaaaaaaagagggggccccgcgtttttttttttggagagaa

SEQ ID NO: 27231 - protein, 186 aa, Zea mays
  misc_feature: Ceres CLONE 1400421-F
  misc_feature: SWISSPROT Homolog: EC 3.2.1.39 Glucan endo-1,3-beta-D-glucosidase
  misc_feature (57)..(57): Xaa is any aa, unknown, or other
  misc_feature (81)..(81): Xaa is any aa, unknown, or other
  misc_feature (88)..(88): Xaa is any aa, unknown, or other
  misc_feature (95)..(95): Xaa is any aa, unknown, or other
  misc_feature (101)..(101): Xaa is any aa, unknown, or other
MAGPPLLSFPFFFLLCVALAWSEAYGASGGYGLGVNYGRVADDIPSPWRSVELLRAXVAGSVKIYDVNPGVLRALAGTRWXVSIMVPXKSYRTSXPLLPRXTGGVARNWPLLPGNLVKVLSRGNEILSNCGMGNPPAQPCPGGGKTPPDPPEGGNQPAKSGPPFPGGFFPEGLFPAHRGGRGSGEI

SEQ ID NO: 27232 - DNA, 741 bp, Zea mays
  misc_feature: Ceres CLONE 1400423-F
  misc_feature: Encodes the peptide sequence at SEQ ID NO. 27233
  misc_feature (389)..(389): n is a, c, t, g, unknown, or other
  misc_feature (601)..(601): n is a, c, t, g, unknown, or other
  misc_feature (602)..(602): n is a, c, t, g, unknown, or other
  misc_feature (605)..(605): n is a, c, t, g, unknown, or other
  misc_feature (606)..(606): n is a, c, t, g, unknown, or other
  misc_feature (609)..(609): n is a, c, t, g, unknown, or other
  misc_feature (614)..(614): n is a, c, t, g, unknown, or other
ggagctccccgcggtggcggccgctctagaactagtggatcccccgggctgcaggaattcgcacgagaccattacctagaacatcctaatcgaaaaatgtgatgtgagcctggcagcctgctgcctgcccgcgtccccgggactagttcagttgcttcactgtggcggtggcctggccctgcgtgccgcgtgcgcgctgcagcagtgcggtagcgggcagatggccgactccacggccatgaccgtcgacttcctccgtgcgcggctgctctccgagcggtccgtctcccgcgccgccaaggagcgtgcggacgagctcgccaagagggtcgcggagctggaggagcaggtccggccggtgacggcgcaaaggcggcaggggaagtggncgacccgcgaggtgctcgcagttctgaggcccaaggctttgggcgacattctctcggatggggccgacgactccgacggctctgaagtccagaacgcgaaggaggaggaccgcaaaagtccgggcgaaccggtcggtgccccccgtgaagatatggtaaaaaaggaccctcccgtatcccacgggggagtgggttgatagcggtaccttggnnccnnggnccgcnccgggggcgttttggtgcaacccccccggagaccccgccgcttggcccgccgctcttctccgccgctgctagcgccggtctcttaaagtttgggcgcctccccacaccatccctcggtgccatgtgg

SEQ ID NO: 27233 - protein, 121 aa, Zea mays
  misc_feature: Ceres CLONE 1400423-F
  misc_feature (57)..(57): Xaa is any aa, unknown, or other
MADSTAMTVDFLRARLLSERSVSRAAKERADELAKRVAELEEQVRPVTAQRRQGKWXTREVLAVLRPKALGDILSDGADDSDGSEVQNAKEEDRKSPGEPVGAPREDMVKKDPPVSHGGVG

SEQ ID NO: 27234 - DNA, 662 bp, Zea mays
  misc_feature: Ceres CLONE 1400424-F
  misc_feature: Encodes the peptide sequence at SEQ ID NO. 27235
  misc_feature (565)..(565): n is a, c, t, g, unknown, or other
  misc_feature (662)..(662): n is a, c, t, g, unknown, or other
tcaccgcggtggcggccgctctagaactagtggatcccccgggctgcaggaattcgcacgagaccattacctagaacatcctaatcgaaaaatcgagacaaaatatctaccggggatgtggtggtggatgctcgggcattcgtcaaaccactcatcatcccatcccatcccatccaagggaatccgatcaatcccggactcgtcctcccggccaaccctagcttcccttctcttcccctcccccgatggacccgccgccaaccagggacagaggggaggagctggagcctgaaacccgcgccttccccgacgccgacgacccggagacctcccgatctgaacgcgaagagggtatccctccaccgccaccgccaccgcctctgcgccagcagctcatgggggcttgccgcgccgacgagcgcctcaggccgctcctcaccctcaacgtctcctgcggcgcagcggacgaccgactcatcgcacacctcgcgcagcacttcgaggtgtcggaggtgggcatgctcgcgcgttgcctctgtgttcccctcgtttccctgcgcgttgncaaggttcagagggaaggggccctcctctgcccaacacacattagagggaagctgaaccttgttcttctgccatcatctagcatgcggcttaccttn

SEQ ID NO: 27235 - protein, 138 aa, Zea mays
  misc_feature: Ceres CLONE 1400424-F
  misc_feature (107)..(107): Xaa is any aa, unknown, or other
MDPPPTRDRGEELEPETRAFPDADDPETSRSEREEGIPPPPPPPPLRQQLMGACRADERLRPLLTLNVSCGAADDRLIAHLAQHFEVSEVGMLARCLCVPLVSLRVXKVQREGALLCPTHIRGKLNLVLLPSSSMRLT

SEQ ID NO: 27236 - DNA, 674 bp, Zea mays
  misc_feature: Ceres CLONE 1400425-F
  misc_feature: Encodes the peptide sequence at SEQ ID NO. 27237
aaagctggagctccccgcggtggcggccgctctagaactagtggatcccccgggctgcaggaattcgcacgagaccattacctagaacatcctaatcgaaaaatcacacatattattgagaccaactagcaacatagaaagcacaatagtgtaccaacaatggcagccaaaatattttgcctccttatgctccttggtctttctgcaagtgctgctacggcgaccattttcccacaatgctcacaagctcctatagcttcccttcttccctcgtacctctcaccagcggtgtcttcggtatgtgaaaacccaattcttcaaccctacaggatccaacaggcaattgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacatcagtttcttccattcaccaactagctgcattgaactctgcttctttattgcaaaacaacaactaccattcagccagctatctgctgcctaccccagcaatttcttccattcaccaactgacagcattgaactctcctgcttattacagcagcaacaactactacattcagccg

SEQ ID NO: 27237 - protein, 121 aa, Zea mays
  misc_feature: Ceres CLONE 1400425-F
MAAKIFCLLMLLGLSASAATATIFPQCSQAPIASLLPSYLSPAVSSVCENPILQPYRIQQAIAAGILPLSPLFLQQSSALLQQLPLVHLLAQNIRAQQLQQLVLANLAAYSQQHQFLPFTN

SEQ ID NO: 27238 - DNA, 603 bp, Zea mays
  misc_feature: Ceres CLONE 1400427-F
  misc_feature (217)..(217): n is a, c, t, g, unknown, or other
  misc_feature (386)..(386): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (506)..(506): n is a, c, t, g, unknown, or other
  misc_feature (507)..(507): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (538)..(538): n is a, c, t, g, unknown, or other
  misc_feature (540)..(540): n is a, c, t, g, unknown, or other
  misc_feature (541)..(541): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (549)..(549): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (581)..(581): n is a, c, t, g, unknown, or other
  misc_feature (595)..(595): n is a, c, t, g, unknown, or other
atagctggagctccccgcggtggcggccgctctagaactagtggatcccccgggctgcaggaattcgcacgagaccattacctagaacatcctaatcgaaaaaagcaaattgcatttcaagtcttttgggtttatacaggacagataaaggcggcagcggcagcagcagagcagcctaccttttcccctctccacctcccgcaagcaaactcacggntcacggtcaccgtcccccgcacccactgccctctaggttcttcctccccgctttcatggcaggaaaggctgaggcgatgatgcccataggccatccagtttgatccatgccatcctgaacctctatacatactgccccagcccgggaactcgcgatctctacttgctcntaaccgacgatgtggcctgggctaggctcctcctctccgggatccagggtttctgggtttttggccccccaacacaagagcggggggnnnnnnnnnnnnnnnnnnnnnnnnnnnnngccnnccnnnnnnncnnnnnnnnnnnnnnannnccncnnannnnacncccnnnccagaaaaacaccacaaggaacccanccgaaaacacgcanaacacttt

SEQ ID NO: 27239 - DNA, 699 bp, Zea mays
  misc_feature: Ceres CLONE 1400430-F
  misc_feature: Encodes the peptide sequence at SEQ ID NO. 27240
aaagctggagctccccgcggtggcggccgctctagaactagtggatcccccgggctgcaggaattcgcacgagaccattacctagaacatcctaatcgaaaaaaaaagtcagatccgtgttccgtgtccgcgtccagtgtgtccgctactccgctccccctcagtcctcagttcctcacctagcggtagcgtgcgcgcgggagacgtagatggcggcttcggaggcggcagcggcggcggcaacaccggagacgccgacagaggggacggtgatcgcgatccacagcctggaggagtggagcatccagatcgacgaggccaacagcgccaagaagctggtggtgattgacttcactgcaacatggtgtcctccgtgccgcgccatgcctccaatttttgctgatatggacaagaagcccccaaatggtgtttttctgaaagttgatgtggatgaaatgaagaccattgctgaagcattcagcgtagaggtcatgccaacattcctcggtcttgagggagggcgaccgtcaaggacgggtcgtttggcgcactaaagcgaaaaactaaccagggaattttgaactacccctggccccccaaaaaaaggggagggcccaaagggaatattcccccaaaaaaaaaggaacccctctcccctcacttttgaaaaaaataagggctttcgggggaggggaaatt

SEQ ID NO: 27240 - protein, 114 aa, Zea mays
  misc_feature: Ceres CLONE 1400430-F
  misc_feature (21)..(114): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MAASEAAAAAATPETPTEGTVIAIHSLEEWSIQIDEANSAKKLVVIDFTATWCPPCRAMPPIFADMDKKPPNGVFLKVDVDEMKTIAEAFSVEVMPTFLGLEGGRPSRTGRLAH

SEQ ID NO: 27241 - DNA, 740 bp, Zea mays
  misc_feature: Ceres CLONE 1400432-F
  misc_feature (52)..(52): n is a, c, t, g, unknown, or other
  misc_feature (97)..(97): n is a, c, t, g, unknown, or other
  misc_feature (254)..(254): n is a, c, t, g, unknown, or other
  misc_feature (482)..(482): n is a, c, t, g, unknown, or other
  misc_feature (484)..(484): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (732)..(732): n is a, c, t, g, unknown, or other
  misc_feature (734)..(734): n is a, c, t, g, unknown, or other
  misc_feature (737)..(737): n is a, c, t, g, unknown, or other
  misc_feature (739)..(739): n is a, c, t, g, unknown, or other
  misc_feature (740)..(740): n is a, c, t, g, unknown, or other
aaagctggagctcaccgcggtggcggccgctctagaactagtggatcccccngggctgcaggaattcgcacgagaccattacctagaacatcctaantcgaaaaacttactggtcctcactcccacaccaaccaaccaacctcctctgcctgccgcttctccctgctgcgggcggtcacggctgcaaggtactagaggaggacatccgcttccattactgggcgcctgcgaggatcggaggaaccagtagcggnagggcttcgcaattttcggcgggcgcaataaatttcccgcatgggggttcgggaggggcgcggtcctcgctcgtctcccgctggcgtccctggggagggggccctggccgggggggccgcccgctgccccctcccgcgctgggggaagaaagggggcccgccaaaggggaatgcccaccccccctgccaagggtgccttttacaaggtccacaactggagcacacacncncgaaaggaaccattctcgcccgccccggacctgggaaataacaaaaaacccccctcataaagggaaaaatcttctttgatattccgctcccggccgaaaattccacaaactctggaccctaggtacccggggaaaagggaactcttcttattggatttccccctccccccannnnnnnnnnnnnnnnnnnnnnannntnnnnnnnnnnnnnnnnnntnnnnnnnnnnnnnnnnnnnnnnnnnnnnncntnccntnn

SEQ ID NO: 27242 - DNA, 693 bp, Zea mays
  misc_feature: Ceres CLONE 1400436-F
  misc_feature: Encodes the peptide sequence at SEQ ID NO. 27243
aagctggagctcaccgcggtggcggccgctctagaactagtggatcccccgggctgcaggaattcgcacgagaccattacctagaacatcctaatcgaaaagaccctcgcttcacttgtcacggactcgcgtccacaaaccacaaccagctcactcaagaacaaaaaacccaacccatggcttctcccaagccgctcctcctgctcgccacctcgttcctgagctgcggactcctggtggccaccgactactccccaatgaccctgaccgcggtgaacaactgcccctacccggggtgaccgggcatccaaggcaactccgggcacgacgtcctggagggcggcggcttcttcctcccgccgatctcccacaagtccttcccggagccggaccaaccctggtccgaccgcaactgggcgcacacgggatgcgcgggcgccggcgcgcaactccactgcgccacggtcgactgcaactccacatgtccagtgcggagaggtccgaggtgctgagcccgaggaccaggaggatgtgaacctccaccgcggaaaagaccaaacactcacaagagagggagctgaatagcacggtttcaaatgtggaagctgttctgtgaaccaagcaaagaaggcccgcagacaacatgacccgtacctcgaactggaacgaactagaccacaaccgaagaccttg

SEQ ID NO: 27243 - protein, 40 aa, Zea mays
  misc_feature: Ceres CLONE 1400436-F
MASPKPLLLLATSFLSCGLLVATDYSPMTLTAVNNCPYPG

SEQ ID NO: 27244 - DNA, 766 bp, Zea mays
  misc_feature: Ceres CLONE 1400437-F
  misc_feature: Encodes the peptide sequence at SEQ ID NO. 27245
  misc_feature (354)..(354): n is a, c, t, g, unknown, or other
  misc_feature (397)..(397): n is a, c, t, g, unknown, or other
  misc_feature (400)..(400): n is a, c, t, g, unknown, or other
  misc_feature (466)..(466): n is a, c, t, g, unknown, or other
  misc_feature (467)..(467): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (487)..(487): n is a, c, t, g, unknown, or other
  misc_feature (489)..(489): n is a, c, t, g, unknown, or other
  misc_feature (580)..(580): n is a, c, t, g, unknown, or other
  misc_feature (589)..(589): n is a, c, t, g, unknown, or other
aaagctggagctccccgcggtggcggccgctctagaactagtggatcccccgggctgcaggaattcgcacgagaccattacctagaacatcctaatcgaaaaacaatccacccgcgtcggcacgagcacccacagcagttggcgcgcaccaaaaccctaccctccctctgctctcagccgccaacgccatgggctccaccgccgctgcctccgtgctcccggtgtccgccggctccggcgagaacctcgtcctcatcctcgactacggctcgcagtacacgcacctcatcacccgccgcgtgcgccagctcggcgtcctctccctctgcgtgtccggcacggcgccgctcgccntccctggagggcctccgcccacgcgccgtcatccctcttcggnggnccccactcagtccacgccccccggggcgcccgcctttccccgaagggattcctggggctttccggnnctgccgcgnnncgcgcacgntngctcggcgtctggctaatgggatgcaagctcctcgtgcagttcctccgaaaggcgcccgtttgggtccgggggagccgccaggagtacggnaaaaatggnaagtttgaggggaacgggggcttcctccggggttctacggggaagcgggaaaccggaaaggccaaaaaggtggtgatgacccttggccaaccaaggtggttagtttgccgaaaagggtttccaagggtggttgtcccaaggtgaagggaaccgtccccccctttaaaaccgggaaaa

SEQ ID NO: 27245 - protein, 105 aa, Zea mays
  misc_feature: Ceres CLONE 1400437-F
  misc_feature: SWISSPROT Homolog: EC 6.3.5.2 GMP synthase (glutamine-hydrolyzing)
  misc_feature (56)..(56): Xaa is any aa, unknown, or other
  misc_feature (70)..(70): Xaa is any aa, unknown, or other
  misc_feature (71)..(71): Xaa is any aa, unknown, or other
  misc_feature (93)..(93): Xaa is any aa, unknown, or other
  misc_feature (97)..(97): Xaa is any aa, unknown, or other
  misc_feature (100)..(100): Xaa is any aa, unknown, or other
  misc_feature (101)..(101): Xaa is any aa, unknown, or other
MGSTAAASVLPVSAGSGENLVLILDYGSQYTHLITRRVRQLGVLSLCVSGTAPLAXPGGPPPTRRHPSSXXPTQSTPPGAPAFPRRDSWGFPXLPRXAHXXSASG

SEQ ID NO: 27246 - DNA, 631 bp, Zea mays
  misc_feature: Ceres CLONE 1400440-F
  misc_feature: Encodes the peptide sequence at SEQ ID NO. 27247
  misc_feature (550)..(550): n is a, c, t, g, unknown, or other
tccccgcggtggcggccgctctagaactagtggatcccccgggctgcaggaattcgcacgagaccattacctagaacatcctaatcgaaaaacggcccaccccgatctcataatcgtcgtcttctcccacttcgacgcggctagggccggcgctaccatctcctcttctcttccggcggcttctccgtcccgtcgatcaaccgcgccgccttcgccagtataccccgcattgagccgtcatcgttacctgcgccgaccggcacctctgtagcctcttctccaggggttgcacgaggaggaggaggttcgggcttcgccatgtcgaagtcgaacctagatgatttgcttctgcaggcagccggccggacggggaagaaccactcccggccgagcaacccgcggtggaactctgggggaagcggctccgacggcttcgacgacgacgactcggacgccgcgccgacctactcgaggaagaagccttcgtcgcaggttccgctcaagaagcggcaccagccagagcagggcggccggcgtggcagtggcgggntggaaggacgaggacgacgaggacgaaacggggcgtcgcagtgggcggggaggactcggacaggccctttcccggggggga

SEQ ID NO: 27247 - protein, 104 aa, Zea mays
  misc_feature: Ceres CLONE 1400440-F
  misc_feature (78)..(78): Xaa is any aa, unknown, or other
MSKSNLDDLLLQAAGRTGKNHSRPSNPRWNSGGSGSDGFDDDDSDAAPTYSRKKPSSQVPLKKRHQPEQGGRRGSGGXEGRGRRGRNGASQWAGRTRTGPFPGG

SEQ ID NO: 27248 - DNA, 725 bp, Zea mays
  misc_feature: Ceres CLONE 1400442-F
  misc_feature (351)..(351): n is a, c, t, g, unknown, or other
  misc_feature (395)..(395): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (417)..(417): n is a, c, t, g, unknown, or other
  misc_feature (425)..(425): n is a, c, t, g, unknown, or other
  misc_feature (426)..(426): n is a, c, t, g, unknown, or other
  misc_feature (432)..(432): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (479)..(479): n is a, c, t, g, unknown, or other
  misc_feature (484)..(484): n is a, c, t, g, unknown, or other
  misc_feature (490)..(490): n is a, c, t, g, unknown, or other
  misc_feature (491)..(491): n is a, c, t, g, unknown, or other
  misc_feature (513)..(513): n is a, c, t, g, unknown, or other
  misc_feature (527)..(527): n is a, c, t, g, unknown, or other
  misc_feature (528)..(528): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (569)..(569): n is a, c, t, g, unknown, or other
  misc_feature (570)..(570): n is a, c, t, g, unknown, or other
  misc_feature (582)..(582): n is a, c, t, g, unknown, or other
  misc_feature (583)..(583): n is a, c, t, g, unknown, or other
  misc_feature (590)..(590): n is a, c, t, g, unknown, or other
  misc_feature (710)..(710): n is a, c, t, g, unknown, or other
aaagctggagctcaccgcggtggcggccgctctagactagtggatcccccgggctgcaggaattcgcacgagaccattacctagaacatcctaatcgaaaaaacggcgccggtctctctctctctctcgcacgagccgcgccggcgccgccaccacgcgcgcgggagacagagaccacagccgcagccaccggcgggcggaataggaatggtggcgccgcgctgaggactgctagaatatcaccaacggtagggggccagacagggccccggtctcgaggatcccaagttctagagtgctggaggatagggacagaccgcgaaatggtgattggcgcgcaagaggcagcgnggcatgtttgccgcggggggagcggctgctgggtctaggaagtnctcctgtggtgtttcccnnngntgcgcccnntgcggngccgtctctcccgccgcccgcggcgtccnnnngccccgcgcgcgcgnccccngccggnntggcccgtcctttttgggcccncgccctcgtcccgnnctcgcccgttcctgttttcgaccannnnncgccttcgcggnncccatggcttcnnaatgatnggtcgtattatacgtgcactacagtaccaactcacacgcattaatgatggttttgttctgcgacccctcaaaatatggtcataatgcgggacagcgtgcacttcagtaataatcaacccngaagcaacgcatggg

SEQ ID NO: 27249 - DNA, 787 bp, Zea mays
  misc_feature: Ceres CLONE 1400443-F
  misc_feature (236)..(236): n is a, c, t, g, unknown, or other
  misc_feature (658)..(658): n is a, c, t, g, unknown, or other
aaagctggagctcaccgcggtggcggccgctctagaactagtggatcccccgggctgcaggaattcgcacgagaccattacctagaacatcctaatcgaaaaatagtaccattcactaatccaagacaaaacatggctgtgaatgtgagaaccatgtggtcgtcgatgcgggcacaggttgcgatggttgtggcgttgctgttcttgctgcgcggttcgtggtgcgcgcctctctngcgtccccccggcaagacccctcccggcctcttatggtttctactggctcgctctctaccgcccccctgttctgtttattcttacgcccgcccgcgccgccgcgctaccccgcgcctcccggctttcttctttgtttttttgttcctcccccccccctctttttttctgtctcgccctgcccccaaatttggcccaccccctcaacgcccgcccccgcttattgtctttaccccccctccctccccctggagccgtctgccctcctctcccccgatcgcgctccggtgccgactccttttctgttctgttgctccctccccgcgcttcccgagtacttccactccctctcatactttcgccctttttctccctccgcgttcctgcccactcttcgtcctttttttttcctcccccctcttcncgccccccccgccccccttcttccttcccctcttctcgcgtcctccccccctctgtggtgttccgccccactccccggcgcagtgcgaccctctgcggtatgcaacttgccgtttccgctctcttgtcg

SEQ ID NO: 27250 - DNA, 646 bp, Zea mays
  misc_feature: Ceres CLONE 1400444-F
  misc_feature: Translation starting site: 279
  misc_feature (379)..(379): n is a, c, t, g, unknown, or other
  misc_feature (397)..(397): n is a, c, t, g, unknown, or other
  misc_feature (406)..(406): n is a, c, t, g, unknown, or other
aaagctggagctccccgcggtggcggccgctctagaactagtggatcccccgggctgcaggaattcgcacgagaccattacctagaacatcctaatcgaaaaatgcacactcactcactccagtgcccactgcccactgcccactgcccgacgaggaagtttcacgatcccaacccgtataaatcgacgccgcgagggggagcgacgagcgatccccgtaattaacctgtcccagccgcaccgatccaccccccctcggtctcggcctccctccggccatggaggtgttctactacgtcgtgttcggcgcgctggccgccgtcgtggcggggctcgagctcggcaagagcggcaagggacgcgtcgccaccaccgtcgnagtgcagctccttcaagncaactacgntctcgtctactccctcatgatgtccggggactggctgcagggccccctacgtctactacctctacagccagtatggctccgacaagggcgaaatccggcggcctctcatcggcgggtttcgatccctcatggtcttccgcaacatcgtcgggctccctcgccaaaaaacaagggccgcaagaagggcctgcggccccctatttgaattaggttaaattccctcagttgtataacccaaaa

SEQ ID NO: 27251 - DNA, 731 bp, Zea mays
  misc_feature: Ceres CLONE 1400445-F
  misc_feature: Encodes the peptide sequence at SEQ ID NO. 27252
  misc_feature (362)..(362): n is a, c, t, g, unknown, or other
  misc_feature (363)..(363): n is a, c, t, g, unknown, or other
  misc_feature (465)..(465): n is a, c, t, g, unknown, or other
  misc_feature (481)..(481): n is a, c, t, g, unknown, or other
  misc_feature (488)..(488): n is a, c, t, g, unknown, or other
  misc_feature (516)..(516): n is a, c, t, g, unknown, or other
  misc_feature (525)..(525): n is a, c, t, g, unknown, or other
  misc_feature (539)..(539): n is a, c, t, g, unknown, or other
  misc_feature (548)..(548): n is a, c, t, g, unknown, or other
  misc_feature (613)..(613): n is a, c, t, g, unknown, or other
  misc_feature (655)..(655): n is a, c, t, g, unknown, or other
  misc_feature (656)..(656): n is a, c, t, g, unknown, or other
aaagctggagctcaccgcggtggcggccgctctataactagtggatcccccgggctgcaggaattcgcacgagaccattacctagaacatcctaatcgaaaacttctgccattccgccgaacaccttccccaatcgtgcgcctccggccatgggggaagcctccgacgcggcggtagccgtatctgcgcggctcctggagctggcggccgaagacgactctgcagcgctcggtgacctccttgcggcacacccgtcgcttgctgacgagcccgcgccgtggtactccccggtgcgcggcgcggagcctatgaccccgctcatggtcgcggtggcgtacggccccgtgcgctgcctcgatgtnnaaatctctctgccccgtcagatgggatccgaccgcgcctcgtcgtttttgcccccccctcgcgcataactcttgaatcgggcgcgggcgcccccgctgcacntcccgcacccgccggncgcctancccctgggccccgacccccccttggggnagggtcttntcgggccgacgccncgggcgcgnagcacgccccggcacacgccgcacccgcctcgtgccggtcctactatactcatcttgttgtgcgnccgcgcgctgacgcccgcaccccccccccccccgcctttttnncggaccgcccggcttttcccccgacttcctgtgtctctctcctcacgggtcagagtgtttctttggtacgatgtc

SEQ ID NO: 27252 - protein, 93 aa, Zea mays
  misc_feature: Ceres CLONE 1400445-F
  misc_feature (72)..(72): Xaa is any aa, unknown, or other
MGEASDAAVAVSARLLELAAEDDSAALGDLLAAHPSLADEPAPWYSPVRGAEPMTPLMVAVAYGPVRCLDVXISLPRQMGSDRASSFLPPPRA

SEQ ID NO: 27253 - DNA, 695 bp, Zea mays
  misc_feature: Ceres CLONE 1400446-F
  misc_feature: Translation starting site: 314
  misc_feature: Pfam Name: H_PPase Pfam Description: Inorganic H+ pyrophosphatase
  misc_feature: SWISSPROT Homolog: EC 3.6.1.1 Inorganic diphosphatase
aaaactggagctccccgcggtggcggccgctctagaactagtggatcccccgggctgcaggaattcgcacgagaccatttacctagaacatcctaatcgaaaaaactaccagcgcagtcactcgcctctgcacacgtcgctgatgctcgtcttccttccttcccatcctttataaggcccggccgcggctctgctcgcctctcctccctttccctcccgtaccgtatcagtctcccggattctctccggttcgtgggagggccaaagcttcgagttaggaaaaccctaccgcttgtgggagtagcctccggcgatggcttgcggcggcgatccttgccggagcttggcgacgcaggtgctcatcccggtcgcggcggccgtgggcatcgcgttcgcggtggtgcagtgggtgctggtctccaaggtgcgggtcacccccgagcgccgcgcggacggcggggccgtgaagagcgggcccagcgactacctcatcgaggaggaggagggactcaacgaccacaacgtcgtcgtcaagtgcgccgagatccagaccgccttctctgaaggagctacattctttccttttcactgagtacaagtatgttggattattcatgggcatctttgcaatccttatattcctctttccttgggtctgtcgagggattcagcacgaagagtcaaccttgccacta

SEQ ID NO: 27254 - DNA, 659 bp, Zea mays
  misc_feature: Ceres CLONE 1400449-F
  misc_feature: Encodes the peptide sequence at SEQ ID NO. 27255
  misc_feature (659)..(659): n is a, c, t, g, unknown, or other
tggagctccccgcggtggcggccgctctagaactagtggatcccccgggctgcaggaattcgcacgagaccattacctaaaacatcctaatcgaaaagagtgctctctccgtcctgagtcttggcatcggacggtaagggaaaaaaaacttaactggccatacgatgatgaggccggctcgtggttatgttagtctgtcgtcccttcgctcgcgcaatggacctgtgtacctgtaacccactccgggtcgagttaagccccaaggtactaggcaggaaaccctaccgcggtgccgaggaccctccgcgaaggcctgcggccccgatcctgccggagctggcgacgcaggagctcatcccggtcgcgggggccgtgggcatcgcgttcgcggtgtcgcagtgggtgctggcctccaaggagcggggcacccccgagcgccgcgaggacggcggggccgtgaagagcggtcccagcgactacctcatcgaggaggaggagggactcaacgaccacaacgtcgtcgtcaagtgcgccgagatccagaccgccatctctgaaggagctacatctttccttttcactgagtacaagtatgttggattattcatgggcatctttgcaatccttatattcctcttccttgggtctgtcgagggatn

SEQ ID NO: 27255 - protein, 147 aa, Zea mays
  misc_feature: Ceres CLONE 1400449-F
  misc_feature: SWISSPROT Homolog: EC 3.6.1.1 Inorganic diphosphatase
MDLCTCNPLRVELSPKVLGRKPYRGAEDPPRRPAAPILPELATQELIPVAGAVGIAFAVSQWVLASKERGTPERREDGGAVKSGPSDYLIEEEEGLNDHNVVVKCAEIQTAISEGATSFLFTEYKYVGLFMGIFAILIFLFLGSVEG

SEQ ID NO: 27256 - DNA, 675 bp, Zea mays
  misc_feature: Ceres CLONE 1400450-F
  misc_feature (480)..(480): n is a, c, t, g, unknown, or other
aagctggagctccccgcggtggcggccgctctagaactagtggatcccccgggctgcaggaattcgcacgagaccattacctagaacatcctaatcgaaaaatcgaagggtcgacaatggttacaacaatcggtagtccatagcagcggcgggcgcaacttcgacccggttttcttcccatatatctgtcaaatccttctccggttgccctccatcggcagaagtttccgccatagataccggcgatcgagggcctcggacaacccaatcgacggagcatcgcgtcgccaggagagtgcaaacccttttcttctcagaactctacttgtctgcgcctggatccactccgcaggactatagacatgtgtcaagcactcggcttgatgcaagtggatcactcgacactagccatcgatgaaacttttgggaacgttgacgaggtcctatagcctgcatgccacttcttgccatggcgcatangcaaggaaactgctgcgtatctgtcactgcgtgtgcagcatcttgatgtccgctgggaacaaagaccaaggataatgtctccgtccatgttgtggcatcagtgacatatcgagacccttgcgataaaggatccgatggatttcacaggataatacccccagtgagggaacccagtattatgttttttgatgcatg

SEQ ID NO: 27257 - DNA, 660 bp, Zea mays
  misc_feature: Ceres CLONE 1400452-R
  misc_feature: Pfam Name: GMP_synt_C Pfam Description: GMP synthase C terminal domain
  misc_feature: SWISSPROT Homolog: EC 6.3.5.2 GMP synthase (glutamine-hydrolyzing)
acaattgggtaccgggccccccctcgaggtcgacggtatcgatattttttttttttttttttgactacaaggcttagctactggtggttacactttacaatccatgcaatgcaatccttgtattaagtaacaaacaattcatgataaacctaatgtattgactgacgaatggtctgcttgctatttgtgacaaccatgcaacgtgttgagagcagcgacatgacatagcgggttttaacccaagacagacagaccagaccatagggtccctcccatcctcctactcccactccaccgttgcaggcggcttagatgtgatgtcctggcaaacgcggttgatgccacgcacattgttgcaaatcttgtttaccacatctaccaggaatgcatgctcaaaatagtaccaatctgcagtcatgccatcctcactggtgattgcccttaaaacaacggcattggagtgggttcgctggtcaccctgaactccaactgtctgtactggcaagaacacagcaaaagcttgccaaattttatcatacaggcctgcgtctttaataaactgaacaatatctccgcccacctgacgaaaaacccccaaagcattgccctgtggaacatcccctaagaaaccgtctgcaaaaaccaggccaagaaaaaggg

SEQ ID NO: 27258 - DNA, 714 bp, Zea mays
  misc_feature: Ceres CLONE 1400453-F
  misc_feature: Encodes the peptide sequence at SEQ ID NO. 27259
  misc_feature (623)..(623): n is a, c, t, g, unknown, or other
  misc_feature (648)..(648): n is a, c, t, g, unknown, or other
  misc_feature (696)..(696): n is a, c, t, g, unknown, or other
  misc_feature (697)..(697): n is a, c, t, g, unknown, or other
aaagctggagctccccgcggtggcggccgctctagaactagtggatcccccgggctgcaggaattcgcacgagaccattacctagaacatcctaatcgaaaaacgaaatcaacccaaaccctagcatcccctttgctcgagggagacgaagatggcgccgaagaggaagacgagtggcgacggcgtggtagaatcgccagctgacgagttcgcaaagccggcggacgacacgaagggatcgccagccgagttcgccaaaccggtttaccttgtggcggcgcgcgacgacgacccggcggcctactccgttctggagatcgacgccgctgccggtggcgacgagccgccgcgcatccgcaccgttgccggtctgacgggcttcatctccgagcctggcatgtccttcgtcgcggcgcattcgaagcacggctcctggattgtcggcgtcggcggtgggttaagagcgatcaccatcatcttcgacccgaggacattgaagactttccgcggtccgcagttcaggtaccccaagcgcgaccccgtcctgatctcgcacggcagcgagatatacgctatctcacgccgccccctggtggtgcgcccgatcgactgcgaaccatggntcgaatggctcagcttcaacagggntgtgccctccaaagattgcgggctttgcggtcactggagcatcctgcnncacacacccttcatcct

SEQ ID NO: 27259 - protein, 187 aa, Zea mays
  misc_feature: Ceres CLONE 1400453-F
  misc_feature (158)..(158): Xaa is any aa, unknown, or other
  misc_feature (166)..(166): Xaa is any aa, unknown, or other
  misc_feature (182)..(182): Xaa is any aa, unknown, or other
MAPKRKTSGDGVVESPADEFAKPADDTKGSPAEFAKPVYLVAARDDDPAAYSVLEIDAAAGGDEPPRIRTVAGLTGFISEPGMSFVAAHSKHGSWIVGVGGGLRAITIIFDPRTLKTFRGPQFRYPKRDPVLISHGSEIYAISRRPLVVRPIDCEPWXEWLSFNRXVPSKDCGLCGHWSILXHTPFI

SEQ ID NO: 27260 - DNA, 671 bp, Zea mays
  misc_feature: Ceres CLONE 1400455-F
  misc_feature: Encodes the peptide sequence at SEQ ID NO. 27261
  misc_feature (580)..(580): n is a, c, t, g, unknown, or other
  misc_feature (611)..(611): n is a, c, t, g, unknown, or other
tggagctccccgcggtggcggccgctctagaactagtggatcccccgggctgcaggaattcgcacgagaccattacctagaacatcctaatcgaaaagtcgcatcgcacgccatcagcagctagcgcgctcctcgagcccagcagagaaaggccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgaaaaagggaggccggcggcggcaaggcggcgctggcgcccgaggaggtggtggcgcggatgcccgcggcgcccagcgaccccgccgccgccgcggccatggtggaccgcatgctccgcctgctcgcctcctacgacgtcgtccggtgccagatggaggaccgggacggccggtacgagcgccgctactccgccgcgcccgtctgcaagtggctcacccccaacgaggacggcgtgtccatggccgccctcgcgctcatgaaccaggacnaggtcctcatggagagctggtactatctcanggacgcggtgctggacggcggcatcccgttcaacaagcgtacggggatgacggcgttcga

SEQ ID NO: 27261 - protein, 87 aa, Zea mays
  misc_feature: Ceres CLONE 1400455-F
  misc_feature: SWISSPROT Homolog: EC 2.1.1.68 Caffeate O-methyltransferase
  misc_feature (58)..(58): Xaa is any aa, unknown, or other
  misc_feature (68)..(68): Xaa is any aa, unknown, or other
MVDRMLRLLASYDVVRCQMEDRDGRYERRYSAAPVCKWLTPNEDGVSMAALALMNQDXVLMESWYYLXDAVLDGGIPFNKRTGMTAF

SEQ ID NO: 27262 - DNA, 668 bp, Zea mays
  misc_feature: Ceres CLONE 1400458-F
  misc_feature: Encodes the peptide sequence at SEQ ID NO. 27263
ggagctccccgcggtggcggccgctctagaactagtggatcccccgggctgcaggaattcgcacgagaccattacctagaacatcctaatcgaaaagtacttgaggagtttgggggggagcttctgctctctgtgcagttgcttggcgcggacagagagcattgcctgcacagagcagaactactggtccagatcatggaaggcgaacaggtgtacgtgcactggagagggaatgcggcggacgagaggaggcacggaggcgtcagggcaacgatcttcctctacgttctgttcatgctacgaagctgctgtaacagctcatacttcaccgtggtggcctatttgcacggcacgttgcatctggacattgtgacctcatcaaccgtgataggctacctggatggcaccgtgatgatatctgctgctctgatgaacttcatctctgatgcgtcgtgtatcaagcgagccaccgctatatttgtattcggaccctgcgtgatcctgggttacatgttgctagcactgcaagcccatttccctgcactccatcctgaaacctgtgccatagacgaagagcctaacaactgtgaggcagctcggcgctggaagttgacactgctctgcttgagcctgttcatgtttgctgatgcggaggcgtgcatgctcgc

SEQ ID NO: 27263 - protein, 157 aa, Zea mays
  misc_feature: Ceres CLONE 1400458-F
MEGEQVYVHWRGNAADERRHGGVRATIFLYVLFMLRSCCNSSYFTVVAYLHGTLHLDIVTSSTVIGYLDGTVMISAALMNFISDASCIKRATAIFVFGPCVILGYMLLALQAHFPALHPETCAIDEEPNNCEAARRWKLTLLCLSLFMFADAEACML

SEQ ID NO: 27264 - DNA, 663 bp, Zea mays
  misc_feature: Ceres CLONE 1400459-F
  misc_feature: Encodes the peptide sequence at SEQ ID NO. 27265
tggagctccccgcggtggcggccgctctagaactagtggatcccccgggctgcaggaattcgcacgagaccattacctagaacatcctaatcgaaaaacttccccatcccgcttgctgcgtggcgcgatgtccgaggacggcgcgcttttccgatttgatgcgcccagctggaaaacgaaaatcgctgatgggttttggaaggaaagtcgtcatttcttggggaggtttccgtttctggatcgactgggtgatcgatcgtactagccgccatggcgtcctcgtgcatcccgggcggagggatccggttgccggacctggagatggtcaaggccgcgccgccgccgccgccgccccgcccggtgcactcagcggcgtcctccacgctctcggaggcgtccaactcgtccccagcctcctcgtcgtcgttggcgtcgctgtcgctcaagcgcccgcgcacgccgcggaagcgggccagccagacgtacaacgaggcggcggcgctgctcgcgtccatgtacccctccgtattccccgtcgccagtggctgggggggacccgaggcggagccaccccgtctcctcggcctcggctccgcgcttggcgaggatccgacctgatccgagctcctccctccgttgcccgtgcacggagggcactccgcc

SEQ ID NO: 27265 - protein, 115 aa, Zea mays
  misc_feature: Ceres CLONE 1400459-F
MASSCIPGGGIRLPDLEMVKAAPPPPPPRPVHSAASSTLSEASNSSPASSSSLASLSLKRPRTPRKRASQTYNEAAALLASMYPSVFPVASGWGGPEAEPPRLLGLGSALGEDPT

SEQ ID NO: 27266 - DNA, 661 bp, Zea mays
  misc_feature: Ceres CLONE 1400467-F
tggagctccccgcggtggcggccgctctagaactagtggatcccccgggctgcaggaattcgcacgagaccattacctagaacatcctaatcgaaaaaccattaaaatgtactggtacctagctagcgcgcggtagtcacagtgggtggcactgggcaatggcagtagtcgcagaaagagaggacgactgaggagcagcgatccagcggctgcagctcttcctccctgccctgaagctgaagctgctgagaatagatgccctctccttccctccctccctccctccatctccatgagttgagcaccctgagcagatgaggtgaagtgagttggctgccagcgcgtgctgtatcttgtatggctgtactgtatcccccctcctctcgctaaccctttgtctccttcccccacaaaaccacctccgccccctcctcccaccagtacctgtgagttgtgagctccttgctgcggctgcttgctcccctcatctctagcctgtacactggttggagtggctgccagtgttctccccacctgctcctctcgatccactccttcccctttggacatgggtgtgcaagcatacatctacagcaattgcatgcttctcctgccttgaagcgcaagccttatccttagcctgccgcctgaggagaacctt

SEQ ID NO: 27267 - DNA, 647 bp, Zea mays
  misc_feature: Ceres CLONE 1400470-F
  misc_feature: Encodes the peptide sequence at SEQ ID NO. 27268
  misc_feature (614)..(614): n is a, c, t, g, unknown, or other
  misc_feature (615)..(615): n is a, c, t, g, unknown, or other
tccccgcggtggcggccgctctagaactagtggatcccccgggctgcaggaattcgcacgagaccattacctagaacatcctaatcgaaaagttccgcttcgtcccagcctctagttcttcctttcctccagagtgatggccaaatgctactcagattggcccccgattccgcctttccatccatcgcgaagaacgccgccgcaatcccacgcctccccgatcacgatcaggcggcagctcgcgtccttcgtgctccactgctccagatcctgcgctcccctcctcgagcccaagaacctgcccgatgagttcgaggccgtaccggcgacgccgccgccgccgctgccggacgccgccccgaagctggggatttctaacaagttcatccgaggcctctgcggtgacccgcagaccgagcagctggccttcgagggctacaggagggcgctgctgcagcccgagttccggctggagaaagagacggccaacgcgctgaccctgcagctgatcagggagaagcagtggggctccctggagctgctggtcgaggactcaggggcccacggcgtgctccccgaaaaagcggacgtgcgcgcggctcgcgctgtgatannggggggggggggaggttccggccccccgaggg

SEQ ID NO: 27268 - protein, 170 aa, Zea mays
  misc_feature: Ceres CLONE 1400470-F
  misc_feature (160)..(160): Xaa is any aa, unknown, or other
MAKCYSDWPPIPPFHPSRRTPPQSHASPITIRRQLASFVLHCSRSCAPLLEPKNLPDEFEAVPATPPPPLPDAAPKLGISNKFIRGLCGDPQTEQLAFEGYRRALLQPEFRLEKETANALTLQLIREKQWGSLELLVEDSGAHGVLPEKADVRAARAVIXGGGGGSGPPR

SEQ ID NO: 27269 - DNA, 668 bp, Zea mays
  misc_feature: Ceres CLONE 1400472-F
  misc_feature: Encodes the peptide sequence at SEQ ID NO. 27270
aagctggagctccccgcggtggcggccgctctagaactagtggatcccccgggctgcaggaattcgcacgagaccattacctagaacatcctaatcaaaacatccagagagagacacggaggacctgggtttggttgcgctgcttgactcgctccgtgttccaagcgccttttgagcattcaggcagatataaaattcctctttttacactacaatccccgctgaatcagcagcagcaactctctccctctccgttcttggtggtccgagacccttggccgtacgctctgcctcactcctccgtctcttgcttcccttgccgccggcggcgcgcggcgccgggcgcggatcggcggcgggtgcatggtggaggccgccgccgggcgccagacaggcaccagacgacggcggtctaccggcagcggaggggagcaccggcacctggtcgcgctcgtcgtcgccgcgcgcgtcgccatgctccaccaccggtccgtgagttccagaggagtacgaaaaggtgatgcgaggggaatctgctgtaaccgatgcctgcgcctcctgccggaggcgcacgcttgctggggggacttcttctactgccctcctccgtttgatccgagccctttaggaatgacatgggcttgcggaaaagccccaatgggaaaccg

SEQ ID NO: 27270 - protein, 101 aa, Zea mays
  misc_feature: Ceres CLONE 1400472-F
MVEAAAGRQTGTRRRRSTGSGGEHRHLVALVVAARVAMLHHRSVSSRGVRKGDARGICCNRCLRLLPEAHACWGDFFYCPPPFDPSPLGMTWACGKAPMGN

SEQ ID NO: 27271 - DNA, 651 bp, Zea mays
  misc_feature: Ceres CLONE 1400473-F
  misc_feature: Encodes the peptide sequence at SEQ ID NO. 27272
  misc_feature (402)..(402): n is a, c, t, g, unknown, or other
  misc_feature (419)..(419): n is a, c, t, g, unknown, or other
  misc_feature (620)..(620): n is a, c, t, g, unknown, or other
tccccgcggtggcggccgctctagaactagtggatcccccgggctgcaggaattcgcacgagaccattacctagaacatcttaatcgaaaaaagaattcgcacgcacagagcacttttgctaaatcgctagttcgtttcctaaaccctagcaaagtaggaatggcgtcggcgagcatgctcgcgcgctcccttctccgcaccccagaccctacccaaacgagccacccgaaccgccggagcgccgctgtcgtctccttcccccgccgccaccgccgcctgtccgtgcgcgcctccgtctccacggcctccccttccccaccgccacagcccgcggcggcggctgccggcgtgccgaagcactgcttccggcgcggggccgatggctacctgtactgcgaggnagtgcgggtggagaacncgatgacggctgctgagcgcagccccttctacctctacagcaagccacagatcctccgcaacctcgcccgcttacgcgatgctctccaggggctcgctccatcatcgggtatggccgtgaggccaacaacacctcccgtgctacgcgtcctgcggagctggtttgggggggcgttctcgtcagcggcacgagctcgatcgncctcccaggcggatcgacccgccaggtggaa

SEQ ID NO: 27272 - protein, 163 aa, Zea mays
  misc_feature: Ceres CLONE 1400473-F
  misc_feature: SWISSPROT Homolog: EC 4.1.1.20 Diaminopimelate decarboxylase
  misc_feature (81)..(81): Xaa is any aa, unknown, or other
  misc_feature (87)..(87): Xaa is any aa, unknown, or other
  misc_feature (154)..(154): Xaa is any aa, unknown, or other
MASASMLARSLLRTPDPTQTSHPNRRSAAVVSFPRRHRRLSVRASVSTASPSPPPQPAAAAAGVPKHCFRRGADGYLYCEXVRVENXMTAAERSPFYLYSKPQILRNLARLRDALQGLAPSSGMAVRPTTPPVLRVLRSWFGGAFSSAARARSXSQADRPARW

SEQ ID NO: 27273 - DNA, 660 bp, Zea mays
  misc_feature: Ceres CLONE 1400474-F
  misc_feature: Encodes the peptide sequence at SEQ ID NO. 27274
  misc_feature (401)..(401): n is a, c, t, g, unknown, or other
  misc_feature (405)..(405): n is a, c, t, g, unknown, or other
tccccgcggtggcggccgctctagaactagtggatcccccgggctgcaggaattcgcacgagaccattacctagaacatcctaatcaaaaattaataaaaagtttgctagtgagtcgagaagagagagagaggcgtccggaattcatcgccagcgatgtctccgtccgccgacgcccccggcccggcctcctccgcctcggcgcccccgctcgcgcccctcatcgccgcgcagctcaactacctcctctcgcactccaagctgcccattagggtggtacagatctggtccggctgccgcaacggtcgccctgccgatcggttcaggctcgccatccccttctgcctcgactacgtccactggggatttcgtgtacaatgcgctgtctcccaagggcaccangagnttggtgttcgggtccggagggatgagaggttccagccgctggtcgattacgctgctgctggaaatggcgataagagctgcttggcgccgttgggattgccgcgcccccgagggactccatgcgctcgtacagggagcttcgagaattgtacattgatacaaaaaaagggagcggttcaccatgggtggatgacgcgaggactagcggttgaaactaagcacagtctcttctaaggaggggggattgaaagtctgc

SEQ ID NO: 27274 - protein, 160 aa, Zea mays
  misc_feature: Ceres CLONE 1400474-F
  misc_feature (82)..(82): Xaa is any aa, unknown, or other
  misc_feature (84)..(84): Xaa is any aa, unknown, or other
MSPSADAPGPASSASAPPLAPLIAAQLNYLLSHSKLPIRVVQIWSGCRNGRPADRFRLAIPFCLDYVHWGFRVQCAVSQGHXEXGVRVRRDERFQPLVDYAAAGNGDKSCLAPLGLPRPRGTPCARTGSFENCTLIQKKGAVHHGWMTRGLAVETKHSLF

SEQ ID NO: 27275 - DNA, 502 bp, Zea mays
  misc_feature: Ceres CLONE 1400476-F
  misc_feature (83)..(83): n is a, c, t, g, unknown, or other
  misc_feature (275)..(275): n is a, c, t, g, unknown, or other
  misc_feature (276)..(276): n is a, c, t, g, unknown, or other
  misc_feature (387)..(387): n is a, c, t, g, unknown, or other
tccccgcggtggcggccgctctagaactagtggatcccccgggctgcaggaattcgcacgagaccattacctagaacaacctnaatcgaaaattacctagaaattagggatgctaaacttgttgaagtgaagcatgcacagttagaacatgagatttcttgtcttgatttgaacccaattggagagcatctagagtatagttccctagctgctgttgggatgtggacagatataagtgttagaatattttccacttccagatcttgtattaatanngaagaaatttgggtggagaaattgtccctcggcctgtctgctgtgcacttgaagggggtttcgaattactttttgggggggcccctccccttgggggggggaaaagggggnaaaaattccctggggtttttccaaaaggttttttttttcccgcggcgccttggaaaaaaaagggggggcaaaaaagaacaaacaacggggggggggaaaaaacttttgggaccct

SEQ ID NO: 27276 - DNA, 733 bp, Zea mays
  misc_feature: Ceres CLONE 1400481-F
  misc_feature: Encodes the peptide sequence at SEQ ID NO. 27277
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (22)..(22): n is a, c, t, g, unknown, or other
  misc_feature (45)..(45): n is a, c, t, g, unknown, or other
  misc_feature (46)..(46): n is a, c, t, g, unknown, or other
  misc_feature (60)..(60): n is a, c, t, g, unknown, or other
  misc_feature (61)..(61): n is a, c, t, g, unknown, or other
  misc_feature (63)..(63): n is a, c, t, g, unknown, or other
nnnnnnnnggggnnnnnggggnggaggggagaggaaagggggggnnaaaaagacggcgcnntntaaaagctggagctccccgcggtggcggccgctctagaactagtggatcccccgggctgcaggaattcgcacgagaccattacctagaacatcctaatcaaaaattcgcaatttccctacgagctcgagctcacggctcaccgcagctcaaaagccagcacaggcaaacccccgtcatggcctcctccaagatactgcgcgccgccgtcgtcgtcgtggccgtcgccgtgtcctccttcgccggcgccgccctcgccgccgaggcccccgcgccgagcccggcctccggcgccgcggccgtctcctcgtcggtcttggccgccgccctctgcccggccgtcgcgctcctcctcggaaacctgcgccactgatgacgcctgcctgcctgtccgacgagagccgccgtgtgctgccccgggaggttattggcctccggaagggggggtgagagatcctgacctgagggcgccttgacccgccccccgccgcggggattggcaactctaccgatgcgctcggcaaattcagcggggctcggtttcacgccccccaaattacgtggaggggaaggcggttcgttggccccccccccccacccccgccgggggggggggcacccccccccaccccccacttcctcccccccccagaccggggccacccccccacc

SEQ ID NO: 27277 - protein, 64 aa, Zea mays
  misc_feature: Ceres CLONE 1400481-F
MASSKILRAAVVVVAVAVSSFAGAALAAEAPAPSPASGAAAVSSSVLAAALCPAVALLLGNLRH

SEQ ID NO: 27278 - DNA, 610 bp, Zea mays
  misc_feature: Ceres CLONE 1400505-F
  misc_feature: Encodes the peptide sequence at SEQ ID NO. 27279
  misc_feature (338)..(338): n is a, c, t, g, unknown, or other
  misc_feature (359)..(359): n is a, c, t, g, unknown, or other
  misc_feature (446)..(446): n is a, c, t, g, unknown, or other
tccccgcggtggcggccgctctagaactagtggatcccccgggctgcaggaattcgcacgagaccattacctagaacatcctaatcgaaaagttccataaaccctaacctcgttggattcgcggcaaaaatcctcccaattcggaaccctccgatgttccagctacctgcgggagctgagccgtgctcggtttggcgaaatttcgcacccctcttgtgctaggaccacccggttcaagctgttcctcggaagggtcaggtcttcaccggtgctctccggcgccggatccaggtttgttccggcgagaggtcgggcctcttggtgggggccagcccagncttcgagctcaatttgccggnctgagatgaatcgcgactgcggtgcggtgcctcaggtagtcgcgtcgagcgagcgcgatctgccattttggtggccagctttctggnatctcgggggggctttccgctcctgcgggaaaaagggggggacgggggatgcatcccaggttcgaaacccgccgaccggggggggggggcaacacttcgatggcctgcgggatttccccccgcgggcatcctgaaaaaaggccagggaaatgggggtcccctcg

SEQ ID NO: 27279 - protein, 71 aa, Zea mays
  misc_feature: Ceres CLONE 1400505-F
  misc_feature (28)..(28): Xaa is any aa, unknown, or other
MNRDCGAVPQVVASSERDLPFWWPAFWXLGGAFRSCGKKGGTGDASQVRNPPTGGGGQHFDGLRDFPPRAS

SEQ ID NO: 27280 - DNA, 694 bp, Zea mays
  misc_feature: Ceres CLONE 1400508-F
tggagctccccgcggtggcggccgctctagaactagtggatcccccgggctgcaggaattcgcacgagaccattacctagaacatcctaatcaaaaaacgtgaactcccccgacgactcagtgcgtcttcgccgccgttttcgtcgtcgcagattaaggttcccctcctctaacacgccggcgcttccccccctgccaccgcgacactcagtcgtcgccgccgtcggctctgctgccgtggccaagcgcgttggcagcgaggattgctttagcttgcaaacactttccccacccccaccgccgctgatttcgccgttatgcggtgaagcccttcgcgttgacgggctaatcggctgcctgatttctattatgatgggggtaggtgtgctcctggttcgcgtctcggaggaccctcgccgtttatcgatccagtgatgtggagctcacctttctccggctagcgttgtgtcaaggggagagtggctgttgatccctcggggagctggttgagttgtcttttcgtttgtggggaaatctgtgcggcaggggtaagggtgcgtgaattcggatggcacccgggggggggaatcaaatttgggggacatcagcctccgatggggggaggatttggttcttcggacctttccctaaaaatactcccaaaaacccctcccaccccggttaaatggggggg

SEQ ID NO: 27281 - DNA, 655 bp, Zea mays
  misc_feature: Ceres CLONE 1400509-F
  misc_feature: Translation starting site: 146
  misc_feature (394)..(394): n is a, c, t, g, unknown, or other
  misc_feature (523)..(523): n is a, c, t, g, unknown, or other
  misc_feature (578)..(578): n is a, c, t, g, unknown, or other
tccccgcggtggcggccgctctagaactagtggatcccccgggctgcaggaattcgcacgagaccattacctagaacatcctaatcgaaaaaattcctgtctgtgcgcgcgcgcgcgtggcgccggccgagcggccgttgacccgatgaccggcgcggcggccgtcgatcccccggtgcctcggccgcggcggctcacggtcctcccgctcatcgcgctcatcttctacgacgtctcgggaggccccttcgcatcgaggactcggtccgcacgggcggcggcgcgctgctcccgatccttggcttcatcgtcctcccagtcctctggtcgctcccggaggcgctggtcacggccgagctcgcatcggctttcccaccacggcggggtacggggncctgggtgtccgccgccttcggccccgccgtgcgtttccttcgtcgggttctcccagtgggccgtcgcgggacgctcgacaacggctctaacccgggtgctgttcctcgactcctcccgctcccggggnggggttggcgctgccgcccgcggcccggttcgttgggggtcctcgcgctcagggncggggttcactactcaaattaccgggggctccacatcggtcgcttctcgggggtgggggctcacggggttctcgttc

SEQ ID NO: 27282 - DNA, 661 bp, Zea mays
  misc_feature: Ceres CLONE 1400513-F
  misc_feature (485)..(485): n is a, c, t, g, unknown, or other
  misc_feature (507)..(507): n is a, c, t, g, unknown, or other
  misc_feature (661)..(661): n is a, c, t, g, unknown, or other
tccccgcggtggcggccgctctagaactagtggatcccccgggctgcaggaattcgcacgagaccattacctagaacatcctaatcgaaaagacgcccatgaggggcctgatctaatgtagcgttaggagaaagcctactgttccatctctttcttggagtacgagggcacgaaggcctaaccccctcgcccccaccagattcggggaattcgcgcctcatccgatcgtcaccggccgccgaagcgcaagaaacagcggccgggttaggactctggaggatacggcggctcggcggattcaggaagtgaggatattttcttggatttctgttcttgattgaggagaggatctcgtattagctactgcgttattcactggatgttggcaatggggtcagaagagtgggagctctatccttcttccgacataggttcgcaggtcatagaatacagacctgtgtctgaagacagcgatgacgatcagnaatggggatgtggcagtgtcgnctggatgttgttctccctgatgattttcctggaagaaggttctttccttcttgcctgttgcagtatcattaagaatcctgggtctttttgcaaaaggtggccaatgagattgtgcatggccgggaggcacgcatgggagcaaattagtgcctcn

SEQ ID NO: 27283 - DNA, 623 bp, Zea mays
  misc_feature: Ceres CLONE 1400514-F
  misc_feature: Encodes the peptide sequence at SEQ ID NO. 27284
  misc_feature (386)..(386): n is a, c, t, g, unknown, or other
  misc_feature (411)..(411): n is a, c, t, g, unknown, or other
  misc_feature (544)..(544): n is a, c, t, g, unknown, or other
  misc_feature (593)..(593): n is a, c, t, g, unknown, or other
  misc_feature (597)..(597): n is a, c, t, g, unknown, or other
cgcggtggcggccgctctagaactagtggatcccccgggctgcaggaattcgcacgagaccattacctagaacatcctaatcaaaaccagatccctcttccctctccgctcccccacgtcatctagtcgccgcccccgctcaccgattgtcctctgctgtggagcgagcaagcagcggcgaagcgatggaggaggagatcagaaaggagttccagagtaacggcttctccatcggaggagccggccccgaggacgccgcccagatcctctccacgctgctgacctactgcatcaactacaagatgagccccgcggatctcgtctcaaactgggaggtctactacctcaataggcaattggatggcttaaagctcgaaagctcgtantcttgatgggttttctgtcacaccnttcaaaatgaagttaaagacaggggataataaaagaagaaagcttaacctttcacattttaccccccagggaaacgggagggttggacatgtgtccctttaagcaatttccccctgggggaaaagaagaaaanagaaattttctcttgtgggacccccccccgggttttttttttttttaanaaanagaagaaaaaaagaccccccccctct

SEQ ID NO: 27284 - protein, 68 aa, Zea mays
  misc_feature: Ceres CLONE 1400514-F
  misc_feature (67)..(67): Xaa is any aa, unknown, or other
MEEEIRKEFQSNGFSIGGAGPEDAAQILSTLLTYCINYKMSPADLVSNWEVYYLNRQLDGLKLESSXS

SEQ ID NO: 27285 - DNA, 647 bp, Zea mays
  misc_feature: Ceres CLONE 1400516-F
  misc_feature: Encodes the peptide sequence at SEQ ID NO. 27286
  misc_feature (329)..(329): n is a, c, t, g, unknown, or other
  misc_feature (351)..(351): n is a, c, t, g, unknown, or other
  misc_feature (647)..(647): n is a, c, t, g, unknown, or other
ggagctccccgcggtggcggccgctctagaactagtggatcccccgggctgcaggaattcgcacgagaccattacctgaacatcctaatcgaaaaacgaaatggttttgccttcgcttttgcttatgcgtacgcgcggcgaatcacggcgcccaccttccaaccggacttgagtcacttgactccgccgcgggattccccgccagatctcattctcgccccaaccctaaccgccgacggtggccatgatggccaccgagcccttgtccccggggaatctcgtcgaggacgtcgaaacactacccctggactcctcctcactctcggggntacgacggacccgttgttccgnccacctcccccctcggtcacttttctcccaccggcgtggagaacatggcgcttttctgaacaagaggatgaggacgtgttggatgactccccccctcggtggttcccattgcgttacggccgggaggaaatccccgaaggggtcaccggggtttcctgaaaaacctgcctccaaacctaaaaaaacccgggaccccgaacggaaaccggggggtttttttccgggtgtgggagattattttctcaacctttgccaccagggggccccaaaagaggggttttccccggggtgcccan

SEQ ID NO: 27286 - protein, 134 aa, Zea mays
  misc_feature: Ceres CLONE 1400516-F
  misc_feature (29)..(29): Xaa is any aa, unknown, or other
  misc_feature (36)..(36): Xaa is any aa, unknown, or other
MMATEPLSPGNLVEDVETLPLDSSSLSGXRRTRCSXHLPPRSLFSHRRGEHGAFLNKRMRTCWMTPPLGGSHCVTAGRKSPKGSPGFPEKPASKPKKTRDPERKPGGFFPGVGDYFLNLCHQGAPKEGFSPGCP

SEQ ID NO: 27287 - DNA, 572 bp, Zea mays
  misc_feature: Ceres CLONE 1400518-F
  misc_feature: Encodes the peptide sequence at SEQ ID NO. 27288
  misc_feature (268)..(268): n is a, c, t, g, unknown, or other
  misc_feature (269)..(269): n is a, c, t, g, unknown, or other
  misc_feature (288)..(288): n is a, c, t, g, unknown, or other
  misc_feature (420)..(420): n is a, c, t, g, unknown, or other
  misc_feature (421)..(421): n is a, c, t, g, unknown, or other
  misc_feature (464)..(464): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
gctctagaactagtggatcccccgggctgcaggaattcgcacgagaccattacctagaacatcctaatcgaaaaaagcgtgctagggtttcccccgtcttatcgcttcctcgttcccgcagccgccgcccaaaccctaagcaaacccgtcctccgccatggccgacgaccactactcgtccaagcggaagtacgacgacccctcgccgccgccgcggcgcacggggttctcttctggcccgccgcctgccctcgccgcccgctggcgnngccccgtcgtacaacagcngttgcgccgccccccgatgagatccagctcgcgaagcagcgtgcgcaggagatcgcggcgcggatctttaacgccgcaaaggccaagcgccctcgcgtcgacaacgggggacgatgacgtcggccccccccnngggaggaagttccctgggtgcaaggggtggtgggggggggtgncccgcatcgcccggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27288 - protein, 108 aa, Zea mays
  misc_feature: Ceres CLONE 1400518-F
  misc_feature (38)..(38): Xaa is any aa, unknown, or other
  misc_feature (44)..(44): Xaa is any aa, unknown, or other
  misc_feature (88)..(88): Xaa is any aa, unknown, or other
  misc_feature (103)..(103): Xaa is any aa, unknown, or other
MADDHYSSKRKYDDPSPPPRRTGFSSGPPPALAARWRXPVVQQXLRRPPMRSSSRSSVRRRSRRGSLTPQRPSALASTTGDDDVGPPXGRKFPGCKGWWGGVXRIARG

SEQ ID NO: 27289 - DNA, 625 bp, Zea mays
  misc_feature: Ceres CLONE 1400519-F
  misc_feature: Encodes the peptide sequence at SEQ ID NO. 27290
  misc_feature (492)..(492): n is a, c, t, g, unknown, or other
  misc_feature (514)..(514): n is a, c, t, g, unknown, or other
  misc_feature (534)..(534): n is a, c, t, g, unknown, or other
  misc_feature (592)..(592): n is a, c, t, g, unknown, or other
  misc_feature (593)..(593): n is a, c, t, g, unknown, or other
tccccgcggtggcggccgctctagaactagtggatcccccgggctgcaggaattcgcacgagaccattacctagaacatcctaatcgaaaaaggactcagcgggctccaaagccgacgaggataaagaggagcccggctccgcacgcgggagcgagaggatcgccggcgcaggatgtggtgcgcatcgtgcttggcgtccgcctgcgcgggctgcacctgcaacctctgcacgtcggcggcatcggccgtgtcccgccgctccgcgcgcctcgcttactgcggcctcttcgccgcctcccttatcctctccttcttgctccgccagttcgccgcgccgctcctcaagcatatcctatggataaatgcgtttgatcaaacaccaccagaagaatggtttcaaatgaatgctgttcttcgtgtaagcctggggaaacttcttgtctttgcatattttctctcgtgatgattggtggtgaagacagaatgaccgncgagatgcctggcacatggtgnctggataagcaagatgctgnatggggctgtctcattggtctaatggtcggggggcgaacatgtcatactaattacagnnacttccgaagagttgatctgcttcttctccaa

SEQ ID NO: 27290 - protein, 96 aa, Zea mays
  misc_feature: Ceres CLONE 1400519-F
MWCASCLASACAGCTCNLCTSAASAVSRRSARLAYCGLFAASLILSFLLRQFAAPLLKHILWINAFDQTPPEEWFQMNAVLRVSLGKLLVFAYFLS

SEQ ID NO: 27291 - DNA, 690 bp, Zea mays
  misc_feature: Ceres CLONE 1400520-F
  misc_feature (495)..(495): n is a, c, t, g, unknown, or other
  misc_feature (522)..(522): n is a, c, t, g, unknown, or other
  misc_feature (525)..(525): n is a, c, t, g, unknown, or other
  misc_feature (526)..(526): n is a, c, t, g, unknown, or other
  misc_feature (574)..(574): n is a, c, t, g, unknown, or other
  misc_feature (633)..(633): n is a, c, t, g, unknown, or other
  misc_feature (640)..(640): n is a, c, t, g, unknown, or other
  misc_feature (687)..(687): n is a, c, t, g, unknown, or other
ggagctccccgcggtggcggccgctctagaactagtggatcccccgggctgcaggaattcgcacgagaccattacctagaacatcctaatcgaaaaaaaatttctctcctaccttatcctctgggctgctcaccaccccagtcctctccctcccctcaacctagcgccgccactcgtgcccaccatgccgccgcaccgccgctggtgaacggatccgtgcatcccgtacaccggccttggcctcctcccccctcccctcaacctagctccaccactcgcgcccacctccgtccgccggcggcgcaggggaggagccggccatccttagtgcgccatggcgtggccggtgtggtggaagcccagcctctgcgcgtggcgagcgccgccggcttgcagtgcgccggcggcggcagggactgcctctgcgtggtggggagcgagtgcgcggacacgacgaggcggcggacgccggagcgcaccctgtagaggacgtgnccccagccccaggtgcccctgccgtgncgnncctcgtcctcgttcatcttgaggtcgcccgcgaaccccggcttccagnattagagccagccgacgatgccccgccgccaccactgcctcagggagcgtctcccgcgncgagggnagggccgccggcccggaagcgccggaacgcccactccggcgacccgnagg

SEQ ID NO: 27292 - DNA, 702 bp, Zea mays
  misc_feature: Ceres CLONE 1400522-F
  misc_feature: Encodes the peptide sequence at SEQ ID NO. 27293
  misc_feature (632)..(632): n is a, c, t, g, unknown, or other
  misc_feature (633)..(633): n is a, c, t, g, unknown, or other
  misc_feature (651)..(651): n is a, c, t, g, unknown, or other
  misc_feature (702)..(702): n is a, c, t, g, unknown, or other
aaagctggagctccccgcggtggcggccgctctagaactagtggatcccccgggctgcaggaattcgcacgagaccattacctagaacatcctaatcgaaaaattccgcgccgcatctgggaaggtctcgtcttgctcgcctccgtccgtcgccgcaccctgcgtcgtcgccatggccacgacgcagggtgcggcggcggccggagtgttcgtctcttgctccgccgggaactccggcccatccggatccaccgtctcaaactccgctccgtgggtcgccaccgtcggcgccgggacactggaccgcgacttcccggcatacgtgatgctccccacgggtgcgcgcctggccggcgtgtccctctacgcggggccttctccctccccacgccccgccatgctcccgctcctctacggcagcgggcgtgacaacgccagcaagctctgcctctccgggacgctcgacccggccgccgtgcgcggcaaaatagttgtgtgcgaccgcggcgtcaacgcgcgcgtggagaagggcgccgtcgtgaaggcggccggcggcgccggcatgatactggcgaacacggcagccagcggagaggagctcgtggcggacagccacctggctcccgcggtgnncgtggggcgcgcggtggncgacagatacgggagtaacgcgcgcgcggtgggcgtaggcccatggcgatn

SEQ ID NO: 27293 - protein, 176 aa, Zea mays
  misc_feature: Ceres CLONE 1400522-F
  misc_feature (70)..(167): Pfam Name: PA Pfam Description: PA domain
  misc_feature: SWISSPROT Homolog: EC 3.4.21.25 Cucumisin
  misc_feature (154)..(154): Xaa is any aa, unknown, or other
  misc_feature (160)..(160): Xaa is any aa, unknown, or other
MATTQGAAAAGVFVSCSAGNSGPSGSTVSNSAPWVATVGAGTLDRDFPAYVMLPTGARLAGVSLYAGPSPSPRPAMLPLLYGSGRDNASKLCLSGTLDPAAVRGKIVVCDRGVNARVEKGAVVKAAGGAGMILANTAASGEELVADSHLAPAVXVGRAVXDRYGSNARAVGVGPWR

SEQ ID NO: 27294 - DNA, 784 bp, Zea mays
  misc_feature: Ceres CLONE 1400524-F
  misc_feature: Encodes the peptide sequence at SEQ ID NO. 27295
  misc_feature (755)..(755): n is a, c, t, g, unknown, or other
cgagctggagctccccgcggtggcggccgctctataactagtggatcccccgggctgcaggaattcgcacgagaccattacctacaacatcctaatcgaaaatattcatgggcactaacgcgcggccaacatccacagcacgtggcaccggccttcctttcttgtgttgtagctaggctatacacacacgatctcgctgctccgcatggccaacgtcaatggttcgtccaccggtgaaggacatagtgacctcgtcagggccatttcgcacgagcagcaccaggccttcatggcctccgtgccccgaggccacaccgggcggatggaatgcgccccacagctagtacttctcacaataccccggtcgttttgattccagggtccgggggttcttgttgcctcacgccaccgaaggttgtcccccccataacgctttcgtcactccgtcccaaaatccacgatgaccgtccgtggccggtcccccatttcatttacattccccagaaccaccggcctggacttcccctgctccgccaaccgtgaatgcaaacagcctcgggctttttttccccctaaggcaaacgcttgctgggctcctttgtatgactaaccaatcccctcaaaaccagacttttccctaaattgtatacaccccaactaaatgcccccccaagctctttgcactcacggaatacaaatttctcgacataaacttgaatccgccaactttgtcataaatggcttcttacccattnaaacatttatccccccacccttcgtaaaa

SEQ ID NO: 27295 - protein, 55 aa, Zea mays
  misc_feature: Ceres CLONE 1400524-F
MANVNGSSTGEGHSDLVRAISHEQHQAFMASVPRGHTGRMECAPQLVLLTIPRSF

SEQ ID NO: 27296 - DNA, 631 bp, Zea mays
  misc_feature: Ceres CLONE 1400525-F
  misc_feature: Encodes the peptide sequence at SEQ ID NO. 27297
tggagctccccgcggtggcggccgctctagaactagtggatcccccgggctgcaggaattcgcacgagaccattacctagaacatcctaatcgaaaactcctcttctccagcgtccgatccccgtttcccacgaatcccactctactcctccatctgcggcctcctccatgctcctgcccccttctctctcctccttgcttccccgcgcgcacgtttttacaagggtttcggcggaggcgaccggtcgccgacgatggcggacgacagcggcagccacgagggcggcggcggcggcggcgacgacgtccgggagcaggacatgttcttgcctattaccaacatcacccggatcatgaagaaggccgtcccggccaatgccaagatcactaaggacgctaaggagataatgcagtactgcgtctccgagttcatattctttgtgacgagcgaagcgagggagaaaagcaaaaaggaggagcgtaagagaatcaacgtggacgatttgctctggtcagtggatacggcagggatccaagtacgtggaagcttctccaggattgccttacaaagtaccaaaaaaaaggggaagtgcaacggggaacccgaacgtggatcaggttaattaacccc

SEQ ID NO: 27297 - protein, 122 aa, Zea mays
  misc_feature: Ceres CLONE 1400525-F
  misc_feature (23)..(88): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
MADDSGSHEGGGGGGDDVREQDMFLPITNITRIMKKAVPANAKITKDAKEIMQYCVSEFIFFVTSEAREKSKKEERKRINVDDLLWSVDTAGIQVRGSFSRIALQSTKKKGKCNGEPERGSG

SEQ ID NO: 27298 - DNA, 711 bp, Zea mays
  misc_feature: Ceres CLONE 1400526-F
  misc_feature: Encodes the peptide sequence at SEQ ID NO. 27299
aaagctggagctccccgcggtggcggccgctctagaactagtggatcccccgggctgcaggaattcgcacgagaccattacctagaacatcctaatcgaaaaaagcacgccttctcttcttcctttacccccacagcttgcgtggtctgtggtctcatctcactcacactctctctctctctcggcgacgtctacgccgagtgcccaggcattcttcaggcgcaggtcgctggctcgctgccgccctacaccaggtgccccggtcttcttccgtcccttcgccggcgacgagcactgccagcgtgatcctttccgacaggacagtatagcggatggcttcgtcggtgcgggcgccatcggggtcggtgatcgccgtggcatcgtcctcttcctcagcagccgcggccggggtgtgcggcacgggctcgccgtgcgccgcgtgcaagttcctgcgtcgcaagtgccagccggactgcgtgttcgcgccctacttcccaccggacaacccgcagaagttcgtgcgcgtgcaccgcgtcttcggcgcgagcaacgtgaccaagctgatgaacgaaatccacccgttgcagcgcgaggacgccatgaactcgctcgcctacgaggccgacatgcgaattcgcgaccccgtctacggctgcgtgggcgtcatctccatcctccagcacaacctacggcagctccagcaggacctcg

SEQ ID NO: 27299 - protein, 126 aa, Zea mays
  misc_feature: Ceres CLONE 1400526-F
  misc_feature (33)..(126): Pfam Name: DUF260 Pfam Description: Protein of unknown function DUF260
MASSVRAPSGSVIAVASSSSSAAAAGVCGTGSPCAACKFLRRKCQPDCVFAPYFPPDNPQKFVRVHRVFGASNVTKLMNEIHPLQREDAMNSLAYEADMRIRDPVYGCVGVISILQHNLRQLQQDL

SEQ ID NO: 27300 - DNA, 673 bp, Zea mays
  misc_feature: Ceres CLONE 1400527-F
  misc_feature: Encodes the peptide sequence at SEQ ID NO. 27301
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
gctctagaactagtggatcccccgggctgcaggaattcgcacgagaccattacctagaacatcctaatcgaaaaagggccggacgacggggacagacagcgttgtcgcggagacacctgcttcccaacgccgtccgcacctgctgccctgtcgtccgccctccttcccttctcctcccctccaactgtttcctcaacctcccgacccaaccacggacgtgcccgccaaggcgccaaccgcacagtatcgctgtctcttggacattgcagcagcagctggagtgctgacgtgctgagggtggttctgttgtccatgtcgcgcaaacatcagcatgttgccatatttaccacagcgtgcttgccgtggatgactgcgactgcgacaaacccactgtttcggactgcataccttgccaaggctggagattgggaggtcacgctggtggtgccttggctgtccaagggggatcaggagctcgtttatccaaacaagatgaggttcagtttgccggcagagcaggataactatgtgcggagatgcttgaggaacgatggctgtgcgagctgactaagtctatctggagttcactgaaagagatcggattgatatgannnnnnnnnnnnnnnnnnnnnnnnnnnnnnnnnnnnnnnnnnnnnnnnnnnnnnnnnnnnnn

SEQ ID NO: 27301 - protein, 84 aa, Zea mays
  misc_feature: Ceres CLONE 1400527-F
  misc_feature: SWISSPROT Homolog: EC 2.4.1.241 Digalactosyldiacylglycerol synthase
MSRKHQHVAIFTTACLPWMTATATNPLFRTAYLAKAGDWEVTLVVPWLSKGDQELVYPNKMRFSLPAEQDNYVRRCLRNDGCAS

SEQ ID NO: 27302 - DNA, 725 bp, Zea mays
  misc_feature: Ceres CLONE 1400530-F
  misc_feature: Encodes the peptide sequence at SEQ ID NO. 27303
aaagctggagctccccgcggtggcggccgctctagaactagtggatcccccgggctgcaggaattcgcacgagaccattacctagaacatcctaatcgaaaaaatcacgacaagggcgccgatctgggaaggcattgtcttgttgtactttcccttccggcagtggcctcgattcgcatccccttttcccgtccatgcgcgcgccggcgggcggtgccagagacaccgcgatcgcggcgaccatgaacattaagcagccgctgcacggcgcatcgactctgatcgcgctgctctctctctcgctgatcctcctcggccagctcctccgcctccgcctggccgccttccgcgacgcggcgctgtcgctccacgtgatggcgcgcctccgcctccgcccggacgtgctctgccacccgggagactgccacgacggcgtcttcgcgatccggatggaccacgctgacccgtatggtgccccacctcgcgcgtactcaagcccgacggttgtgctaatccagggctcctggtgtgaaagccaggtcgaagagggctccaaaccctctcctgttggtcgcggccaattcgaacggtaaactccggaacctagggtcctccggggggaggtcctggtccgcaatttccgtgccgaaaatggggtccccagagcccgctgagccgcttaacctaagtcccgtcactgggccgggccaccccaaaaaaggccc

SEQ ID NO: 27303 - protein, 132 aa, Zea mays
  misc_feature: Ceres CLONE 1400530-F
MRAPAGGARDTAIAATMNIKQPLHGASTLIALLSLSLILLGQLLRLRLAAFRDAALSLHVMARLRLRPDVLCHPGDCHDGVFAIRMDHADPYGAPPRAYSSPTVVLIQGSWCESQVEEGSKPSPVGRGQFER

SEQ ID NO: 27304 - DNA, 706 bp, Zea mays
  misc_feature: Ceres CLONE 1400533-F
  misc_feature: Encodes the peptide sequence at SEQ ID NO. 27305
aaagctggagctccccgcggtggcggccgctctagaactagtggatcccccgggctgcaggaattcgcacgagaccattacctaaaacatcctaatcgaaaaattacggctgaagggagtcgctcgccgccgcgttcgaggcgttccctcgtcgcgctcgcgccgtcgaccttcaccgctcgctgtcaggtctgcccgccacgacctcgccggccacactcgcagctcgccctcgctcctacgcctcgccggcgaggccttctgccttttcgcgccctctatctgctgcgatctttggagcatcgttctcttctctcacttgagatccagacccctaaaccctagagctcgccgcttccgctcgctcgctccgcgctggcggcgacaatggaggacgaggagatggagaagaaggtgcagcagtacttgcagcgcaagggtttccgcctcactgagcttgcgctccaggaggagtgcaaccgcctctccacctccgccatctccgacgttgcgcttgcacggtctgacaatgatccagcgagatactacgatggatatagcagattaagaacatgggcatacagttctcttgatcaatataagcacgaattacttcgcgtcctttatccagttttcatccatagcttcatggatctagtggcagaaggacatatgcaggaagctcggtcatttttccatacatttc

SEQ ID NO: 27305 - protein, 106 aa, Zea mays
  misc_feature: Ceres CLONE 1400533-F
MEDEEMEKKVQQYLQRKGFRLTELALQEECNRLSTSAISDVALARSDNDPARYYDGYSRLRTWAYSSLDQYKHELLRVLYPVFIHSFMDLVAEGHMQEARSFFHTF

SEQ ID NO: 27306 - DNA, 703 bp, Zea mays
  misc_feature: Ceres CLONE 1400535-F
  misc_feature: Encodes the peptide sequence at SEQ ID NO. 27307
  misc_feature (661)..(661): n is a, c, t, g, unknown, or other
  misc_feature (662)..(662): n is a, c, t, g, unknown, or other
aaagctggagctccccgcggtggcggccgctctagaactagtggatcccccgggctgcaggaattcgcacgagaccattacctagaacatcctaatcgaaaaagatttggatgtggactagatgcttaaggtgtgaacgtgaaagtggggtccccagatcatcacgaagggtgataatgtcagctgaagcacactacctttcatttgggaagttccttgaacttagtttttcaagccactcaaccgctagaaggctgccaatatgcgggcattcactcaatacggattgtctgcgctttttttgggttgggctccaaagttgcaatgttccagtattcctcagtcgaaatttacaatgcctgcaaaccacagcctactcttgagattcacaaccccgatatgcacaaagatgccccaaggttgctgccctcgtgtttcgtgctctgattgttgagtcttcaatgagagctgattccagttatatagaggtgaacaagcttttgattatttcttttgttaatttggtgcaacatatagaggtgaacaagcttattaaaggaagatccttgtacaatcaagagttcatacaatagatgaaacgatattgtgattctctcaatggtggcttcatgagcaagcaatcattcaccttgttcactannatttcagactgtagctcagataaggctttgagcattccttg

SEQ ID NO: 27307 - protein, 90 aa, Zea mays; identical to SEQ ID NO: 11994
  misc_feature: Ceres CLONE 1400535-F

SEQ ID NO: 27308 - DNA, 664 bp, Zea mays
  misc_feature: Ceres CLONE 1400538-F
  misc_feature: Encodes the peptide sequence at SEQ ID NO. 27309
aaagctggagctcaccgcggtggcggccgctctagaactagtggatcccccgggctgcaggaattcgcacgagaccattacctagaacatcctaatcgaaaactccttctcctccctctttccacgacactaaaagaaatcgaaaaccattgacgcgctacttccacactaatctacaccgagatttcctcctctacgactgccagcctatgtgggagaaccgtaaacctaaatgggggacgccacctctacggtggcggcgcgctttgcctttttcgcggcgaggccgccgtcgtacggaaacgagaagccgacgctgcttacggccactgccacagcagaggctacaggcgagggcacatctcaaccacatgctccgggcgggggcacacaagagacggcgcctccggcccgggtcactcgctaagctgccatgagcgcgagaatacaacggagcaggcgaaactgtggagctcacaggagccacgtatatactaaaaatggaggcgcggactgtgcgaattaagcgccatcaccattgatgcgagatgaacgttcagcaagcacatcctgaactaacgcttgtatactgctaggcgacaaagcagaactcgaccaatgtaagatgtatctgcggggtcagggatagctcaacgtcaatctt

SEQ ID NO: 27309 - protein, 64 aa, Zea mays
  misc_feature: Ceres CLONE 1400538-F
MGDATSTVAARFAFFAARPPSYGNEKPTLLTATATAEATGEGTSQPHAPGGGTQETAPPARVTR

SEQ ID NO: 27310 - DNA, 682 bp, Zea mays
  misc_feature: Ceres CLONE 1400539-F
  misc_feature: Encodes the peptide sequence at SEQ ID NO. 27311
  misc_feature (624)..(624): n is a, c, t, g, unknown, or other
aagctggagctccccgcggtggcggccgctctagaactagtggatcccccgggctgcaggaattcgcacgagaccattacctagaacatcctaatcaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacacctccccggactcgcctgcgcagcgcttcgtgtcggaggacggcgtcatcaactcgcgcccgcggatgctggggcgcggcagctgcatcaacgccggcttctacacgcgggccagcgacgactaacgtgcgggcgtcggatgggacctgggcgcccgcgggcagcgtaccggtgantggaagacacgtgtgcgttcagacgaggggggcccccttgtcaggccgggcttcaggg

SEQ ID NO: 27311 - protein, 141 aa, Zea mays
  misc_feature: Ceres CLONE 1400539-F
  misc_feature: SWISSPROT Homolog: EC 4.1.2.10 Mandelonitrile lyase
MSGRSRHFTMSTLLATSFFFVLLCSSLQVRGVNYTFVKDAALAPSVSYYDYIIVGGGTAGCPLAATLSERFRVLLLERGASPYDDDRIGDMARFADTLSDTSPDSPAQRFVSEDGVINSRPRMLGRGSCINAGFYTRASDD

SEQ ID NO: 27312 - DNA, 632 bp, Zea mays
  misc_feature: Ceres CLONE 1400540-F
  misc_feature: Encodes the peptide sequence at SEQ ID NO. 27313
  misc_feature (51)..(51): n is a, c, t, g, unknown, or other
  misc_feature (60)..(60): n is a, c, t, g, unknown, or other
  misc_feature (61)..(61): n is a, c, t, g, unknown, or other
  misc_feature (187)..(187): n is a, c, t, g, unknown, or other
  misc_feature (189)..(189): n is a, c, t, g, unknown, or other
  misc_feature (285)..(285): n is a, c, t, g, unknown, or other
aagctggagctccaccgcggtgggcggccggcttctagtaactagtgggcnatcccccgnnggctggcaggaattcgcacgagaccattacctagaacatcctaatcgaaaatcttaaatcccacctctccccgtctacgcctcattcgcttcagctcgcatcccacagccaagccaggtagccccngnagatctcccaagaaacccatcttgaaatccggagaacgcccagcattctttgctcggcccagggattccgatttccgacgaacgggttcctacggncgaaaaaaaagtccgaatattttcccggggggagctcagggaggggttctcggcctccggaaaccggaagaaagaggcccggggggaatttgacaaagggggccaaaaggggggagggttgccgaaccaaagggggttaaacccccttgttaaaataaagggtggttttttccctttggggggggtttaggggtttttttcccccaaaatttccccccggggggttcagggggcaaaaaactcttgggggggccccccgccatttttcttggggggggggggggagtttttttttgtgtgggcccccccccgttttttgggaccacacaaaaaattttttttttaga

SEQ ID NO: 27313 - protein, 38 aa, Zea mays
  misc_feature: Ceres CLONE 1400540-F
  misc_feature (17)..(17): Xaa is any aa, unknown, or other
  misc_feature (20)..(20): Xaa is any aa, unknown, or other
SWSSTAVGGRLLVTSGXSPXGWQEFARDHYLEHPNRKS

SEQ ID NO: 27314 - DNA, 726 bp, Zea mays
  misc_feature: Ceres CLONE 1400543-F
  misc_feature: Encodes the peptide sequence at SEQ ID NO. 27315
  misc_feature (570)..(570): n is a, c, t, g, unknown, or other
  misc_feature (582)..(582): n is a, c, t, g, unknown, or other
  misc_feature (586)..(586): n is a, c, t, g, unknown, or other
  misc_feature (617)..(617): n is a, c, t, g, unknown, or other
  misc_feature (618)..(618): n is a, c, t, g, unknown, or other
aaagctggagctccccgcggtggcggccgctctagaactagtggatcccccgggctgcaggaattcgcacgagaccattacctaaaacatcctaatcgaaaaacagccacgcacaggggtcaggtcagtcgcctacgaaattcaatagcacagcgagagccaaggaagaagaagaagcaagcggagcgccatggcggcgtccaacggcgagggccacggccggttcgacgtgatcgtggtgggcgcgggcatcatgggcagctgcgccgcctacgcggcgtcctctcgtggcgcgcgcgtgctgctcctggagcggttcgacctgctccaccaccggggctcctcgcacggcgagtcgcgcaccatccgcgccacctacccgcaggcgcactacccgcccatggtgcgcctgtcccggcgcctcctgggacgaggcccaggccgacgccgggtacaccgtggtcacgcccacccccgcactcgactggggccccgcgggacgactcggcgctcgtcgcctccatgaggaaacggcgtgccaccgaagtcgtcgccggggatgagtcgtcntctggccggggncagncgtgttcaggtccccgaacggtggacgccgnnccggaccaagttgggcgggttcatgaggccaccaggcccgggcccatgtcaggggtccccgcaaagaggggcccgcccagggaggggtctggggggggggactccccc

SEQ ID NO: 27315 - protein, 111 aa, Zea mays
  misc_feature: Ceres CLONE 1400543-F
  misc_feature (12)..(71): SWISSPROT Homolog: EC 1.5.3.1 Sarcosine oxidase
  misc_feature (1)..(42): SWISSPROT Homolog: EC 1.14.99.7 Squalene monooxygenase
MAASNGEGHGRFDVIVVGAGIMGSCAAYAASSRGARVLLLERFDLLHHRGSSHGESRTIRATYPQAHYPPMVRLSRRLLGRGPGRRRVHRGHAHPRTRLGPRGTTRRSSPP

SEQ ID NO: 27316 - DNA, 712 bp, Zea mays
  misc_feature: Ceres CLONE 1400544-F
  misc_feature: Encodes the peptide sequence at SEQ ID NO. 27317
  misc_feature (630)..(630): n is a, c, t, g, unknown, or other
  misc_feature (653)..(653): n is a, c, t, g, unknown, or other
aagctggagctccccgcggtggcggctgctctagaactagtggatcccccgggctgcaggaattcgcacgagaccattacctagaacatcctaatcgaaaaagagccgccgcgcaccctccagttcgtctccccagctctgtctctaaaatccactcgtccaccacctcctcggcgcttcgcatcctttccccctccgcaagaaagaagcgaagcaactctccgccgtctccgtttttctccacaccacccaaagctctctccgaccacagcctcgcccccagcgcctccttccgcagtcatgtaccgcgcggccgctagcctcgcctccaaggcgcggcaagccgggaacagcctcgccgcccgccaggttggaagcaggcttgcctggagcaggaattatgctgcgaaggacatcaagtttggtgttgaggcccgtgctctgatgttgaggggtgttgaggagttggcagatgccgtcaaagtgacaatgggacctaagggccgcaatgtggttattgagcaaagctttggtgcaccgaaagtcacaaaggatggtgtgactgtagcaaagagcattgaaatttaggatagagtaaagaatgggtggtgcagccttggtgaaacaggntgctaaatgcactaatgacactngctggcgatggtacccacatgggccactggttttgacaaaagcataattttactgaggt

SEQ ID NO: 27317 - protein, 95 aa, Zea mays
  misc_feature: Ceres CLONE 1400544-F
MYRAAASLASKARQAGNSLAARQVGSRLAWSRNYAAKDIKFGVEARALMLRGVEELADAVKVTMGPKGRNVVIEQSFGAPKVTKDGVTVAKSIEI

SEQ ID NO: 27318 - DNA, 676 bp, Zea mays
  misc_feature: Ceres CLONE 1400545-F
  misc_feature: Encodes the peptide sequence at SEQ ID NO. 27319
  misc_feature (450)..(450): n is a, c, t, g, unknown, or other
  misc_feature (451)..(451): n is a, c, t, g, unknown, or other
  misc_feature (499)..(499): n is a, c, t, g, unknown, or other
  misc_feature (500)..(500): n is a, c, t, g, unknown, or other
  misc_feature (588)..(588): n is a, c, t, g, unknown, or other
  misc_feature (623)..(623): n is a, c, t, g, unknown, or other
cgctctagaactagtggatcccccgggctgcaggaattcgcacgagaccattacctagaacatcctaatcgaaaaacacaccacagcactaaagtctattcatctctggctccccaaattcagctggagagcactttttcccatcatggataagaactacggtgaactctacaacatcctcggatggggtgaggagtacttcgcggtgaacacggaggggcacctcagcgtgaagcctttcggccgctggacggagcccgggcaggagatcgacgtgcactcggtcatcgtggaagctctagcgacccaacccaacgacagcaccagcaaatctcagttccccatgatccttcgcttccccgacgtgctcaagaaccgtatcgagacgctccataacgcattcaacagcgccatggagtccaccgggtacacgtccaggtaccaaggcgnntgtcccgatcaggtgaaccagaaacagcacgtcgtgcagggacatggnntagggtcgccagcaatggaaactatggctcgaggctggctccaggccagactgctcatcggcatgagctggcctcccgtcaccgaagncgaggccaagccgtacttgatctggcacggctacnaggacgggaatacatcgcgctcggggttctcggggggcccatgggactgaacc

SEQ ID NO: 27319 - protein, 175 aa, Zea mays
  misc_feature: Ceres CLONE 1400545-F
  misc_feature: SWISSPROT Homolog: EC 4.1.1.19 Arginine decarboxylase
  misc_feature (102)..(102): Xaa is any aa, unknown, or other
  misc_feature (119)..(119): Xaa is any aa, unknown, or other
  misc_feature (148)..(148): Xaa is any aa, unknown, or other
  misc_feature (160)..(160): Xaa is any aa, unknown, or other
MDKNYGELYNILGWGEEYFAVNTEGHLSVKPFGRWTEPGQEIDVHSVIVEALATQPNDSTSKSQFPMILRFPDVLKNRIETLHNAFNSAMESTGYTSRYQGXCPDQVNQKQHVVQGHGXGSPAMETMARGWLQARLLIGMSWPPVTEXEAKPYLIWHGYXDGNTSRSGFSGGPWD

SEQ ID NO: 27320 - DNA, 702 bp, Zea mays
  misc_feature: Ceres CLONE 1400550-F
  misc_feature: Translation starting site: 177
  misc_feature: Pfam Name: COX5C Pfam Description: Cytochrome c oxidase subunit Vc (COX5C)
  misc_feature: SWISSPROT Homolog: EC 1.9.3.1 Cytochrome-c oxidase
  misc_feature: SWISSPROT Homolog: EC 2.3.1.15 Glycerol-3-phosphate O-acyltransferase
  misc_feature (639)..(639): n is a, c, t, g, unknown, or other
tggagctccccgcggtggcggccgctctagaactagtggatcccccgggctgcaggaattcgcacgagaccattacctagaacatcctaatcaaaaacggatcgaaaacgaattaccctcggtgccctccctctcggcgggggcggcgcaagtccccttcatctccggcgcggcaaatggcaggcggcagggttgcacatgctaccctcaagggccccagcgtggtgaaggagatcttcattggactgaccctgggtctgatcgctggaggtatgtggaagatgcaccactggaacgagcagaggaaaactagatccttctacgacatgcttgacaagggccagatcgtcgtcgtcgaggagtagttcccacgtgtcacctcagaagtttttttttccagttgtttttgaaaactcactctggagagcacgacaaagtgaatgctgtgaagatttggcttgaaaataagcataaccatttgagagctctcgcgggcgacgtgcacccggaaagctggaggccgttcagctccttcggcaggcgctacgtcgtcacggcctgccccagggtcatggtcgagcttttcgctagcggcttcctcggagcgggggccgggaaccaaatccacgctgaaggagncaaatacagcgcgtcactggctcatgtttcacacgggcgtgctcggaaaacacttgccgaacc

SEQ ID NO: 27321 - DNA, 709 bp, Zea mays
  misc_feature: Ceres CLONE 1400553-F
  misc_feature: Encodes the peptide sequence at SEQ ID NO. 27322
  misc_feature (574)..(574): n is a, c, t, g, unknown, or other
  misc_feature (690)..(690): n is a, c, t, g, unknown, or other
aaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtgacgtcggtgctccaagaccggcggtgtcgacggcctcccgccggggcctccgggttggccggtggtggggaacctgttccaggtgatcctgcagcgacggcccttcatgtacgtggtgcgcgacctccgggagaagtacgggcccatcttcaccatgcggatggggcagccaccctcatcgtggtcacctcggcggagctcatccacgaggcgctggtgaagcagggccccatgttcgcgagccggaccgaggacagcctcacccgcctcctactcagcgtcggnaagtgcaccgtcaactcgacgccctacggccccctgtgacgtgctctgcgccgcaacttcgtcgccgagatcgtgtcccgcatcgcgtcaaggcttctcctggatcctggagtggnccgtggacgcgcactgcgc

SEQ ID NO: 27322 - protein, 30 aa, Zea mays
  misc_feature: Ceres CLONE 1400553-F
MFASRTEDSLTRLLLSVGKCTVNSTPYGPL

SEQ ID NO: 27323 - DNA, 665 bp, Zea mays
  misc_feature: Ceres CLONE 1400557-R
tcgaggtcgacggtatcgatattttttttttttttttttcgctgcggaacgaaactgccacccaataaatttatttctgcgatccgcagcaagaaacagacccacacccatccatccaaactgaatggcaattgctggttccgggttccccgttcccatcaacatcaacagagcgcccctttctcgccggtgcgccgttggtgggtggtgtgggtgcctcgtcgtcgtcgcactttgcggttccgtcacttaggctcggacgaccaggacagggcgaggccgactggccacgtaccgccattacaccaagcaatcatgccccatgcgcgccgcgctcgccacgtcacatcgtgtccgacgcgacgaaggggtcgtagagtaggcccaccgccgagagcagcggcgggccacgcagcgccttgatcgagaccctcaccgtcgtgcccgcgacgggggcagggcagccggtgcagtcgcttgtgccccaccgtcgtgccgttggccacgggcgcgcccgcccacgtacaccgggtgcccgctccacgcgcttgccccagcgggcacgtggttcctaaaatcccaaccacgttgaaacggcccgattcctcccgtggacttgggcgcccggccgcaaacatcgaacccaggtaccccgtttccggggg

SEQ ID NO: 27324 - DNA, 684 bp, Zea mays
  misc_feature: Ceres CLONE 1400557-F
  misc_feature: Encodes the peptide sequence at SEQ ID NO. 27325
aagctggagctccccgcggtggcggccgctctagaactagtggatcccccgggctgcaggaattcgcacgagaccattacctagaacatcctaatcgaaaaagagaagtgataacagcagcacgatggcaagcccgctgatgtgcctggccgccgcggcgctggccgtagccgtcctcgtctccgcgacagaggagtggctcgcgactccgccgccactggcgttgctgacgatcccgtcccccccgaagctaacatggcagcaacgcgacgccatgatcgtcttccacttcggcatgaacaccttcacggactccgagcgtcggcacggatctcggaggacacggcccagttccgccccgcgggagtcaacgccactccagtgaatgcacgcagcgtcgcatcttgatggacttcttgctcatcttcgacccgaagcaccacgcaggattctgtctctggaagctcgactacacattcacttccgtgacgatctgcaccatgtgctcaagctcttcacatgacagttaatgagtatcgtgtgccctgccacggtatgagcactagatgcagctgtaacatcatctatttctaaggaactcctacagcacggagagaccatgtgcaccagaggaccagaaggacgcttctcgattactcgtctgcacggaagaaaagaatactg

SEQ ID NO: 27325 - protein, 86 aa, Zea mays
  misc_feature: Ceres CLONE 1400557-F
MASPLMCLAAAALAVAVLVSATEEWLATPPPLALLTIPSPPKLTWQQRDAMIVFHFGMNTFTDSERRHGSRRTRPSSAPRESTPLQ

SEQ ID NO: 27326 - DNA, 677 bp, Zea mays
  misc_feature: Ceres CLONE 1400561-F
  misc_feature: Encodes the peptide sequence at SEQ ID NO. 27327
  misc_feature (318)..(318): n is a, c, t, g, unknown, or other
  misc_feature (367)..(367): n is a, c, t, g, unknown, or other
  misc_feature (424)..(424): n is a, c, t, g, unknown, or other
aagctggagctccccgcggtggcggccgctctagaactagtggatcccccgggctgcaggaattcgcacgagaccattacctagaacatcctaatcgaaaagtcatagagagccacaggccacaggcaagacaggcaggaggatcggacgagtcggcgaggaagctgcctgcttttcagatagagttattaagatggcgttgcttcggctgcttgccctgatctccctgctcttcgcagtggccactcctgtcagggacatcgcccacgatgcctgctcgtcagaagtgaaggatttccagcacctgaaacacagctncgggctccacctgacgctgcaccacccgcagagcccctgctccccgggngcgctgcccgccgacctccccttctccgcgtgctcgcccacgacgggcgcgcatcgngtcgctcggcgcggcgctcggccagaacgcgtcctctcggcccacttgcttgacgagagccgcgcggggtcctcgtcgtcctcccccgatgacgagtcgtccctcgggtccgtgccggtcggcccgggcacgttcgtcggggggggcaactacgtcaccgggatggggctcgggacgccggccaattgtacgtcatggccggggaacccgggtcctccctcaccgggttcaggggtccccctggggggggcgg

SEQ ID NO: 27327 - protein, 161 aa, Zea mays
  misc_feature: Ceres CLONE 1400561-F
  misc_feature (42)..(42): Xaa is any aa, unknown, or other
MALLRLLALISLLFAVATPVRDIAHDACSSEVKDFQHLKHSXGLHLTLHHPQSPCSPGALPADLPFSACSPTTGAHRVARRGARPERVLSAHLLDESRAGSSSSSPDDESSLGSVPVGPGTFVGGGNYVTGMGLGTPANCTSWPGNPGPPSPGSGVPLGGA

SEQ ID NO: 27328 - DNA, 707 bp, Zea mays
  misc_feature: Ceres CLONE 1400562-F
  misc_feature: SWISSPROT Homolog: EC 6.1.1.14 Glycine--tRNA ligase
  misc_feature (293)..(293): n is a, c, t, g, unknown, or other
  misc_feature (361)..(361): n is a, c, t, g, unknown, or other
  misc_feature (467)..(467): n is a, c, t, g, unknown, or other
  misc_feature (599)..(599): n is a, c, t, g, unknown, or other
aaagctggagctccccgcggtggcggccgctctagaactagtggatcccccgggctgcaggaattcgcacgagaccattacctagaacatcctaatcgaaaacgcttcccatctgatgctcgtgctccgccgcgtctccttcctcctctcgtcgccctcccctcgcgcgccgctcgcaaaacctctcctgctgctacgcccgccccaaaccctagccccgacagcgcggcagctcgtggatatggccgcgtcagtcccgtcggcgggtggggcgacgatgagccgcgacgcgnttccgcgcggccgtgaccaacacgctggagcgccgtctcttcttcgtgccctctttcagatctacggncggcgtcgcggggctctacgactacggacccccagggtgcgctgtcaaagctaacgtcctcgcattctggcgccagcattttgtattgggagaagggatgcttgangttgacctgtcatgtgggacgccagaagtgtcttgaaggcctctggacatggtgataaatttccgactaatgggtaaagatgaaagacaggaactgctacccggcggatcattggttgaacgcgatttgaangatagcttggagaagatcaccctggtcccccgaattgcagagaaaacaaaaagttctgctttccggggagatctcctgaaaaacatgggggctaaaataggggattaa

SEQ ID NO: 27329 - DNA, 703 bp, Zea mays
  misc_feature: Ceres CLONE 1400563-F
  misc_feature: Encodes the peptide sequence at SEQ ID NO. 27330
  misc_feature (608)..(608): n is a, c, t, g, unknown, or other
tggagctccccgcggtggcggccgctctagaactagtggatcccccgggctgcaggaattcgcacgagaccattacctagaacatcctaatcgaaaagttcctttcttccccactacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctggcatgaaggtcctcgtcctcgacccccaaaccgttgggatggtgagcgtggtgtacagccagtcggatctgctgcggaaggaggtcttcctcgtcgagaccatggacaacgcctccagctccagggagtccatggcgcacctcaaggccgtctacttcctccgaccctccgctaacaacgtccagaagctccgcaggcacctcgccatggcgcgctttcgcgagtaccactattctttctcagtatattgaagggtccgcagattcaatacttgctgactccgatgaacaggagttgtgcancaagtcaggaggtctatgctgaattttgggccatgacccatacatttccttcccaactacaaaataccccctggatttggtcccaaagggctcga

SEQ ID NO: 27330 - protein, 102 aa, Zea mays
  misc_feature: Ceres CLONE 1400563-F
MVLITLVRDYIDRMLHDIPGMKVLVLDPQTVGMVSVVYSQSDLLRKEVFLVETMDNASSSRESMAHLKAVYFLRPSANNVQKLRRHLAMARFREYHYSFSVY

SEQ ID NO: 27331 - DNA, 739 bp, Zea mays
  misc_feature: Ceres CLONE 1400566-F
  misc_feature: Encodes the peptide sequence at SEQ ID NO. 27332
  misc_feature (381)..(381): n is a, c, t, g, unknown, or other
  misc_feature (547)..(547): n is a, c, t, g, unknown, or other
  misc_feature (556)..(556): n is a, c, t, g, unknown, or other
  misc_feature (669)..(669): n is a, c, t, g, unknown, or other
aaagctggagctccccgcggtggcggccgctctagaactagtggatcccccgggctgcaggaattcgcacgagaccattacctagaacatcctaatcgaaaaataaatttggaggtcggtgaagagattttctccttattctcgtcatctcgtggctttaaaataccccgcgggccgcggccccgcccaaatccaaccgccctaccaacgaccatctgctctgctctcgccgctcctacccttccaaatcccctcctcgcaacaaccaggcagccatcttccccatcagcaggcgatggagctcttccccgacggtggcttcgtgcggctgcagaaccgcgcgaatagaaggtacgtccacgccgacgaggactgggtggnggtctcccttcgtccgaacgggcccgtcccatccctgaatgcggtctggcgggtggagcattgggtctccccgttgtggccgaacgaacgggacaccttcgtcctcctccagaacgcagcctacggccgctacctctcctcctcgatggacgaggcgccgcacggncaccttggncagcgcggcacccagcacaaccgcgacgacccccaagtgctggacatccaccccccgtggatatggagcgtcgagaggctgcaccccccggacatgactacgtccgcctgcgncatttacgcccacacctcgtggccagcggagggacaaatctggaacatcggcgtcaccgtcgactacacc

SEQ ID NO: 27332 - protein, 148 aa, Zea mays
  misc_feature: Ceres CLONE 1400566-F
  misc_feature (29)..(29): Xaa is any aa, unknown, or other
  misc_feature (125)..(125): Xaa is any aa, unknown, or other
MELFPDGGFVRLQNRANRRYVHADEDWVXVSLRPNGPVPSLNAVWRVEHWVSPLWPNERDTFVLLQNAAYGRYLSSSMDEAPHGHLGQRGTQHNRDDPQVLDIHPPWIWSVERLHPPDMTTSACXIYAHTSWPAEGQIWNIGVTVDYT

SEQ ID NO: 27333 - DNA, 671 bp, Zea mays
  misc_feature: Ceres CLONE 1400569-F
  misc_feature: Encodes the peptide sequence at SEQ ID NO. 27334
  misc_feature (485)..(485): n is a, c, t, g, unknown, or other
  misc_feature (505)..(505): n is a, c, t, g, unknown, or other
  misc_feature (546)..(546): n is a, c, t, g, unknown, or other
  misc_feature (549)..(549): n is a, c, t, g, unknown, or other
  misc_feature (582)..(582): n is a, c, t, g, unknown, or other
  misc_feature (611)..(611): n is a, c, t, g, unknown, or other
aagctggagctccccgcggtggcggccgctctagaactagtggatcccccgggctgcaggaattcgcacgagaccattacctagaacatcctaatcgaaaaactcgctcaaaccctagccccaccgcgcgaatggccgatgtgcttgacccggcctccgacgcgccgcgcgcgcgccgtccgccgccacctcccccggatagcccggaggaccctcgccgcagctgcccccgcctccacccgggggccccccggcggcgagccggaagcggagtcgctctccgccgccgccgccgccgcctccgctgggttcgtcccggccccaaaggtatcgggaccaccgcagcggcggagggcggggcgggagcagccccagcccgccgccgtaccggggcagccgccgccactcgccgtccaggagatccccgtcgccgccattcaagcggtcgcggagggacgacgggtacgaccgccgcgggggccgcnggagcccgccgcgttacggntacgatgataggaggcgaggttatgacccatgagcgagtgncgncagaggtgggtatgaagatgacaggaaccaggncagatatctgaaccgtgctccagattggnctgattcggggtacggagcggccaatgatggtccagggctcaccaaaagggaggtttgat

SEQ ID NO: 27334 - protein, 153 aa, Zea mays
  misc_feature: Ceres CLONE 1400569-F
  misc_feature (125)..(125): Xaa is any aa, unknown, or other
  misc_feature (139)..(139): Xaa is any aa, unknown, or other
  misc_feature (140)..(140): Xaa is any aa, unknown, or other
  misc_feature (151)..(151): Xaa is any aa, unknown, or other
MADVLDPASDAPRARRPPPPPPDSPEDPRRSCPRLHPGAPRRRAGSGVALRRRRRRLRWVRPGPKGIGTTAAAEGGAGAAPARRRTGAAAATRRPGDPRRRHSSGRGGTTGTTAAGAAGARRVTXTMIGGEVMTHERVXXEVGMKMTGTRXDI

SEQ ID NO: 27335 - DNA, 727 bp, Zea mays
  misc_feature: Ceres CLONE 1400571-F
  misc_feature: Encodes the peptide sequence at SEQ ID NO. 27336
  misc_feature (382)..(382): n is a, c, t, g, unknown, or other
  misc_feature (393)..(393): n is a, c, t, g, unknown, or other
  misc_feature (495)..(495): n is a, c, t, g, unknown, or other
aagctggagctccccgcggtggcggccgctctagaactagtggatcccccgggctgcaggaattcgcacgagaccattacctagaacatcctaatcgaaaaattaattaacaaagagaagacttcttccttcctcgtcgtctccagcccattccaattcttgattccatcgccccaccatccacaactcccctaatccttccaacctcctcgtcgtccagtccaccacctccacgcgcaatggccagcggctaggcggcaccaaccagatcacaaggattcgtttcatccggcagcgcagctctagagcctccatgggcagctacgcgtacaagtactgtatgtgcttcacgcgcaagttccgatccccggacgcccagccngccgcggacgntcgcgccgcccacctctcctttcgctctgacgcccatgccctccccgcgctcgtcgccggcgtccagggcgagtcccccgccgacgtcgaccgcatcctcgncatgctctccgggggccacagccatggaatcgcccgcctcgtcacaaggtcggcggggggcatccacgcccacggttcgaagattttttcggctttcctcttttccccccgaacctaaacccaaccatggggggaccaaggttaaccagggacagggcaagggcccgttcctctaaaaattttcggggttcccgggggaaataattcccaacctcccggggagaccaagttt

SEQ ID NO: 27336 - protein, 99 aa, Zea mays
  misc_feature: Ceres CLONE 1400571-F
  misc_feature (27)..(27): Xaa is any aa, unknown, or other
  misc_feature (61)..(61): Xaa is any aa, unknown, or other
MGSYAYKYCMCFTRKFRSPDAQPAADXRAAHLSFRSDAHALPALVAGVQGESPADVDRILXMLSGGHSHGIARLVTRSAGGIHAHGSKIFSAFLFSPRT

SEQ ID NO: 27337 - DNA, 722 bp, Zea mays
  misc_feature: Ceres CLONE 1400572-F
  misc_feature: Encodes the peptide sequence at SEQ ID NO. 27338
  misc_feature (498)..(498): n is a, c, t, g, unknown, or other
  misc_feature (591)..(591): n is a, c, t, g, unknown, or other
  misc_feature (611)..(611): n is a, c, t, g, unknown, or other
  misc_feature (703)..(703): n is a, c, t, g, unknown, or other
aagctggagctccccgcggtggcggccgctctagaactagtggatcccccgggctgcaggaattcgcacgagaccattacctacaacatcctaatcgaaaagattgattcacaagacgtcgatcccaaaccctaaccctttcaacggttccactccaccaccaacctcatgtgtcggcgcccgccgccgcacccaacccctccctcctccgtctgctcccggtcctcgcgtagccgcaacctccctcgttgccccacactacccacgtccctagcgtcatgcagatcaaaaccaaggggcaggcggcgacagtggttcagagtccgccgctgacggccctgcgaggaacgggtagattcgcttggtgtccgggcggctccgcgtcgccgaatccgatagcattgtggatctggaggtaggaaaagggcttggtggtagacgtggaggacgatggcgttcatggtcctagaagtaagcgcgatggtctcctcaggcatncgcttcgtggacggctggttcttcccatcatagatcagaaagagactcgagtcataaaaaagtcatcatttgtgcttgatccccacgaatggncgctgggtcttctcatttcngtgtacatgcctagatctgtgaaaatggtttgttccttcgcttcgctttgatcccacgagtaagctgctggtatctagtttcaatacatacnaaagcttttttgtggtgaa

SEQ ID NO: 27338 - protein, 54 aa, Zea mays; identical to SEQ ID NO: 24650
  misc_feature: Ceres CLONE 1400572-F

SEQ ID NO: 27339 - DNA, 738 bp, Zea mays
  misc_feature: Ceres CLONE 1400574-F
  misc_feature: Encodes the peptide sequence at SEQ ID NO. 27340
  misc_feature (564)..(564): n is a, c, t, g, unknown, or other
  misc_feature (569)..(569): n is a, c, t, g, unknown, or other
  misc_feature (576)..(576): n is a, c, t, g, unknown, or other
aaagctggagctccccgcggtggcggccgctctagaactagtggatcccccgggctgcaggaattcgcacgagaccattacctagaacatcctaatcgaaaaaaaataaaaacatttcggtctcatctccgtccacatccgtcctccagcactccagctgcatcgacgaggaccgccgtagcgatttgcgaagcaagggacgggagaggaacccgaggaaggcgaaaatgatctaccgcaactggtcgctgctctcgtccacagtcgtcatttggggcggcgtcgccaccgccggcctcgccggtatcttcctcttgggcggcaaggagaaattcaatggttatctgtgccgcgaaggcgagaggcttaggcagcaggacagagccgcgatgggccgaagctaagcgttagcttctttggtatctcaggggagcaatagcccttttcgaattcacaagattcctgcgtccctaccagaaacagtccctatctagggactaggatggaatccatccttctgcaggctttcactttcctgataataacagtaaacataaattgacnatggntttgtgntcttctgcaaaaaaaaaaaaaaaagcttatcgataccgtccacctcgagggggggcccggtacccattcgccctataggagtcgtatacgcgcgctcactggcgtcgttttacacgtcgtgactggaaaaacttggcgtaccaaactaatcggctggcagac

SEQ ID NO: 27340 - protein, 58 aa, Zea mays
  misc_feature: Ceres CLONE 1400574-F
MIYRNWSLLSSTVVIWGGVATAGLAGIFLLGGKEKFNGYLCREGERLRQQDRAAMGRS

SEQ ID NO: 27341 - DNA, 747 bp, Zea mays
  misc_feature: Ceres CLONE 1400578-F
  misc_feature: Encodes the peptide sequence at SEQ ID NO. 27342
  misc_feature (374)..(374): n is a, c, t, g, unknown, or other
  misc_feature (396)..(396): n is a, c, t, g, unknown, or other
  misc_feature (397)..(397): n is a, c, t, g, unknown, or other
  misc_feature (418)..(418): n is a, c, t, g, unknown, or other
  misc_feature (431)..(431): n is a, c, t, g, unknown, or other
  misc_feature (436)..(436): n is a, c, t, g, unknown, or other
  misc_feature (486)..(486): n is a, c, t, g, unknown, or other
  misc_feature (487)..(487): n is a, c, t, g, unknown, or other
aaagctggagctccccgcggtggcggccgctctagaactagtggatcccccgggctgcaggaattcgcacgagaccattacctagaacatcctaatcaaaaaaagaaaagcctccattcccgagtctccagccaaccgcatccagtccaccccatccccctcgaccccgacaaccccgagtcccgacccgatggcgcccaaggccgagaagaagccagcggagaagaagccggcggccgaggagaaggcggagaagacgaccgcaggtaagaagcccaagtccgagaagcgcctgcccgcctcgaagtcctccggcaaggagggcggcgagaagaaggggaaagaagaagccaagaagagcgtggagacctacnaaatctacatctttcaggtccnntgagcagtgcaccccgacatncggatctcctccnagggncatgtccatcatgaactcctttcatcacgacatcttcagaagctcgccgnngaggccgctagctcgccgggaacacaagaagccaccatcacctcccgggagatcagaacctcgggggcctcgtcctccaaggaaactcgccaaaacgccgtttcaagggaaccaggccgtccccaatttccccagaattggaacccccccgggcccccggatttttaaggcccccctttttaaagggttttttcggggggcccaaccccccccccccccccaatttttgggggggaaaaccgtgggtttcccccggggaa

SEQ ID NO: 27342 - protein, 68 aa, Zea mays
  misc_feature: Ceres CLONE 1400578-F
  misc_feature (62)..(62): Xaa is any aa, unknown, or other
MAPKAEKKPAEKKPAAEEKAEKTTAGKKPKSEKRLPASKSSGKEGGEKKGKEEAKKSVETYXIYIFQV

SEQ ID NO: 27343 - DNA, 684 bp, Zea mays
  misc_feature: Ceres CLONE 1400579-F
  misc_feature (543)..(543): n is a, c, t, g, unknown, or other
  misc_feature (684)..(684): n is a, c, t, g, unknown, or other
tggagctccccgcggtggcggccgctctagaactagtggatcccccgggctgcaggaattcgcacgagaccattacctagaacatcctaatcgaaaagtaggcgttcacagtccgtgcaccacggttctgcctcctctcaccgcgcgtccgcgtctgccgtctggcccctccgcgcccgcaatccacgcctccgccgccgcaatccgtgcccccacccgacgcaaccctcgcccattgtcccgtcccgcgatccgcgatgccctcccccacgcgcagaaactcccagtctcgccgatccctggaagcctgctcggcacccatcccccgacgtccagcgagggttttgggagcggcgactagggtttcgagaccgctgatgacgtcaccttcctcggtcgccggcaacatttgcgaccgtctgaggttccattttcagtccccgtgtgatttccccaatgtttcccttcctctgtagcctctccgacggtgccgccgccgttcgtttcctcggccgccggtgacattttgtgaatgtctgaggntcgttcttcacttcatgtgtgatttccccatctttctcttcctctgtatcccctccgacagtgtcgtcgctgttttttgcgatcgtcagcatcactgtcgatcgcttcgcttggatgcaccgttgtgaacatgcaggtagn

SEQ ID NO: 27344 - DNA, 702 bp, Zea mays
  misc_feature: Ceres CLONE 1400583-F
  misc_feature: Encodes the peptide sequence at SEQ ID NO. 27345
  misc_feature (306)..(306): n is a, c, t, g, unknown, or other
  misc_feature (570)..(570): n is a, c, t, g, unknown, or other
  misc_feature (610)..(610): n is a, c, t, g, unknown, or other
tggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggncgtgtcgacggcctcccgccggggcctccgggttggccggtggtggggaacctgttcccagtgatcctgcagcgacggcccttcatgtacgtggtgcgcgacctccgggagaagtacgggcccatcttcaccatgcggatggggcagcgcaccctcatcgtggtcacctcggcggagctcatccacgaggcgctggtgaagcagggccccatggtcgcgagccggcccgaggacagccccaaccgccctctcttcagggtcggnaagtgcaccgtcaactcggcgccctacggccccctgtggngtgctctgcggcgcaacttcgtcgccgagatcgtgtccccgcacgcgtcaggtctttctctggatccggggtgggccgggaccgcacttgcc

SEQ ID NO: 27345 - protein, 159 aa, Zea mays
  misc_feature: Ceres CLONE 1400583-F
  misc_feature: SWISSPROT Homolog: EC 1.14.13.89 Isoflavone 2'-hydroxylase
  misc_feature (129)..(129): Xaa is any aa, unknown, or other
MDVNDVLLVVLAAALAAMWWRRCSKTGRVDGLPPGPPGWPVVGNLFPVILQRRPFMYVVRDLREKYGPIFTMRMGQRTLIVVTSAELIHEALVKQGPMVASRPEDSPNRPLFRVGKCTVNSAPYGPLWXALRRNFVAEIVSPHASGLSLDPGWAGTALA

SEQ ID NO: 27346 - DNA, 773 bp, Zea mays
  misc_feature: Ceres CLONE 1400584-F
  misc_feature: Encodes the peptide sequence at SEQ ID NO. 27347
  misc_feature (336)..(336): n is a, c, t, g, unknown, or other
aaagctggagctccccgcggtggcggccgctctagaactagtggatcccccgggctgcaggaattcgcacgagaccattacctagaacatcctaatcgaaaaactggagccctataggctatagccatcaccacactcgcctccctctctccctcccacactccaccacccgcgccgccgcctcctactccgccccggcccctctgatccggaccgagcgccggccatggcgctcgccttcgacgagttcgggcgccccttcatcatcctgcgggagcaggagaagaagacgcgccttagggggctcgacgcgcagaaggccaacatcgcctcggncaaggccgtcgcgcggatcctccgcacgtcgcttggacccaggggcatggacaagatgctccagtcccccgacggggacgtcatcatcacaaatgatggagcgaccatcctgaagcagatggatgttgacaccaagatacaaagctgatgggggacctgtcccgaagccaaaacaatgaaatcggggatggaccccccggggggggaaccatggaaggggtcttttcccagaaggcccaaaaatttttgggaggggaattcccccccataagggggggggaaggttaaaaaaagggccaaaaaggattttttgcccccaaaaaaattttccaaaaaaattggggttttgggaaaaaaaatttacccccggggccaaacgggaaaaaacctttctcaaaaaaattaaccccgcccaacgggggtgtgaaaaatatttt

SEQ ID NO: 27347 - protein, 85 aa, Zea mays
  misc_feature: Ceres CLONE 1400584-F
  misc_feature (37)..(37): Xaa is any aa, unknown, or other
MALAFDEFGRPFIILREQEKKTRLRGLDAQKANIASXKAVARILRTSLGPRGMDKMLQSPDGDVIITNDGATILKQMDVDTKIQS

SEQ ID NO: 27348 - DNA, 675 bp, Zea mays
  misc_feature: Ceres CLONE 1400587-F
  misc_feature: Encodes the peptide sequence at SEQ ID NO. 27349
  misc_feature (229)..(229): n is a, c, t, g, unknown, or other
  misc_feature (233)..(233): n is a, c, t, g, unknown, or other
  misc_feature (234)..(234): n is a, c, t, g, unknown, or other
  misc_feature (490)..(490): n is a, c, t, g, unknown, or other
  misc_feature (544)..(544): n is a, c, t, g, unknown, or other
aaagctggagctccccgcggtggcggccgctctagaactagtggatcccccgggctgcaggaattcgcacgagaccattacctagaacatcctaatcgaaaaacttggcgctagggtttcccccctctcatttcccctcctcctcccgctccccctggctccccaagcctcgacgcccggctagggttttgcctccttcccgccgccgctgtttcagcgagcgagaccngagnngggtagagaaaagagcggtgcttagccacccatgtcgctgcgtccgagcgagcgggtcgaggtacggcggaaccgctacaaggtggcggttgacgcggaggaggggcggcggcggcgcgaggaacatatggtggagatccgcaagagccgccgtgaggagagcctccctcagaggcgccgtgaggggctcccaaagcccagtccctgcccctcccctcggggtcgagaagaagcttggaaagctcccagctatggntaagtggggtttattcggatgataataaccttcagcttgaggccaccacacagntccggcaaattgctccctaaaaagaaggagtccccccatccgaagaaggtatcaaaacaggggtaggtcccaaaatttgggcagcctccccccaaaaaagaatcccccccagttgaagtttaaagtgaatt

SEQ ID NO: 27349 - protein, 75 aa, Zea mays
  misc_feature: Ceres CLONE 1400587-F
  misc_feature (4)..(76): Pfam Name: IBB Pfam Description: Importin beta binding domain
MSLRPSERVEVRRNRYKVAVDAEEGRRRREEHMVEIRKSRREESLPQRRREGLPKPSPCPSPRGREEAWKAPSYG

SEQ ID NO: 27350 - DNA, 741 bp, Zea mays
  misc_feature: Ceres CLONE 1400595-F
  misc_feature: Encodes the peptide sequence at SEQ ID NO. 27351
  misc_feature (628)..(628): n is a, c, t, g, unknown, or other
  misc_feature (629)..(629): n is a, c, t, g, unknown, or other
aaaagctggagctccccgcggtggcggccgctctagaactagtggatcccccgggctgcaggaattcgcacgagaccattacctagaacatcctaatcaaaaaatccgctccccgccttccgcttccctaccccccgcatcacctaccaacgccgacaccatgggggccttcgcgaatgaggagcaccagttcctcgccgagctcggcctcgcgcagcgcaacccgggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttcgacgccgctaagacatggatggcgattcctgctccaaagcgaggagagatcgttaggcaaatcggtgatgcactgagagcaaagctccatcaccttggcaggcttgtgtcacttgagatggggaaaattcttcctgaagggatcggtgaggttcaggaaatcattgacatgtgtgattatgctgtgggactaagtcgccaactaaatggatccattataccatctgaacgacaatccatatgatgatggaggtgtggatccccttgnnagtgtggtgttatacggcatttatttccctgtgctgtgcttggtcggatgctgcatttgcttggctgtgaaatgtgtcgctggaaagtgctcccacactcactgatactatt

SEQ ID NO: 27351 - protein, 147 aa, Zea mays
  misc_feature: Ceres CLONE 1400595-F
  misc_feature: SWISSPROT Homolog: EC 1.2.1.3 Aldehyde dehydrogenase (NAD(+))
MGAFANEEHQFLAELGLAQRNPGAFACGAWGGSGPTVTSTSPTNNQVIAEVVEASVHDYEEGMRACFDAAKTWMAIPAPKRGEIVRQIGDALRAKLHHLGRLVSLEMGKILPEGIGEVQEIIDMCDYAVGLSRQLNGSIIPSERQSI

SEQ ID NO: 27352 - DNA, 654 bp, Zea mays
  misc_feature: Ceres CLONE 1400604-F
  misc_feature: Encodes the peptide sequence at SEQ ID NO. 27353
  misc_feature (501)..(501): n is a, c, t, g, unknown, or other
aaagctggagctccccgcggtggcggccgctctagaactagtggatcccccgggctgcaggaattcgcacgagaccattacctagaacatcctaatcgaaaaactacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctggcatgaaggtcctcgtcctcgacccccaaaccgttgggatggtgagcgtggtgtacagccagtcggatctgctgcggaaggaggtcttcctcgtcgagaccatggacaacgcctccagctccagggagtccatggcgcacctcaaggccgtctacttcctccgaccctccgctaaacacgtccagaagctccgcaggcacctcgncatgccgcgctttcgcgagtaccacctattctttctcagtatattgagggcccgcagattcaatacttgctgactcggatgaacaggagttgtgcagcagttcaggagtctatgctgatttttgtgcattgacccataccatttcactctcac

SEQ ID NO: 27353 - protein, 111 aa, Zea mays
  misc_feature: Ceres CLONE 1400604-F
  misc_feature (88)..(88): Xaa is any aa, unknown, or other
MVLITLVRDYIDRMLHDIPGMKVLVLDPQTVGMVSVVYSQSDLLRKEVFLVETMDNASSSRESMAHLKAVYFLRPSAKHVQKLRRHLXMPRFREYHLFFLSILRARRFNTC

SEQ ID NO: 27354 - DNA, 721 bp, Zea mays
  misc_feature: Ceres CLONE 1400606-F
  misc_feature: Encodes the peptide sequence at SEQ ID NO. 27355
  misc_feature (565)..(565): n is a, c, t, g, unknown, or other
  misc_feature (606)..(606): n is a, c, t, g, unknown, or other
  misc_feature (614)..(614): n is a, c, t, g, unknown, or other
  misc_feature (627)..(627): n is a, c, t, g, unknown, or other
  misc_feature (671)..(671): n is a, c, t, g, unknown, or other
  misc_feature (697)..(697): n is a, c, t, g, unknown, or other
aaagctggagctccccgcggtggcggccgctctataactagtggatcccccgggctgcaggaattcgcacgagaccattacctagaacatcctaatcgaaaatcttaaatcccacctctccccgtctacgcctcattcgctccagctcgcatcccacagccaagccagttagcccgggagatctccaagaaaccatcttggaatccgagaacgcccagcattcttggtcggccaaggattcgaattccgacgaacggcttctacggccgaaaaaagtccgataatttccgcggggagctcaggaggtgtctcggtctcgggaaccggaggaggaggccgtgggggattgacgagggggcaagatggtgaggctgccgtacacaacggcgctgaccacgctgttcagctacggcctgctcttcgccttcggccagctcagggatttcttccgcaagttcgtcgactggttcaaggccaagaacgtcaaggggtacgcgccgatctgcctgggcctggaggatttctatgtgcgacgcctgtacttgcggatccaggattgctttgntaggccgatcgcaagtgcgccagattcatggtttgatgttngtgagcgnacctcaaaggacnaataacagacactacagcgtacctcgaatacccacagatgcctncacctgggctcctacactaccttggncttgctgcagcagatgagtactgc

SEQ ID NO: 27355 - protein, 88 aa, Zea mays
  misc_feature: Ceres CLONE 1400606-F
  misc_feature: SWISSPROT Homolog: EC 2.3.1.50 Serine C-palmitoyltransferase
  misc_feature (68)..(68): Xaa is any aa, unknown, or other
  misc_feature (82)..(82): Xaa is any aa, unknown, or other
MVRLPYTTALTTLFSYGLLFAFGQLRDFFRKFVDWFKAKNVKGYAPICLGLEDFYVRRLYLRIQDCFXRPIASAPDSWFDVXERTSKD

SEQ ID NO: 27356 - DNA, 672 bp, Zea mays
  misc_feature: Ceres CLONE 1400610-F
  misc_feature: Encodes the peptide sequence at SEQ ID NO. 27357
aaagctggagctccccgcggtggcggccgctctagaactagtggatcccccgggctgcaggaattcgcacgagaccattacctagaacatcctaatcgaaaaaatgtcaaatctctcgcgagcgaggcagacccacgggccgcggccatctcacggtggaagcagccaagcagccggcctggcgcccctccccttccgtcccgccgctgctgccgtgcctcgtgcctgccagcggcggatgccgccccgccccgctgctgaccaccgccgctgctgagcatggccgccgctcccgcgggcgctcagaaccgctgcgtcttcgttggcaacataccatatgatgcgacggaggagcagctcgtgcagatttgcgaagaagtcggcccagtcgtatccttcagattggtgattgacaaagacaccggcaagccaaaagggtatggcttttgcgagtacaaggatgaggaaactgctttaagtgcacgccggaacccctcagggttacgagattaatggtcgtcagttacgggttgattttgctgaaagggggaggaaccctgatagaaatagagaaaagggtcgtgggagggaccggggatggcatcctaaaggttgataatcaaaaaacgggttacctggggaacttcctgttggtgggaaaacacaaacctt

SEQ ID NO: 27357 - protein, 77 aa, Zea mays
  misc_feature: Ceres CLONE 1400610-F
  misc_feature (13)..(75): Pfam Name: RRM_1 Pfam Description: RNA recognition motif. (a.k.a. RRM, RBD, or RNP domain)
MAAAPAGAQNRCVFVGNIPYDATEEQLVQICEEVGPVVSFRLVIDKDTGKPKGYGFCEYKDEETALSARRNPSGLRD

SEQ ID NO: 27358 - DNA, 752 bp, Zea mays
  misc_feature: Ceres CLONE 1400613-F
  misc_feature: Encodes the peptide sequence at SEQ ID NO. 27359
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (19)..(19): n is a, c, t, g, unknown, or other
  misc_feature (21)..(21): n is a, c, t, g, unknown, or other
  misc_feature (22)..(22): n is a, c, t, g, unknown, or other
  misc_feature (39)..(39): n is a, c, t, g, unknown, or other
  misc_feature (40)..(40): n is a, c, t, g, unknown, or other
  misc_feature (51)..(51): n is a, c, t, g, unknown, or other
  misc_feature (78)..(78): n is a, c, t, g, unknown, or other
  misc_feature (81)..(81): n is a, c, t, g, unknown, or other
  misc_feature (85)..(85): n is a, c, t, g, unknown, or other
  misc_feature (108)..(108): n is a, c, t, g, unknown, or other
  misc_feature (618)..(618): n is a, c, t, g, unknown, or other
  misc_feature (750)..(750): n is a, c, t, g, unknown, or other
nnnnnnnnnnnaagggggncnncaccacaccaggggggnnggtgccggggncccatggctgggactccctgggggggnggngggncttccctaggggatcccccgggnggcaggatcccccacgagaccattacctagaacatcctaatcgaaaaaccaaagtccaagcaccttcccaaaaaatcccccattttcttcgaggcgaggagagcgtgaaagacagggcaccggcagcgacgatgtcggggcgcggcaagggcggcaaaggtctgggcaagggcggagcaaagcgccaccggaaggtgctccgtgacaacatccagggcatcaccaagcccgccatccggaggctggctcggaggggcggcgtgaagcgcatttcggggcttatctacgaggagacccgcggcgtcctcaagatcttcctcgagaacgtcatccgcgacgccgtcacctacaccgagcacgcacgccgcaagactgttaccgccatggacgtcgtctacgcgctcaagcgccagggccgaaaccctctacgggttccgagggcaagctgggatgccctcctcctccttgctggccgggaatgcccggtttgttggtaagggtaacctccgnttaaatcccttgggccggggaccggggttggaaaaaatgggtaagaaaaaaattccctgggaaagtggggggtttcccaaaagggtaaacccaaatctttaatagggtgtccgaaaaaaaaaaaaaccgagncg

SEQ ID NO: 27359 - protein, 121 aa, Zea mays
  misc_feature: Ceres CLONE 1400613-F
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRNPLRVPRASWDALLLLAGRECPVCW

SEQ ID NO: 27360 - DNA, 734 bp, Zea mays
  misc_feature: Ceres CLONE 1400614-F
  misc_feature (504)..(504): n is a, c, t, g, unknown, or other
  misc_feature (608)..(608): n is a, c, t, g, unknown, or other
  misc_feature (624)..(624): n is a, c, t, g, unknown, or other
  misc_feature (642)..(642): n is a, c, t, g, unknown, or other
  misc_feature (643)..(643): n is a, c, t, g, unknown, or other
  misc_feature (645)..(645): n is a, c, t, g, unknown, or other
  misc_feature (734)..(734): n is a, c, t, g, unknown, or other
gctctataactagtggatcccccgggctgcaggaattcgcacgagaccattacctagaacatcctaatcgaaaagaatcgaatcgcgaccaaaccaaatcctccaccccggcgcgctgccccatcacccttcccgctgtgctcacgcaccaaaccccactccgttcctcactgcaatccaccgccccagctctttcgcgcaatggcaggcgtcgcggcacgtgcgccgccaccgccgcgggagctgagcctgcacgacctcaggagctgtccttgctcgggccgagagaacaagatttcgtgttccacgtccagcagactccccggggaaacccaaggtcctaggccgaagaaggccacccaaaaacgccggaaaatgtatatcgaaggcctgcaccccccggaaatgctatagccccccccaggaaacggccggcttcccgcgcgcaagggggaaccggggtcccagaacccatccaccagaccttgagggaaaaacagaggntccgagagcaagacctcacacacctgcaagataccccgttcacaccccggaacagctcccccccggcccacaccgacccccagaaaaatcccctcctctccaantcgagagaaaccaggngtcaacaccaccacaggnntnggagagaagaaactcctctggacatgcggtgggcggaggtggcaaaagggtataaatcaaaacccctggtttcatctcccccaacccan

SEQ ID NO: 27361 - DNA, 752 bp, Zea mays
  misc_feature: Ceres CLONE 1400615-F
  misc_feature: Translation starting site: 146
  misc_feature (482)..(482): n is a, c, t, g, unknown, or other
  misc_feature (493)..(493): n is a, c, t, g, unknown, or other
  misc_feature (683)..(683): n is a, c, t, g, unknown, or other
  misc_feature (690)..(690): n is a, c, t, g, unknown, or other
caaagctggagctccccgcggtggcggccgctctagaactagtggatcccccgggctgcaggaattcgcacgagaccattacctagaacatcctaatcgaaaactccccgcccctccgcagccgcagtgccgcagcatcgtcgccatggctctcctcaagaactccctcatgctccaggggcggttgcgccatgcggcggcggcgctcactgcgcggcgccacgcggcgacgtcgacggaagagtacgcgcgccggaactacgccgataacaactccgagtacaacacggtcatcggatcgctcgtcgctcagcgcaggccctaccttctgcgtgatgcttacgacgacatgatgcttgatggcgtgaagcctgagcgggaaacattccacacactcatagtcggtaccatgaaaggcagccggctacaagatgcgctttacttccgtgatcagatgaaagaaatgggtttgaagcctgatngtaacctttancacttcttgatctccacttgtggaaaatgcaagaactcagatgcagcaatcatgcttttagaaagaatgaaggcacatgatgttaaagtgaaaggagaacctacatttgtctactggatgcacttgcatcaacagggcaaactgatcaaagttatgcccatagtagtgatatgagtgctgctggacttgnattaaanagttttgttatgctggattgatactgcattcaagaacagacaccaccactgatgaactatgg

SEQ ID NO: 27362 - DNA, 726 bp, Zea mays
  misc_feature: Ceres CLONE 1400617-F
  misc_feature: Encodes the peptide sequence at SEQ ID NO. 27363
  misc_feature (433)..(433): n is a, c, t, g, unknown, or other
  misc_feature (455)..(455): n is a, c, t, g, unknown, or other
  misc_feature (483)..(483): n is a, c, t, g, unknown, or other
  misc_feature (484)..(484): n is a, c, t, g, unknown, or other
  misc_feature (587)..(587): n is a, c, t, g, unknown, or other
  misc_feature (665)..(665): n is a, c, t, g, unknown, or other
aaagctggagctccccgcggtggcggccgctctagaactagtggatcccccgggctgcaggaattcgcacgagaccattacctagaacatcctaatcgaaaagtactcccgtgcgctagtgcgctcggcgctgcccccgtccgcccgcagtccgtccccgctcgccgcccatgcgctcgccggccgcccctcggcgctcccccatctcctcccgctccgcccccgccctccgtctggtagtccgtcgccgctcctcccgcacgccagcacgacctagtagacggctcgaagcgaagacggtcccatttccagtctccgtggtcaagatggatttagaggtatccggagggttcaggtactaatgccacctcggatgaccaatcggtgcaaacgttgcctagaagggcaaagctttttggagtattttcaaccnggagttagttgaggtcaatggncgtgatgaaggctatttgcaaatattgnncggggcgatgttgaggagttcaagcacaaatagccttagaaaccacgttgcggatacatgtcttaaaatttcagttgaggaccgcaagcaattcattgctacnatggaaaaaggaccagcggaagctttcatttgtgtttgactctcaaaggctcgtgagggtatggttaagtggtgcatnagtgccgaggtcgcattcaacaagtttgacgatcctttctttgctcagtggatggagtcaa

SEQ ID NO: 27363 - protein, 63 aa, Zea mays
  misc_feature: Ceres CLONE 1400617-F
MRSPAAPRRSPISSRSAPALRLVVRRRSSRTPARPSRRLEAKTVPFPVSVVKMDLEVSGGFRY

SEQ ID NO: 27364 - DNA, 737 bp, Zea mays
  misc_feature: Ceres CLONE 1400618-F
  misc_feature: Encodes the peptide sequence at SEQ ID NO. 27365
  misc_feature (485)..(485): n is a, c, t, g, unknown, or other
  misc_feature (599)..(599): n is a, c, t, g, unknown, or other
aaagctggagctccccgcggtggcggccgctctagaactagtggatcccccgggctgcaggaattcgcacgagaccattacctagaacatcctaatcgaaaagttagctgtgcctgctcccatttggagggacgaagttttatcctgtggttactgcctgtcgatgtcaagcaatttttatgtactctagagattagtttggctgcatcctccgtatctttaccttgttgaccagggatggagcttgtatacatggaaaggagaaacggatcgtacgacggatggcgcgggtccagagttcagtggaaggggggctggaggggatcaggatcaggacccgtccgctgctgcatccgaggtccagtctgactcgcgtcagacaccggacgagaagaagagcaagggctgccaatcatgccgtgacccattctgttcatgcagcggcggcacaccccactcggaactgttccccccacatcctgccnagatgatgatcctggagttcctcgtcgcgagcctcaggcacccgacaagaacccacaacatcagtgatctcgacgaccggatccgccgacggggtcagcccaagggagcggggnaaacctcggcccttctgagaagaaggggctggaatctctggacgccatggtaaacgcccagacgaggccgaaaagcccgtcgcccgttaatggcgggaatttagctgagggaaaacccggccaagtcccacggtttat

SEQ ID NO: 27365 - protein, 54 aa, Zea mays
  misc_feature: Ceres CLONE 1400618-F
  misc_feature (38)..(38): Xaa is any aa, unknown, or other
MMILEFLVASLRHPTRTHNISDLDDRIRRRGQPKGAGXTSALLRRRGWNLWTPW

SEQ ID NO: 27366 - DNA, 749 bp, Zea mays
  misc_feature: Ceres CLONE 1400620-F
  misc_feature: Encodes the peptide sequence at SEQ ID NO. 27367
  misc_feature (521)..(521): n is a, c, t, g, unknown, or other
  misc_feature (524)..(524): n is a, c, t, g, unknown, or other
  misc_feature (727)..(727): n is a, c, t, g, unknown, or other
tccccgcggtggcggccgctctagaactagtggatcccccgggctgcaggaattcgcacgagaccattacctagaacatcctaatcgaaaaagtctatcttctcggctcgcacacctcagacacagccaggcagcggagcgctcccccttcccctcgattctttcgcttccttctagaaccttccgctccctccgctgcaacagtaacactgagcttcctcctcctcccaccccgaagatgacgaccatggagaacgtgatcgtgctcgtgaaccgcatccagcgtgcctgcaccggtcctcggcgaccacggggggggggggacgccgccgcctccctccctaccctctgggaaggcctcccgacggtcggcgggcgtcggggggtcaagagtttcggggaaatcatcgggtggtcgagaaggatccggggggcggagacttcctgccttcgaaggaatcaagggatccgggacgcgtaaggccactccgtcctgcagctgcacaagacagaaggccggnagngcaggaggaatggccaagttccttcacatgcctaagcgccgcttccctgatgtctcctattggggcggaaggaaatccaggatgaaacctgacaggatggctgggaaagacaaagaggatatcctccgggtccaattcatctcagcaaataccctcccaatgggggcaattaaaccattgagttgatctgcccggcccaaccnagagggtgcgagggagggggcg

SEQ ID NO: 27367 - protein, 80 aa, Zea mays
  misc_feature: Ceres CLONE 1400620-F
MTTMENVIVLVNRIQRACTGPRRPRGGGDAAASLPTLWEGLPTVGGRRGVKSFGEIIGWSRRIRGAETSCLRRNQGIRDA

SEQ ID NO: 27368 - DNA, 736 bp, Zea mays
  misc_feature: Ceres CLONE 1400622-F
  misc_feature: Encodes the peptide sequence at SEQ ID NO. 27369
aagctggagctccccgcggtggcggccgctctagaactagtggatcccccgggctgcaggaattcgcacgagaccattacctagaacatcctaatcgaaaaaagaagagccgccctacctattccttctccccgccgtcgagctgcccaacccagagcaccagcagccctcacctccttcctctcggccggtccttccaacgagcccgctggtcttggagccgccgccggtctcgttctggacgaacgttcaaggagattgcatttgtggatgctctaatggagtcgaaaggtggcaagaagtctagtagtagtaatagtaatttcatgtacgaagctccccttggctacaagatcgaggacgttcgcccagccggaggaatcaagaagttccagactgctgcttattccaactgcgtccgccagccatcctgatatcgcctcacatgcaattcgcagtagagtaggattttaattcagttttcctcttgtgtcggtagttctccgttggctctggctgccatcctctgcttctgagattccaacttgtcttaaccatctctccttttcctctctcatcctctctttcttgcaaacgtctccaaaagggggatggcttcagcaaaattcctggggtctcttctcctgcctcccctattggggttttgagggctatgagaagcgccccgagatccggttccctgacgcgccttggcttgagggacccctttgggggc

SEQ ID NO: 27369 - protein, 51 aa, Zea mays
  misc_feature: Ceres CLONE 1400622-F
  misc_feature (1)..(51): Pfam Name: AdoMetDC_leader Pfam Description: S-adenosyl-l-methionine decarboxylase leader peptide
MESKGGKKSSSSNSNFMYEAPLGYKIEDVRPAGGIKKFQTAAYSNCVRQPS

SEQ ID NO: 27370 - DNA, 730 bp, Zea mays
  misc_feature: Ceres CLONE 1400625-F
  misc_feature: Encodes the peptide sequence at SEQ ID NO. 27371
  misc_feature (360)..(360): n is a, c, t, g, unknown, or other
  misc_feature (413)..(413): n is a, c, t, g, unknown, or other
  misc_feature (414)..(414): n is a, c, t, g, unknown, or other
aaaagctggagctccccgcggtggcggccgctctagaactagtggatcccccgggctgcaggaattcgcacgagaccattaccagaacatcctaatcgaaaaccccttctatgcgcgcaagccaccttctttccccgtgagatcgacgcacctccccctctcgtgcttcattcccgctcgtcgttcgtttcttcggccccgagccgtcgcgcggtcgcctccacatctcgtcgtgctttaaggtctttggcctccgccgttcttggacaggggcacaccactgtccaccggtgcccactacgcgaaatacgagtccctcgtgcggctccgtaggggtggaagagatccatcaggcggtgnagtgggaaggggcggcgccacacaccggaggggggagagggggcaaatggcgnnccgtggcaggcccactctgcacgtggctcggtcgccgcgtgcttaatctgcggcatggcgacgcttgaagagcacaagcagaagcattttctgcgcaggcggaagccgcgctggggggggccggtgtcatgctcggccagcgccgccgcctcggcgcgcgggcgtcgcggcttggcgcgctctggatggactatggctgttgccttacaagctgaaagaagtgtcattgaaaagaagaacccgatatcaacaaaggggagggtggttgtcactggcatgggtgtagtgacccattgggccatgatcctgacgtgtt

SEQ ID NO: 27371 - protein, 87 aa, Zea mays
  misc_feature: Ceres CLONE 1400625-F
MATLEEHKQKHFLRRRKPRWGGPVSCSASAAASARGRRGLARSGWTMAVALQAERSVIEKKNPISTKGRVVVTGMGVVTHWAMILTC

SEQ ID NO: 27372 - DNA, 734 bp, Zea mays
  misc_feature: Ceres CLONE 1400628-F
  misc_feature: Encodes the peptide sequence at SEQ ID NO. 27373
aagctggagctccccgcggtggcggccgctctagaactagtggatcccccgggctgcaggaattcgcacgagaccattacctagaacatcctaatcgaaaaatctctctcgctttctctagccatgacgctggagaggatgccttgccgcctctggtggttcctgctcggcgtcgccgcctccgccgtctccggccgggggcgggtggtcaccaccctcccgagctacgaggaccgcctccccttccacctcaaaacaggttatgtggaggtggactaggacgccggcgcggagctcttctactacttcgtccgggccgagtccggcgccgacgacagcgacaccccgttcgacctccagatccccggaggtcaacgctgctcctccttcagcgatctcgtctacgagatacgtcccatcgtgtttgtcgcgcaaccctacaacggaaggttgccgcgcctgcgctacaacccaaactcgtggacaaaggtggcgcatattctttttgagcattcaccagtcgtggccagccttttcctactccaggagatgccaaaggcttctacgctggagcgaaatcaaccacgatgcacttgcccgagttcctcagcaggtgggtcattggccatcccgagcaccatgaaaaccctttctacctccaatgaagaagcctactccggaaaaattgtaacgttccttgaacaaatgtttgccaaaggtatttgaccacgaat

SEQ ID NO: 27373 - protein, 51 aa, Zea mays
  misc_feature: Ceres CLONE 1400628-F
MTLERMPCRLWWFLLGVAASAVSGRGRVVTTLPSYEDRLPFHLKTGYVEVD

SEQ ID NO: 27374 - DNA, 717 bp, Zea mays
  misc_feature: Ceres CLONE 1400638-F
  misc_feature: Encodes the peptide sequence at SEQ ID NO. 27375
  misc_feature (424)..(424): n is a, c, t, g, unknown, or other
  misc_feature (434)..(434): n is a, c, t, g, unknown, or other
  misc_feature (435)..(435): n is a, c, t, g, unknown, or other
  misc_feature (579)..(579): n is a, c, t, g, unknown, or other
aaagctggagctccccgcggtggcggccgctctagaactagtggatcccccgggctgcaggaattcgcacgagaccattacctagaacatcctaatcgaaaacctgttccctccccgagtcgatatctcaccgtcgtgcgagtaaaacaaagcctcgccgccacggcgccacgcgagcaaagacctagcgcgagcaagcaagggaggcagagaccttagtgcgtcgcgcaacgcggctcggaccgacggcatggagagcctcgtcctcgcctcctcctgctccccgtccccacggctgccgctactctcccccttcgcccgcttccggcgggtgtccggctccatgccacagggcgccggcgttcaccagcgctgccaacgcggaaaggtcccaggaggcacatggctcattcgtcgccgccgnccaccgcgannccccttccggatccagggaacgttttttcaaggaattgagagcaaaaggcttttgcagcatgtcatccttcgactggcaaatgagaatatgtctactggaaactggcaccctggcttccatgcctccccatcataaaacatggntcacctgttttcttgggttgggagttgggggaaacattgcctggggcgtttaccagggtttctttcatggttaagaaatttgccgggaaacaggcttttaaggcagggggggccccgggccccccaaatctttttggt

SEQ ID NO: 27375 - protein, 106 aa, Zea mays
  misc_feature: Ceres CLONE 1400638-F
  misc_feature (62)..(62): Xaa is any aa, unknown, or other
MESLVLASSCSPSPRLPLLSPFARFRRVSGSMPQGAGVHQRCQRGKVPGGTWLIRRRRPPRXPFRIQGTFFQGIESKRLLQHVILRLANENMSTGNWHPGFHASPS

SEQ ID NO: 27376 - DNA, 755 bp, Zea mays
  misc_feature: Ceres CLONE 1400643-F
  misc_feature: Encodes the peptide sequence at SEQ ID NO. 27377
  misc_feature (132)..(132): n is a, c, t, g, unknown, or other
  misc_feature (311)..(311): n is a, c, t, g, unknown, or other
  misc_feature (351)..(351): n is a, c, t, g, unknown, or other
  misc_feature (400)..(400): n is a, c, t, g, unknown, or other
  misc_feature (421)..(421): n is a, c, t, g, unknown, or other
  misc_feature (456)..(456): n is a, c, t, g, unknown, or other
  misc_feature (500)..(500): n is a, c, t, g, unknown, or other
  misc_feature (605)..(605): n is a, c, t, g, unknown, or other
  misc_feature (606)..(606): n is a, c, t, g, unknown, or other
  misc_feature (618)..(618): n is a, c, t, g, unknown, or other
aagctggagctccccgcggtggcggccgctctagaactagtggatcccccgggctgcaggaattcgcacgagaccattacctagaacatcagctcaacagccaccggagagcacggaggaaaagcatctccnaaaaccctagctcccatcccctcgctgggaagtctcgtcggcggcggcggcggagatgggcaaggcgaaggggaagcagcgtcaggacaagttctaccacctcgccaaggagcaagggtaccggagtcgcgcggcgttcaagctgctccagctcgacgcgcggttccgcttcctcccgnacggcgcgctcggtgcttgacctctgcgccgcgccggggnagggtggggtccaggtggccgtcaaccatgctcccgtgggtggccttcngttgggtcggcgttgacctcngttcccatacgcccccatccgcggggcccactcgnctcaccgaggacatcagccgccaccaagtggccgcgcccgcggntgggcggaggctcatgggactccaacggcgtctcccgcttttcgacgtcgtgcctccacgacgggtcgccccaaacgtcgggtgggtgcctggggcgcaggaggnntaacatcgcagnccggcggctcgtcatagacgcactggcgcctcgctaccatgttcctcgctcccaagggcgcttttcatcacgaaaggtttttaggtctcaagattacaacgctattatgtactggtcttaaacaggttgtttgagaa

SEQ ID NO: 27377 - protein, 47 aa, Zea mays
  misc_feature: Ceres CLONE 1400643-F
  misc_feature (42)..(42): Xaa is any aa, unknown, or other
MGKAKGKQRQDKFYHLAKEQGYRSRAAFKLLQLDARFRFLPXGALGA

SEQ ID NO: 27378 - DNA, 759 bp, Zea mays
  misc_feature: Ceres CLONE 1400644-F
  misc_feature: Translation starting site: 254
  misc_feature (558)..(558): n is a, c, t, g, unknown, or other
  misc_feature (646)..(646): n is a, c, t, g, unknown, or other
  misc_feature (647)..(647): n is a, c, t, g, unknown, or other
caaagctggagctccccgcggtggcggccgctctagaacaagtggatcccccgggctgcaggaattcgcacgagaccattacctaaaacatcctaatcaaaaaattaatttccaggcgacgtacgcaggcaagtttaatttggaggatcaatggtagctatctagagctactacagaaatacatggcgtatcctctgatgcgagcgcgacccagaaggaagaaggtcttaacgtactacttggtgcgactccgatggattcctgccctcttcgtgtcccttccagtatctgcgctgatctacctgagcgtcttcctggggaacacgtggtccgccatgaaatccgagaagcgtcgacagaaggaacaccaggagaacgtagagaggctgagagggtcgtgaagcgtctcaaggagagggatccgaagagggacggcctcgtctgcaccgcgggaagccatgggttggtcgtgggcatgcgcaacgtggactacaagcgcgcaaacggcttcgaggtcgacctctccgcgttgaggaacatcctcgagatcgacgccgnagaggatggtcgcccagggtggagtctctcgtcagcatggcccagataaccaaggctacctgccccatgaacctctcgctcgccgtgnntcctgagttgacgacctttaccgttcggggtctgataaacggctacggggatttcggggagctctcacgtctacggcctcttctctgacacggttgtcttccttggagtctg

SEQ ID NO: 27379 - DNA, 739 bp, Zea mays
  misc_feature: Ceres CLONE 1400645-F
  misc_feature: Encodes the peptide sequence at SEQ ID NO. 27380
  misc_feature (430)..(430): n is a, c, t, g, unknown, or other
  misc_feature (458)..(458): n is a, c, t, g, unknown, or other
  misc_feature (468)..(468): n is a, c, t, g, unknown, or other
  misc_feature (469)..(469): n is a, c, t, g, unknown, or other
  misc_feature (472)..(472): n is a, c, t, g, unknown, or other
  misc_feature (473)..(473): n is a, c, t, g, unknown, or other
  misc_feature (489)..(489): n is a, c, t, g, unknown, or other
  misc_feature (490)..(490): n is a, c, t, g, unknown, or other
  misc_feature (521)..(521): n is a, c, t, g, unknown, or other
  misc_feature (610)..(610): n is a, c, t, g, unknown, or other
  misc_feature (611)..(611): n is a, c, t, g, unknown, or other
  misc_feature (678)..(678): n is a, c, t, g, unknown, or other
aagctggagctccccgcggtggcggccgctctagaactagtggatcccccgggctgcaggaattcgcacgagaccattacctagaacatcctaatcgaaaaaaaaaggcactgctcatcgatccggcactacgccacagaatcctctcctactccggcagttctgctcgccgccgcctccacgatgacggaagacgtgcagatgaacgactcggagccccagcctgcggtctcagctcccgccgtcggggcgccggcgctctccacactacaccatctgaaggagatcgcgtccgtgatcgaggccggttctctggttccaggagggtctgccggatctcccgtgccttccgtctcaccgtcgctgctccgtgtcgcgttcgccggggggtggaggtctccgtcttcctcgccttcgctgctacccgcgntcctccgaagccctacggacgcctcacntgccctgtgnnacnnaggaagatgatagtgnnaaacggaaatgttgatggctgcagctccagnaaactcagatttcaatcaaagatgctctcccctgagagttgaaatatattgctacttggctcgtactgattttccttattgatcataannaaaatatgaatgagggctatgcaatgcgcagggtgtgagccatgctcgcctggagatctagaccganaaaatggtggtgaggttttggaatcacgactggacttcaatactcttaagggggatgagct

SEQ ID NO: 27380 - protein, 99 aa, Zea mays
  misc_feature: Ceres CLONE 1400645-F
  misc_feature (83)..(83): Xaa is any aa, unknown, or other
  misc_feature (92)..(92): Xaa is any aa, unknown, or other
  misc_feature (95)..(95): Xaa is any aa, unknown, or other
  misc_feature (96)..(96): Xaa is any aa, unknown, or other
  misc_feature (97)..(97): Xaa is any aa, unknown, or other
MTEDVQMNDSEPQPAVSAPAVGAPALSTLHHLKEIASVIEAGSLVPGGSAGSPVPSVSPSLLRVAFAGGWRSPSSSPSLLPAXLRSPTDASXALXXXGR

SEQ ID NO: 27381 - DNA, 747 bp, Zea mays
  misc_feature: Ceres CLONE 1400646-F
  misc_feature: Encodes the peptide sequence at SEQ ID NO. 27382
  misc_feature (382)..(382): n is a, c, t, g, unknown, or other
  misc_feature (391)..(391): n is a, c, t, g, unknown, or other
aaagctggagctccccgcggtggcggccgctctagaactagtggatcccccgggctgcaggaattcgcacgagaccattacctagaacatcctaatcgaaaaacgagctctccatcttgccatctgctcctatttctgtcgcgagctggatgagggcatgatacagttcacgggatctggctccccgacggccaattcttcatctcgccttcgaaaacccggtccttgtcgggccgtcggactggagggaccacgccgccggcaaggaaggggtccagaggtaccgcatccgcaacctcccggacaacttccccggcctctacgagctaggcgttgcctgcgcggccgacgagggcgtcaggtcccggaggcgtgacgcgcngaggcgtcntcgtggtgtacctcggccaggccgacagtgtccgggcgaggctgcagcagtatggcccgctcggggtcgcatctggacactacgaactcgccgggctcttctgatagagatgcggcgaatgcgctcgccgagggtcctggatctttcagagaagtgttctccagaggctactccgtcgtggttcgatgtgcgctgatggacaataaacaagaagctgagaagactgaagcactactcctgagagtatttgattatgcatggaacaagcttcagaatggggcttgtcgccggcaagaaatactgcataagttagaactgcgagcagccaaccataggtctctacttagcagaggagg

SEQ ID NO: 27382 - protein, 101 aa, Zea mays
  misc_feature: Ceres CLONE 1400646-F
MARSGSHLDTTNSPGSSDRDAANALAEGPGSFREVFSRGYSVVVRCALMDNKQEAEKTEALLLRVFDYAWNKLQNGACRRQEILHKLELRAANHRSLLSRG

SEQ ID NO: 27383 - DNA, 751 bp, Zea mays
  misc_feature: Ceres CLONE 1400647-F
  misc_feature: Encodes the peptide sequence at SEQ ID NO. 27384
  misc_feature (637)..(637): n is a, c, t, g, unknown, or other
  misc_feature (638)..(638): n is a, c, t, g, unknown, or other
  misc_feature (751)..(751): n is a, c, t, g, unknown, or other
aaagctggagctccccgcggtggcggccgctctagaactagtggatcccccgggctgcaggaattcgcacgagaccattacctagaacatcctaatcaaaaaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggcggaatctcccgggacgcctctccgtccgcgcctccgcgacggtggtagcggcaccgcggcgggagacggatcccaagaagcgggtggtgatcacgggaatggggctggtctccgttttcgggaacgatgtagacgcttactacgaccgcctgctagtcggggagagcggcatcgggcccatcgaccgcttcgacgcttctaagttccccacccgctttgccggtcagatccggggcttctcctccgagggatacatcgacggaaagaacgaccggccgccttgatgattgcctccgatactgcatcgtcggtggcaagaaggctctcgaggcctccggtatcgcccacggctccnnagcccatggaaaagattgacagaccccgggcccggtgtgcttgtgggcactgggtatgggtgggcctcacgggggtttttcggatggtgtccagaatcctcattgaggagggn

SEQ ID NO: 27384 - protein, 114 aa, Zea mays
  misc_feature: Ceres CLONE 1400647-F
  misc_feature: SWISSPROT Homolog: EC 2.3.1.41 Beta-ketoacyl-acyl-carrier-protein synthase I
MQSLLLPTAAVAPVAPPCGRRNLPGRLSVRASATVVAAPRRETDPKKRVVITGMGLVSVFGNDVDAYYDRLLVGESGIGPIDRFDASKFPTRFAGQIRGFSSEGYIDGKNDRPP

SEQ ID NO: 27385 - DNA, 737 bp, Zea mays
  misc_feature: Ceres CLONE 1400648-F
  misc_feature: Encodes the peptide sequence at SEQ ID NO. 27386
  misc_feature (320)..(320): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (529)..(529): n is a, c, t, g, unknown, or other
  misc_feature (578)..(578): n is a, c, t, g, unknown, or other
aaagctggagctccccgcggtggcggccgctctagaactagtggatcccccgggctgcaggaattcgcacgagaccattacctagaacatcctaatcgaaaaataaaaatttcgtttttctcctctcagtctccgacgccgccgcactcatccccccagacgaccaccctcctcctcctcccccacccacctcgccggaaccctagcgccgaccgcctgccgtgcccatcgacggcgatcgcattgctgcgccccgatggcgacccgcgcctccaagaattgcctctgcgcgggcagctcttcgttcgatgaccccgcgntgggtcgaggtgtctccggaaccgccgggttgnnnngggggggggccctccggccacaaaaggaggaggcggagccaggttgtaccgcaagaagtgattgaaatcgatgatgatgatccgtgatggaggcactacttattggtgataaagcacaggtggaaaagaataagcaaactgctgtagttcccatggattgctcaagcatgccnagaaattggttgggttcaggacatccctggtccaagcacatatgcttcnaaatataccaggttcctgggttggacctgaaagtgtttcagggacgaggcagtttacaactattctgatggctaccccctttgatggatttgaagaagactatgcttatgatgaagatgagtttggaggatgatggttatgacactccactcattgaag

SEQ ID NO: 27386 - protein, 44 aa, Zea mays
  misc_feature: Ceres CLONE 1400648-F
  misc_feature (15)..(15): Xaa is any aa, unknown, or other
  misc_feature (16)..(16): Xaa is any aa, unknown, or other
MTPRWVEVSPEPPGXXGGGPSGHKRRRRSQVVPQEVIEIDDDDP

SEQ ID NO: 27387 - DNA, 737 bp, Zea mays
  misc_feature: Ceres CLONE 1400649-F
  misc_feature (415)..(415): n is a, c, t, g, unknown, or other
tggagctccccgcggtggcggccgctctagaatagtgtcatcccccgggctgcaggaattcgcaccacaccactacctagaacatcctaatctaaaaagaacaaccaaacgaaccctcccggatcagcaaagcataaggcgcttcgagcgcttccctccccgagctccctccgcctcacggtccacgcctcgtgtccccccacccacctcctcctccttcctcggtcggccgcctcacgccgtcacctccgcttcggcgagtctcggctccgaccgcttgccgccacgtgcgacctcccctaactcctgagagatctgcgtggctcgtcatggggtgaccagatcgcgtcgctgcttcgtgctttccagctgaatttgtccgcagctcgtgtcgatgcagcgaaaatgtcgaagnctgcttgtaacgcggctcagggagcgctggctatgctttgtcaggaactctgcatgctgtggtgggcccgttgtcacgtgctccccaagggagttgtttatactccccccagggcaattgaacgcttgaagggctaacgatcacacttgatccacattggcttttttaaccaacgcaaaaacccctgggaggggggcagggaaaatttagggggaacggttttgggagaaatttttcccaaatttaggccaccccaaaaaggaaagggggccccccccccaaattggaacccccgggggcggaaagaggacattcttctcct

SEQ ID NO: 27388 - DNA, 767 bp, Zea mays
  misc_feature: Ceres CLONE 1400650-F
  misc_feature: Translation starting site: 194
  misc_feature (378)..(378): n is a, c, t, g, unknown, or other
  misc_feature (476)..(476): n is a, c, t, g, unknown, or other
  misc_feature (603)..(603): n is a, c, t, g, unknown, or other
  misc_feature (658)..(658): n is a, c, t, g, unknown, or other
  misc_feature (659)..(659): n is a, c, t, g, unknown, or other
  misc_feature (667)..(667): n is a, c, t, g, unknown, or other
  misc_feature (732)..(732): n is a, c, t, g, unknown, or other
  misc_feature (733)..(733): n is a, c, t, g, unknown, or other
caaagctggagctccccgcggtggcggccgctctagaactagtggatcccccgggctgcaggaattcgcacgagaccattacctagaacatcctaatcgaaaaaaaccctaaccccatcccgcactccccccctcccccaacacgcgcgtgctttcttagccgctaagcatatccctccccgccacgatctcgatggtggagatgtctgtggtggagctcaggacgctgccgctcggcttccgcttccaccccaccgacgaggagctcgtcacccactacctcaagggcaagatcaccggcaggatcaactccgagtccgaggtcatccccgagatcgacgtctgcaagtgcgagccgtgggacctcccagataagtncctgatccggtccgagaatcctggagtggttcttcttcgcccccaaggaccgcaagtaccccaacggtagcaggtcgaacagggccaccgaggcgggnatactggaaggctactggcaaggacaggataatcaaatccaagggcgacaagcgcaagcagcataccatcgggtatgaagaagaccctcgtcttccaaccgtggtcgtgcccccaaggcgaggggcncgggggggtggtttatgcacgagtaccgcacaccgagccctgaattcgagccgcnnaggaaagngggggggtttatgtttctttatccgcctcttccgtaagcaagaagaggaaaactgagcgctccgnncccagagaaaaggggaatagaagtggctactcac

SEQ ID NO: 27389 - DNA, 754 bp, Zea mays
  misc_feature: Ceres CLONE 1400651-F
  misc_feature (453)..(453): n is a, c, t, g, unknown, or other
  misc_feature (621)..(621): n is a, c, t, g, unknown, or other
  misc_feature (656)..(656): n is a, c, t, g, unknown, or other
  misc_feature (657)..(657): n is a, c, t, g, unknown, or other
  misc_feature (670)..(670): n is a, c, t, g, unknown, or other
  misc_feature (672)..(672): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (691)..(691): n is a, c, t, g, unknown, or other
  misc_feature (717)..(717): n is a, c, t, g, unknown, or other
  misc_feature (719)..(719): n is a, c, t, g, unknown, or other
  misc_feature (720)..(720): n is a, c, t, g, unknown, or other
  misc_feature (722)..(722): n is a, c, t, g, unknown, or other
  misc_feature (723)..(723): n is a, c, t, g, unknown, or other
  misc_feature (730)..(730): n is a, c, t, g, unknown, or other
  misc_feature (733)..(733): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (749)..(749): n is a, c, t, g, unknown, or other
  misc_feature (750)..(750): n is a, c, t, g, unknown, or other
caaagctggagctccccgcggtggcggccgctctagaactagtggatcccccgggctgcaggaattcgcacgagaccattacctagaacatcctaatcgaaaagtatcgtctcctctccttcctgacattggcactggcagctgcactcaccggaagccatggaagacttgctctactactccctcaccatagccatctgcatcgcagtcatcgccctcctctccatccttcgttcggtcaccgctaccggacgggcgccggagctcccgcccggggccgtcgctgctgtagctgatcaccccgctcctcttcctcggccgaacgaacttcggcatcgagcggatcctccccgccgcgcggtcccgctacgggcccgtcttcacgctctacctgctcccgtcccgcccggtcatcttcatcgccgaccacgccgtggcgcaccgcgtggctgntgcagggcggcgccgccttcgccgacaggccgccggacagcctccccttccgcctcttctccagtgaccagcgcaacatcacatccggcgcctacgggcccggtctggcgcgcgctccgtcacaacctcacggggcaacgtgttccacccgtcgcggcatgggccggnttcgccgccgcccgccgccgcggggttgcgggggnntcctcgcccgggncncggcgcgaacgcggnnngngggggccggcgcccgcgaaggggcgncnngnnacggggnaangnnnnnnnnccctcgnnccca

SEQ ID NO: 27390 - DNA, 746 bp, Zea mays
  misc_feature: Ceres CLONE 1400653-F
  misc_feature: Encodes the peptide sequence at SEQ ID NO. 27391
  misc_feature (392)..(392): n is a, c, t, g, unknown, or other
  misc_feature (407)..(407): n is a, c, t, g, unknown, or other
  misc_feature (410)..(410): n is a, c, t, g, unknown, or other
  misc_feature (424)..(424): n is a, c, t, g, unknown, or other
  misc_feature (425)..(425): n is a, c, t, g, unknown, or other
  misc_feature (432)..(432): n is a, c, t, g, unknown, or other
aaagctggagctccccgcggtggcggccgctctagaactagtggatcccccgggctgcaggaattcgcacgagaccattacctagaacatcctaatcgaaaaaaaaaaacgcacggggagcttggagacttcacgacaaatcgacgatcgccgcttctcttggccattgtagagggagagagagagcgcgagcgacctaggtcagtcggtttcggttttgggcgtcagcttcagctatccgcgaccgcgacgatgggtctgcgcgtggccgccaccgcgccagctccggccggcgtgcgcgtgctcggcaggggcgccgcgcgcgtgacgccgcgaccgtgggcggctgtcggcggcaggagacgctctccccgtgcggatgtccgtcgcgnacaccgagggcaacnacnaatcgccgtggggnngcctcgnaggaccaggcgctggagggtagaaattcaaggacgggggtgggggccatccctcgggggtggggccgggaccaggtttttcccggttaccaaaaggggggccaagcccggggggccaatggggggggggaaagggtttcgcggggggccgggagaacggggataaaaggggggataaaaaggggccctctctcccgggggtgaattggaattccctaatgccccccttccgggggcttaatttttcaggggggggggcccggaagggattccctgggggtttaaaaaacacaagtggtgggggagggggggaaa

SEQ ID NO: 27391 - protein, 114 aa, Zea mays
  misc_feature: Ceres CLONE 1400653-F
  misc_feature (47)..(47): Xaa is any aa, unknown, or other
  misc_feature (52)..(52): Xaa is any aa, unknown, or other
  misc_feature (53)..(53): Xaa is any aa, unknown, or other
  misc_feature (58)..(58): Xaa is any aa, unknown, or other
MGLRVAATAPAPAGVRVLGRGAARVTPRPWAAVGGRRRSPRADVRRXHRGQXXIAVGXPRRTRRWRVEIQGRGWGPSLGGGAGTRFFPVTKRGAKPGGPMGGGKGFRGGPGERG

SEQ ID NO: 27392 - DNA, 764 bp, Zea mays
  misc_feature: Ceres CLONE 1400659-F
  misc_feature: Translation starting site: 255
  misc_feature: SWISSPROT Homolog: EC 1.2.1.3 Aldehyde dehydrogenase (NAD(+))
  misc_feature (293)..(293): n is a, c, t, g, unknown, or other
  misc_feature (421)..(421): n is a, c, t, g, unknown, or other
  misc_feature (443)..(443): n is a, c, t, g, unknown, or other
  misc_feature (447)..(447): n is a, c, t, g, unknown, or other
  misc_feature (507)..(507): n is a, c, t, g, unknown, or other
  misc_feature (540)..(540): n is a, c, t, g, unknown, or other
  misc_feature (542)..(542): n is a, c, t, g, unknown, or other
  misc_feature (543)..(543): n is a, c, t, g, unknown, or other
  misc_feature (561)..(561): n is a, c, t, g, unknown, or other
  misc_feature (667)..(667): n is a, c, t, g, unknown, or other
caaagctggagctccccgcggtggcggccgctctagaactagtggatcccccgggctgcaggaattcgcacgagaccattacctagaacatcctaatcgaaaagtactcccgtccaaggcagcagagaccagagagcgaaggaggccaaggccatcgctctcctagcctcggagacttgcctttgcatacacatccccccggagggcggtggccggagctgacccctgatcggacgcgcttagcgcctgagggcatggctgcaaccgtgaggagggctgcttcctccgtcctntctcgcttcctcctcacaaagccttcgccttcgcctgcttctgccgccggcaataattccgctctcctcgggatcaggggctgctgctcttcacaggttcagcaccgcaccggcatccgcggccgcgngccgcagaggagccatcccagnccgncgggtgggaggtgaagcacacccagctcctcatcaatggcaacttcgtcgacgctgctcntgtgggaagacgtttcccgacgctggaccgcgnannccgggcgaggtcatcggncggcggtcgccgagggcggacagcgaggacatccgaccgcgccgtggcggcccgcccgcagggcctttcgacgagggcccgtgggccgaggatgacggcctacganccggtgccgcgtgctgtttcgcttcgcggaactgatcgagggcacgggggaggagggcgcggcgctggagacgtgggacacggcaagacgctgggga

SEQ ID NO: 27393 - DNA, 735 bp, Zea mays
  misc_feature: Ceres CLONE 1400660-R
  misc_feature (735)..(735): n is a, c, t, g, unknown, or other
cagattgggtaccgggccccccctcgaggtcgacggtatcgataagcttttttttttttttttttggacgagaacgtctttcaagttacgttagcgatgcccagcaggaataccagacaaaaatcacccaaatgcaaggtgaaaagaatgacacgcaaaacgactaaatcctgactataccattgctttacaatctgctctttagttggcttctgctcatctagagcaaacagaagggggttggcctcttgatcttgatcttcatcaaaatcttgatccatttcaacatcaccatcatcttcacctccctctaacagttctgcatcagcatcaggatttattcgttttgcacgcttgcgttcttgctttatttcaccaccctttttagttacaaagcgctcataagcttcatcaagcacctcttcaagctgggcatcatacctctgctgttcctcgtcagaatccattttcctcatcagagtcttcaagaggcttgagtatcctcattaatcaccgtgtccattttcatcttcccaataatctctgctgattcaacagcttcaagtctttttcacccctttataacactaataaaaaaacaggcagggtccccctatatctctcccggaaaataaacctgattcctggtgcctttccgggctttaaccttttgcccaaaccttaaaaagccgcctttttccccttttttaccctccaacaaagaaccctggccan

SEQ ID NO: 27394 - DNA, 756 bp, Zea mays
  misc_feature: Ceres CLONE 1400661-F
  misc_feature: Translation starting site: 137
  misc_feature: SWISSPROT Homolog: EC 1.11.1.7 Peroxidase
  misc_feature (328)..(328): n is a, c, t, g, unknown, or other
  misc_feature (393)..(393): n is a, c, t, g, unknown, or other
  misc_feature (471)..(471): n is a, c, t, g, unknown, or other
  misc_feature (497)..(497): n is a, c, t, g, unknown, or other
  misc_feature (563)..(563): n is a, c, t, g, unknown, or other
  misc_feature (581)..(581): n is a, c, t, g, unknown, or other
  misc_feature (582)..(582): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
aagctggagctccccgcggtggcggccgctctagaactagtggatcccccgggctgcaggaattcgcacgagaccattacctagaacatcctaatcgaaaaatcattcctctcgagtagtcgatcggagtcaggagatgggcgcgtctggtggtgaaaagcttggtactcttgtgtgtgttcttgcacatgtatcgttattattggtgctcgtgctagcaccgtgtgtgtgcaaggcgactggtggtgactacggcggcctctccaacgaccactacaccgagtcctgcccggagctggagacattcgtcaagaagtccctggcgcgnatctttcgccgtggacatcacctcgccggccgccctcctccgcctgctcttccacgactgcaagntccacgggatgtgacggctccatattgctcaactccgacgagcgccggcacataaccctcggaactgggctcacgcanaaaacctcgggatccggcacgcgggncccgtcgggctccgtggaaagcggcccgtggaagcgctgtccccttggccggtcctcctgcgcccnaacatcgtccttctgggnngnnnaaagaaaaagccgtggcgccacaccggggggcccgcgcggtcgccagcgtgcctctttgggcccggaaagaaccccacgactaaccagcacgcaaggccgcccaaagcgcagctttcccgcctggttttcctccggaatcgaacgcgccgctcgaaattcttttcccagc

SEQ ID NO: 27395 - DNA, 778 bp, Zea mays
  misc_feature: Ceres CLONE 1400663-F
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (267)..(267): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (277)..(277): n is a, c, t, g, unknown, or other
  misc_feature (278)..(278): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (285)..(285): n is a, c, t, g, unknown, or other
  misc_feature (288)..(288): n is a, c, t, g, unknown, or other
  misc_feature (289)..(289): n is a, c, t, g, unknown, or other
  misc_feature (321)..(321): n is a, c, t, g, unknown, or other
  misc_feature (431)..(431): n is a, c, t, g, unknown, or other
  misc_feature (656)..(656): n is a, c, t, g, unknown, or other
  misc_feature (703)..(703): n is a, c, t, g, unknown, or other
aaagctggagctccccgcggtggcggccgctctagaactaagtggatcccccgggcttgcaggaattcgcacgagaaccatttacctaaaacatcctaaatcaaaaaaaaaacgcattccgcagaacgcgcggcgagggagtaggaggggacggcgggtgccgaggcccgcaggcacggggaagctacctgcttgcgtagccgggcgggctcgcgctgtgctgtcgctccatgtcggtcgccggcgagagcgcggnnnaaattcggncgnnnnnncnncnnncgntgnnatttctcctacaagggccccgacagcactccnatgttgaaagaggctgtggaaatgtctacagatgaagaatcgggatggcgttgttatatgccatccgaaagggtaaccttgatggatgggactaattcattagtggcagncatgatgatgaaacccccaaagggcaggaaactatttccattaaaggaccctgtttgataaaggggaccccccagggaggagagggggggcaaatccagaattccctggaattttgatggggtcagaagaacctctcttccccccaaagtccccagggaaaatccgccacttggggagtttctggaccagaaaaaacataaaggtgtttgccccccaccgttggncctttttttaccccacaaaggctccttgggggaaaattggggggggngccccacccccccccccaaaaagggggattctgcgggggaaaaaaaagacctctctcccccaagagagaaaaaat

SEQ ID NO: 27396 - DNA, 737 bp, Zea mays
  misc_feature: Ceres CLONE 1400666-F
  misc_feature: Translation starting site: 532
  misc_feature: Pfam Name: Dynamin_N Pfam Description: Dynamin family
  misc_feature: SWISSPROT Homolog: EC 3.6.5.5 Dynamin GTPase
  misc_feature (363)..(363): n is a, c, t, g, unknown, or other
  misc_feature (369)..(369): n is a, c, t, g, unknown, or other
  misc_feature (380)..(380): n is a, c, t, g, unknown, or other
  misc_feature (387)..(387): n is a, c, t, g, unknown, or other
  misc_feature (424)..(424): n is a, c, t, g, unknown, or other
  misc_feature (515)..(515): n is a, c, t, g, unknown, or other
  misc_feature (519)..(519): n is a, c, t, g, unknown, or other
  misc_feature (530)..(530): n is a, c, t, g, unknown, or other
  misc_feature (691)..(691): n is a, c, t, g, unknown, or other
tggagctccccgcggtggcggccgctctagaactagtggatcccccgggctgcaggaattcgcacgagaccattacctagaacatcctaatcgaaaaagtctatcttctcggctcgcacacctcagacacagccaggcagcggagcgctcccccttcccctcgattctttcgcttccttctagaaccttccgctccctccgctgcaacagtaacactgagcttcctcctcctcccaccccgaagatgacgaccatggagaacgtgatcgtgctcgtgaaccgcatccagcgtgcctgcaccgtcctcggcgaccacggggggggggggacgccgccgcctccctccctaccctctgggaaggnctcccnacggtccgcgntcgcggncggtccagaagttcggggaaaatcatcggtgctcganaagcatcgtgggggcgagacttcctgcctcgagggatcagggatcgtggacgcgtaggccactcgtcctgcagctgcacaagacagaaggncggnggtgcaggagntatgccgagttccttcacatgcctaagcgccgcttcactgatttctctatttgtgcggaaggaaatccaggatgaaactgacaggttgactggaaagacaaagcagatatctccagttccaattcatctcagcatatactctccacatgtggtcactttancattgattgatctgccgggctacccccaatttgcagttgaggggca

SEQ ID NO: 27397 - DNA, 744 bp, Zea mays
  misc_feature: Ceres CLONE 1400668-F
  misc_feature: Encodes the peptide sequence at SEQ ID NO. 27398
  misc_feature (508)..(508): n is a, c, t, g, unknown, or other
  misc_feature (517)..(517): n is a, c, t, g, unknown, or other
ggagctccccgcggtggcggccgctctagaactagtggatcccccgggctgcaggaattcgcacgagaccattacctagaacatcctaatcgaaaaaaaccctaaccccatcccgcactccccccctcccccaacacgcgcgtgctttcttagccgctaagcatatccctccccgccacgatctcgatggtggagatgtctgtggtggagctcaggacgctgccgctcggcttccgcttccaccccaccgacgaggagctcgtcacccactacctcaagggtaagatcaccggcgggatcaactccaagtccgaggtcatccccgagatcgacgtctgcaagtgcgagccgtgggacctcccagataagtccctgatccggtccgacgatcctgagtggatcttcttcgcccccaaggaccgcaagtaccccaacggtagcaggtcgaacagggccaccgaggcgtgatactgcaaggctactggcaaggacaggataatcaaatccnagggcgacnagcgcaagcagcataccatcgggtatgaagaagaccctcgtcttccaccgtggtcgtgccccccagggcgagcggacgggggtgaattatgcacgagtaccgcaccaccgagcctgagttccagtccggggaacaagggggggttatgttctttatcgcctccttcggaaggaaggagagaaaacttgacgctcccccccagaagaaggggttagaagggctacccc

SEQ ID NO: 27398 - protein, 93 aa, Zea mays
  misc_feature: Ceres CLONE 1400668-F
  misc_feature (12)..(94): Pfam Name: NAM Pfam Description: No apical meristem (NAM) protein
MVEMSVVELRTLPLGFRFHPTDEELVTHYLKGKITGGINSKSEVIPEIDVCKCEPWDLPDKSLIRSDDPEWIFFAPKDRKYPNGSRSNRATEA

SEQ ID NO: 27399 - DNA, 750 bp, Zea mays
  misc_feature: Ceres CLONE 1400669-F
  misc_feature (327)..(327): n is a, c, t, g, unknown, or other
  misc_feature (430)..(430): n is a, c, t, g, unknown, or other
  misc_feature (573)..(573): n is a, c, t, g, unknown, or other
  misc_feature (718)..(718): n is a, c, t, g, unknown, or other
aaagctggagctccccgcggtggcggccgctctagaactagtggatcccccgggctgcaggaattcgcacgagaccattacctagaacatcctaatcgaaaaatctgtctatcttgatctcatctcctatcttcttcctcctagattctttcttccgcgcgccctctctctctctctccttcctgccttctgcctgcgggcggcccatgtccgtggcgcccctcctgccctgcgagctgcttctccagcgaaaaggttgctgcgccttgacgcaccaccgatccaccgccgcccaacccgagcgttctgtccggcagctaggtacgnagctgcgcggtggctgcgaccggaagcagggaggggaacagggcagcgaacgccgggcgattgccttgacttgcctgtgtgctcgcccggcgcgaagtttggntcggtcgttccattggcatggatgacaaggaacttatctcacagtccggacctggcagtcattctaccagcagcagcagcagcaccaccggggctttccggggggggcggggggcgagcagcatagcccggtcctcgcttggnccggaatgcacttccgtcatttcgccccatgcccaacatgaacatgagccccgtcggcgatccttaaactctattgggggggggctccttccccggggatggaagttccaaatggacccggccgccgccacattgctgcacacgncccgcatgggtggctcgggttctacctccgcc

SEQ ID NO: 27400 - DNA, 742 bp, Zea mays
  misc_feature: Ceres CLONE 1400674-F
  misc_feature: Encodes the peptide sequence at SEQ ID NO. 27401
  misc_feature (548)..(548): n is a, c, t, g, unknown, or other
  misc_feature (705)..(705): n is a, c, t, g, unknown, or other
caaagctggagctccccgcggtggcggccgctctagaactagtggatcccccgggctgcaggaattcgcacgagaccattacctagaacatcctaatcgaaaaacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcggtctctttgtcgtcgacaagctccgccaggttgctgtgtgaagtccaaggttgtcacatggattcagcacaagatttccaacccaggacattctctataaagttgtggccaccaagtgaaagcacacggatcatgcttgttgacaggatgacaaacaatctgtccacagagtccattttctctcgcaaatatcgccttttgggaaagcaagaggctcatgagaatgcaaaaacgattgaagaactttgctttgccttggctgatgagcatttcagagaggagccagagggntgatgggaagttctgctgtccagctatatgcaaaggaaacagcaagatggttggttgaaaagttctgaaaaaggcccaaggactactgcagaactgtaggcacctgtagctgacacaccttcttgtgtctgctgatactgtactagatatatctggntggcagcggtgcttttatttgaggcagatgaagcaag

SEQ ID NO: 27401 - protein, 78 aa, Zea mays
  misc_feature: Ceres CLONE 1400674-F
MDSAQDFQPRTFSIKLWPPSESTRIMLVDRMTNNLSTESIFSRKYRLLGKQEAHENAKTIEELCFALADEHFREEPEG

SEQ ID NO: 27402 - DNA, 737 bp, Zea mays
  misc_feature: Ceres CLONE 1400675-F
  misc_feature: Translation starting site: 169
  misc_feature: Pfam Name: LANC_like Pfam Description: Lanthionine synthetase C-like protein
  misc_feature (359)..(359): n is a, c, t, g, unknown, or other
  misc_feature (409)..(409): n is a, c, t, g, unknown, or other
  misc_feature (510)..(510): n is a, c, t, g, unknown, or other
  misc_feature (540)..(540): n is a, c, t, g, unknown, or other
  misc_feature (549)..(549): n is a, c, t, g, unknown, or other
  misc_feature (666)..(666): n is a, c, t, g, unknown, or other
  misc_feature (667)..(667): n is a, c, t, g, unknown, or other
  misc_feature (685)..(685): n is a, c, t, g, unknown, or other
  misc_feature (693)..(693): n is a, c, t, g, unknown, or other
  misc_feature (694)..(694): n is a, c, t, g, unknown, or other
  misc_feature (717)..(717): n is a, c, t, g, unknown, or other
aaagctggagctccccgcggtggcggccgctctagaactagtggatcccccgggctgcaggaattcgcacgagaccattacctagaacatcctaatcaaaaaaccggtcgcgaaccctcctcctccagccacgcctcgaaacggcgtcggggcctgcgcggcgagtccatggctgatcgcttcattcccaatgactttcctgacttcgtcgccgaggctgaggcctccgacggcgaggggcaccgccccgcagggcatcggggcctgctctcgcttccgtacaccaggctctccgaccacttcgtccgcgccgcgcgccgcctcaaggacaaggtggttgaggagacgtgggtgaaagncggacggaaggtgacggactacacgctctacacgggctctctcgggacangcgctgctgctgttcaagtccttccaggtcctgggaggaccgcggggacctcaccctcgccgctgatatcggtccgcgcgtgcgagaattccgtcgcgggngccctgccgttcttgaattcatatgccggnaagggcggntgtctgccttcctgggggcggtgattggcaagcattgcgatgatcagctgagggtcactcagtatctgagctccttttgatgagataacatccaccgagaaagttccaaatgagtgnnctgtaagggaagggcggnctatctgnngggcctttgtttgttcttggatnaagcatcttcagcgaggaga

SEQ ID NO: 27403 - DNA, 764 bp, Zea mays
  misc_feature: Ceres CLONE 1400677-F
  misc_feature: Encodes the peptide sequence at SEQ ID NO. 27404
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (696)..(696): n is a, c, t, g, unknown, or other
  misc_feature (741)..(741): n is a, c, t, g, unknown, or other
aaagctggagctccccgcggtggcggccgctctagaactagtggatcccccgggctgcaggaattcgcacgagaccattacctagaacatcctaatcgaaaaacagaaccctgcaactgcaagctaaggagagtgtgatcaccaacagctagtgctagtcccccttccttccatccatccatggcatgcgtcagcaccttccagagctgccccattgccagaagagcaaagatcaacacgaggtccaggggctgcagcagtagcgtggcgaaggggtcatcaccaccagccttccagttccagtgcagggcgtcgactttcgcggcggacaccagcctccggctcgagctggacgagaaccccgagggcgatcatctcgggggcgtggcccgggaactgctccctcctcagctacgacgacctccgcgcctacctcgagtcgcaggagacggcggcccaggcagacggtcagcaagcgcggcgtggcgctcctgagcgagaccatgtcacaccccgtgctggtggccacagcagacagaccctggagggacgtcgaggccactttcgagggccgtgtcggggctttccggtcgtcgacagcggctcagaatgcggtccggggtgatcgtcaagaacgaccgggcaagagcctctcatgggtccaagacannnatattcgaagtgatgacatctccngctatcacactatcgtctgacaaaaccgtgatgggatgctgctgntctcatgcttcaagaagagatcc

SEQ ID NO: 27404 - protein, 104 aa, Zea mays
  misc_feature: Ceres CLONE 1400677-F
MACVSTFQSCPIARRAKINTRSRGCSSSVAKGSSPPAFQFQCRASTFAADTSLRLELDENPEGDHLGGVARELLPPQLRRPPRLPRVAGDGGPGRRSASAAWRS

SEQ ID NO: 27405 - DNA, 663 bp, Zea mays
  misc_feature: Ceres CLONE 1400682-F
  misc_feature: Encodes the peptide sequence at SEQ ID NO. 27406
  misc_feature (193)..(193): n is a, c, t, g, unknown, or other
  misc_feature (243)..(243): n is a, c, t, g, unknown, or other
  misc_feature (248)..(248): n is a, c, t, g, unknown, or other
  misc_feature (260)..(260): n is a, c, t, g, unknown, or other
  misc_feature (261)..(261): n is a, c, t, g, unknown, or other
  misc_feature (363)..(363): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
gctctagaactagtggatcccccgggctgcaggaattcgcacgagaccattacctagaacatcctaatcgaaaatcctctccccgagtcctctcctctccggggtattgaattcgaaccaaaaaatcaaaacaactcagcgattcgattcgcggcgagtcaagcgggatgccgccgcgcacggctccggcggngacctcaaccccgccgcggaaggtgcccctccggaagctgctgcgtgcgncgtcngtcgcctgcggnngtgcattcggctgggcgctgcagctgtcgttgctgaccccgtacgtggaggagctggggaatccggacggctttggcaatctcgtctggctgggcggcccgntggtccggcctcctcggtccaaccccttaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27406 - protein, 76 aa, Zea mays
  misc_feature: Ceres CLONE 1400682-F
  misc_feature (9)..(9): Xaa is any aa, unknown, or other
  misc_feature (26)..(26): Xaa is any aa, unknown, or other
  misc_feature (32)..(32): Xaa is any aa, unknown, or other
  misc_feature (66)..(66): Xaa is any aa, unknown, or other
MPPRTAPAXTSTPPRKVPLRKLLRAXSVACGXAFGWALQLSLLTPYVEELGNPDGFGNLVWLGGPXVRPPRSNPLP

SEQ ID NO: 27407 - DNA, 726 bp, Zea mays
  misc_feature: Ceres CLONE 1400688-F
  misc_feature: Encodes the peptide sequence at SEQ ID NO. 27408
aaagctggagctccccgcggtggcggccgctctagaactagtggatcccccgggctgcaggaattcgcacgagaccattacctagaacatcctaatcgaaaactcccggtccttctggacgcaacagcacaccacctctacgaagcatgtcgaactctcggtgccgctcaatttgtacccccaatccccttccacacaccgcctcgacacatcgaagagtcagagtaagggaagacgacgcagatctcgccacgcgaacacagatagatcgagggagtaagtgagagtgagagccatgacggagctgttcgacacggccgtgaccagcctcctccacctgccggaggtgctggaccgcctcgccgccgcagacggcgaccggcgatcggtcgggcaccacgcggcgcacgccaacggtcacgggcacggccacggacgcgtccacggactcggcggctgcgaaacgccggtggacatcgtggatcaggcccgcgagtacgacttcgtgctcgacgtgcccgatctctccagtcagacatccacgtgacgctgcagaaggacgcgtgctgctgatcaacgctgcagtgataagggaagcgcaatgagatgaggacatgaccgcgagggtgcgatacatcaggtggagcgcggccggcccgagtagttcggaggaagtcgggttgccgagatccgacaccggcggcgtgagtcgataccaaaacgtgg

SEQ ID NO: 27408 - protein, 83 aa, Zea mays
  misc_feature: Ceres CLONE 1400688-F
MTELFDTAVTSLLHLPEVLDRLAAADGDRRSVGHHAAHANGHGHGHGRVHGLGGCETPVDIVDQAREYDFVLDVPDLSSQTST

SEQ ID NO: 27409 - DNA, 751 bp, Zea mays
  misc_feature: Ceres CLONE 1400695-F
  misc_feature: Encodes the peptide sequence at SEQ ID NO. 27410
  misc_feature (344)..(344): n is a, c, t, g, unknown, or other
  misc_feature (446)..(446): n is a, c, t, g, unknown, or other
  misc_feature (447)..(447): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (527)..(527): n is a, c, t, g, unknown, or other
  misc_feature (531)..(531): n is a, c, t, g, unknown, or other
  misc_feature (532)..(532): n is a, c, t, g, unknown, or other
  misc_feature (547)..(547): n is a, c, t, g, unknown, or other
  misc_feature (548)..(548): n is a, c, t, g, unknown, or other
  misc_feature (576)..(576): n is a, c, t, g, unknown, or other
  misc_feature (577)..(577): n is a, c, t, g, unknown, or other
  misc_feature (579)..(579): n is a, c, t, g, unknown, or other
aaagctggagctccccgcggtggcggccgctctagaactagtggatcccccgggctgcaggaattcgcacgagaccattacctagaacatcctaatcgaaaaagctagccaagctataccactagaaccagagcacaactcaaagcaatgccgccgcctcctcctcctccgccccactcccacgcttcccatcccgcgccgcatggacgcgagcagcactagcgcgggggcacacagcacggcgagcgggcgggggcgcgacgatggacctgggcgggtcgggtggtgatggacgcgggcgcctcggagctgggcctgctcggcgggggatctagcaggctgcntcaagcacgggcgggggcccaatggcggcggggggagacgacgacgtgtgggggcggcggcagggccaagcagcccaggacaggggacagcgccgtcgccgnnccggggacgtggcggctgccacccaaggcggnnngggggcgccggttcctggctgggctcgtgcagtcccgggccacggncggnngagcagatgctcagnnttctcggtccgccgccgccggccgccgnngncctcgtgcgcctcctccaccgctgcggctgatggcggcggggcccatgccgctgtactacgggaccccggcctcttgctcaggattgagctcggggagcttgagcaccagcatgcaaggggcaagggccaaggtgagggccccattcacgccggcccagtggatcgagctcg

SEQ ID NO: 27410 - protein, 154 aa, Zea mays
  misc_feature: Ceres CLONE 1400695-F
  misc_feature (19)..(19): Xaa is any aa, unknown, or other
  misc_feature (53)..(53): Xaa is any aa, unknown, or other
  misc_feature (64)..(64): Xaa is any aa, unknown, or other
  misc_feature (65)..(65): Xaa is any aa, unknown, or other
  misc_feature (80)..(80): Xaa is any aa, unknown, or other
  misc_feature (82)..(82): Xaa is any aa, unknown, or other
  misc_feature (87)..(87): Xaa is any aa, unknown, or other
  misc_feature (97)..(97): Xaa is any aa, unknown, or other
MDAGASELGLLGGGSSRLXQARAGAQWRRGETTTCGGGGRAKQPRTGDSAVAXPGTWRLPPKAXXGRRFLAGLVQSRATXGXADAQXSRSAAAGRRXPRAPPPPLRLMAAGPMPLYYGTPASCSGLSSGSLSTSMQGARAKVRAPFTPAQWIEL

SEQ ID NO: 27411 - DNA, 750 bp, Zea mays
  misc_feature: Ceres CLONE 1400696-F
  misc_feature: Translation starting site: 156
  misc_feature: SWISSPROT Homolog: EC 3.4.23.40 Phytepsin
  misc_feature: SWISSPROT Homolog: EC 3.4.23.34 Cathepsin E
  misc_feature (328)..(328): n is a, c, t, g, unknown, or other
  misc_feature (475)..(475): n is a, c, t, g, unknown, or other
  misc_feature (476)..(476): n is a, c, t, g, unknown, or other
  misc_feature (539)..(539): n is a, c, t, g, unknown, or other
  misc_feature (588)..(588): n is a, c, t, g, unknown, or other
  misc_feature (591)..(591): n is a, c, t, g, unknown, or other
  misc_feature (592)..(592): n is a, c, t, g, unknown, or other
  misc_feature (708)..(708): n is a, c, t, g, unknown, or other
  misc_feature (720)..(720): n is a, c, t, g, unknown, or other
aaagctggagctccccgcggtggcggccgctctagaactagtggatcccccgggctgcaggaattcgcacgagaccattacctagaacatcctaatcgaaaaaccagctttccccttctctacggtccgggaatcggaagctcacggcagaagccatggggcagacgcatcttttgttgctcgcttgtttctgggtcctgtcaacatgctccttgctacttgatgcttcctccgatggactgttaagaatcaacctgaacaagaagagactggacaaggaagctttgactgctgcgaaattggcgaagaaggagagcaaccttcgaanggtctgtgggtgctgaccagtatctcagtgcctcaactgatgacatagtccctttggacaactacctggacacccagtactttggacagatcagcatcggcacgccaccacagaacttcacagtgatattcgacactggaagctccnnacttgtgggttccctcatccaagtgctacttttcgatagcatgctacttacaccacagatacnagtcaaccaagtcgaagacttacacaaagaatggagaatcttgacgatnacnnatatggttctgggcaaatcgctggcttcttcatgaggacaaagggtgttggttggccaaccttgttgtgcaaaatcagaaatttattgagacaactcgagaaccagcctacttcancccattgggagnttgatggaattctttgggctcggattccct

SEQ ID NO: 27412 - DNA, 767 bp, Zea mays
  misc_feature: Ceres CLONE 1400697-R
  misc_feature: Pfam Name: Granulin Pfam Description: Granulin
ggggttttacaattgggtaccgggccccccctcgaggtcgacggtatcgataagctttttttttttttttcctgaccccgaaaagatgcatccgtgcacaatatcatattttcctatttaataagaggtaccccgctacctacagcagattcttggaacggtaacagtactcatacaaacatctagattacctatgaaatcacttgctcttggatgagtcacacaagctctgggcgaaccccaaatctaggccctcatgccgcgctcatcttggccaggagtgcgcttctaggccttgacgaccactgggctgttcttgctcacccagcatgctccaactatgacgatgcacatctggtagccccgggggcaaccaccggcatgatcctcgcagcgtgtggcaccctcaacaggccaccatccacaaaccaagcaggacattcacggaagccgaaccccctgcaccccgggcttgccaccgaccaccataagctctcgtctcacacgttgaaacggacatcccgccttattatctgggattcatacggcattgcacggatcacccccttcatcagcgggtaggacaccgtcttcaggatcccgcacctcacagtgatcgcgttaacgcccctctacctacggatcgtacctgacatcgccccggttcgggccccaccagtggctgacgatccagctggccggcccgatctcctcgccagatggccactctcgacgacaccctactgaagggtaccccggtagcagct

SEQ ID NO: 27413 - DNA, 754 bp, Zea mays
  misc_feature: Ceres CLONE 1400700-F
  misc_feature: SWISSPROT Homolog: EC 3.2.1.67 Galacturan 1,4-alpha-galacturonidase
caaagctggagctccccgcggtggcggccgctctagaactagtggatcccccgggctgcaggaattcgcacgagaccattacctagaacatcctaatcgaaaaacgaataaagcttcgatcacgacaagatggagtgcacagactatgcgatgagagccttgttcctcctggtcctcttctgcatcagtgcatggtgataaggaagagacaaagggcatcgatgcgaaagtgtccgtgcctgttggatccttcgacatcaccaagttgggcgcctccggcaatggcaagacagacagcacgaatgctgtgcaggaggtatgggcatcggcgtgcggcggcactgggaagcagacaatcctcatacccaagggcgacttccttgtcggacaactcaacttcacaggtccttgcaagggcgacgtgaccatccaggtggatggcaatctgctggcgaccacggacctaagccagtacaaggaacatggtaattggatcgagattctacgcgtggataacctggtcatcaccggcaagggaaaccttgacgggcagggcccagccgtgtggagcaagaactcctgcaccaagaagtacgactgcaagatccttcccaactcgctggtgatggacttcgtgaccaaacggggtagggtgtccggagatcacgctgcttcaactccaagttactccacatgaacatgtaccagtgcaagaacatgtttggatcactgactgtgaccgtgacggtccccc

SEQ ID NO: 27414 - DNA, 788 bp, Zea mays
  misc_feature: Ceres CLONE 1400701-F
  misc_feature (391)..(391): n is a, c, t, g, unknown, or other
  misc_feature (457)..(457): n is a, c, t, g, unknown, or other
  misc_feature (458)..(458): n is a, c, t, g, unknown, or other
  misc_feature (499)..(499): n is a, c, t, g, unknown, or other
  misc_feature (500)..(500): n is a, c, t, g, unknown, or other
  misc_feature (621)..(621): n is a, c, t, g, unknown, or other
  misc_feature (700)..(700): n is a, c, t, g, unknown, or other
caaagctggagctccccgcggtggcggccgctctagaactagtggatcccccgggctgcaggaattcgcacgagaccattacctagaacatcctaatcgaaaaaccgcatcgcctcgccgctgttccccgcaacctatcgacccaatctcgtccgacccggcgcgtcgtcccctccagatctccgtcgccctctccaggtagcagaaactgttctgctgcattctgacaaagtggagggcttaggagcttctgcttcttttatgtctgaacaatctttgctttatttgggattggttgggagagtactctcgtgcaactaggaaaaggcacaaggttccgtcccactgcatgcgtcaagagactggtctggctttctctgttctgatttgntcatttgctggtgctcaaaagccgggcttgggtttccctcgaaggatcagcatcttaacgtccggnnattgtggactttttgtcgcaatctgatatcaactttcatannatcttttatcccaagatggcgctgcaaaaaacattggtgctcacaaaaccagggatgatgcccttctacaggtacagaattgcccagaatgataccccagaataaaaggccccggggtaantggtatccagaaccaatggttggtgaacctggttgacttaacaaaaggacttgccagggcaggctcctaaccaacaggnaattttttggaaggggagctttggtgcccggccaattttgaggagaaaaaaggggattttcctgggggtaagggggctctgaactgga

SEQ ID NO: 27415 - DNA, 792 bp, Zea mays
  misc_feature: Ceres CLONE 1400703-F
  misc_feature: Encodes the peptide sequence at SEQ ID NO. 27416
  misc_feature (419)..(419): n is a, c, t, g, unknown, or other
  misc_feature (512)..(512): n is a, c, t, g, unknown, or other
  misc_feature (562)..(562): n is a, c, t, g, unknown, or other
  misc_feature (789)..(789): n is a, c, t, g, unknown, or other
acaagctggagctccccgcggtggcggccgctctagaactagtggatcccccgggctgcaggaattcgcacgagaccattacctagaacatcctaatcgaaaaaccggtcgcgaatcctcctccttccagccacgcctcgaaacggcgtcggggcctgcgcggcgagtccatggctgatcgcttcatttcccaatgactttcctgaacttcgtcgccgaggctgaaggcctccgacggcgaggggcacccgccccgcagggcatcggggcctgctctcgcttccgtacaccaggctctccgaccactttcgtccgcgccgcgcgccgcctcaaggacaaggtggttgaaggagacgtgggtgaaagcccggacggaaggtgacggactacacgctctacacgggctctctcgggacagngctgctggctgttcaagtccttccaggtcactgggaaaaaccgcggggacctcgcccctcgccgctgattccggtccgcggcgtgcatgaatncactccgcggggccttggccgccgcaggttcttgacttcattatgccggnaagggccaggtgtctgcctctcttgggggggcggtgatttgccaagcattgcgatgaattcagctgaggggtcacttcagtatctgagcctccttttgatgagataacattccaccgagaaagttccaatgagtgccttttgattgggaaggcaggctatcttggggggggtttttgtttgttctttgaataagcatctcaagcgaagaagacgatccctctcgatnaac

SEQ ID NO: 27416 - protein, 62 aa, Zea mays
  misc_feature: Ceres CLONE 1400703-F
MTFLNFVAEAEGLRRRGAPAPQGIGACSRFRTPGSPTTFVRAARRLKDKVVEGDVGESPDGR

SEQ ID NO: 27417 - DNA, 765 bp, Zea mays
  misc_feature: Ceres CLONE 1400704-F
  misc_feature (548)..(548): n is a, c, t, g, unknown, or other
  misc_feature (558)..(558): n is a, c, t, g, unknown, or other
  misc_feature (567)..(567): n is a, c, t, g, unknown, or other
  misc_feature (599)..(599): n is a, c, t, g, unknown, or other
  misc_feature (694)..(694): n is a, c, t, g, unknown, or other
  misc_feature (695)..(695): n is a, c, t, g, unknown, or other
  misc_feature (697)..(697): n is a, c, t, g, unknown, or other
  misc_feature (698)..(698): n is a, c, t, g, unknown, or other
  misc_feature (706)..(706): n is a, c, t, g, unknown, or other
  misc_feature (759)..(759): n is a, c, t, g, unknown, or other
caaagctggagctccccgcggtggcggccgctctagaactagtggatcccccgggctgcaggaattcgcacgagaccattacctagaacatcctaatcgaaaaataaaaaaaactgagcctgcccgcccgcccgcccgcgcgctccgctccgtgaactatatctatctatcacctgctgctccaaggaggcggacagaggcaggcaggaaggcactcacttctccaggagctcggagtcggcagcaagagagaatggccgccgacgccgccgccgccgccacccttcgtactgctctctcccaaggtctggtgctgtggcatgtttagtgcaatcttcattgcttgctgtcttgctgcatttaacacagcacgagcttcagagaatagtccaagcctatctgtgttgccaagagatctcatccaaggtttacggcaatgaaccatttctaaagcacaaagacgtgatgtctttatcaattcatcaggagagcaaatggcgtcaacaggaggtcacccgacgagcggttcgtcgacataaccccgagangggtcatcgnacgtgtacnagctctggcgcccgacgccccctgatcagggnccaggaggggctggagaagctgctcggcaccgccggcgaaatctactaccaagtacgagggcccccccccccggcggggtcgacagccccaacgnncnngtgggccnaagcgtgtacaagcccccgcgggggggggggagaaaaaacgtgtccacgaagnacggcc

SEQ ID NO: 27418 - DNA, 722 bp, Zea mays
  misc_feature: Ceres CLONE 1400706-F
  misc_feature: Encodes the peptide sequence at SEQ ID NO. 27419
  misc_feature (428)..(428): n is a, c, t, g, unknown, or other
  misc_feature (514)..(514): n is a, c, t, g, unknown, or other
  misc_feature (515)..(515): n is a, c, t, g, unknown, or other
  misc_feature (559)..(559): n is a, c, t, g, unknown, or other
  misc_feature (601)..(601): n is a, c, t, g, unknown, or other
  misc_feature (607)..(607): n is a, c, t, g, unknown, or other
  misc_feature (639)..(639): n is a, c, t, g, unknown, or other
  misc_feature (662)..(662): n is a, c, t, g, unknown, or other
  misc_feature (666)..(666): n is a, c, t, g, unknown, or other
acaagctggagctccccgcggtggcggccgctctagaactagtggatcccccgggctgcaggaattcgcacgagaccattacctagaacatcctaatcgaaaaagaagcatcacacactaatcaacaagcaggaccagctagctagctcctctcactgctatcacccgcccagccatctcgctgaaagagaaaagcgcagccatgaagactactagctcgggcattgcagtcgtcctactggtggccatgctggcagtccattccgcgttggccgacatctcgtgctccgacgtgctcaacgacctgtcgccgtgcctgcccttcctgcagggcaaggcagccaaacccagcgagagcaacaaccagtggctgcgacggcgtgagggccctggtacgcggcggcggacaccaggcccgacaggcaggncaacgtgccggtgcctcaaggcggccctacgttcagggtccacgctgtgctctcccgcggcgcaggagctggcccggcgactgcgnncctctcgctgtcctacaacatcacccccgacatcgactgcgacnagatcgaatgaaagggatactgttcccttaccaaatcctacnacgggnaatggtgatgttcagtgccctgctagcagtangctgcatctgcactgagtgatanaatnaagattttgggtgatgtttgtgcttgattagtgtgttcgcctgtaacgtggggaat

SEQ ID NO: 27419 - protein, 150 aa, Zea mays
  misc_feature: Ceres CLONE 1400706-F
  misc_feature (76)..(76): Xaa is any aa, unknown, or other
  misc_feature (105)..(105): Xaa is any aa, unknown, or other
  misc_feature (146)..(146): Xaa is any aa, unknown, or other
MKTTSSGIAVVLLVAMLAVHSALADISCSDVLNDLSPCLPFLQGKAAKPSESNNQWLRRREGPGTRRRTPGPTGRXTCRCLKAALRSGSTLCSPAAQELARRLRXSRCPTTSPPTSTATRSNERDTVPLPNPTTGNGDVQCPASSXLHLH

SEQ ID NO: 27420 - DNA, 645 bp, Zea mays
  misc_feature: Ceres CLONE 1400711-F
  misc_feature: Encodes the peptide sequence at SEQ ID NO. 27421
  misc_feature (387)..(387): n is a, c, t, g, unknown, or other
  misc_feature (431)..(431): n is a, c, t, g, unknown, or other
  misc_feature (442)..(442): n is a, c, t, g, unknown, or other
  misc_feature (451)..(451): n is a, c, t, g, unknown, or other
  misc_feature (496)..(496): n is a, c, t, g, unknown, or other
  misc_feature (513)..(513): n is a, c, t, g, unknown, or other
  misc_feature (630)..(630): n is a, c, t, g, unknown, or other
aaagctggagctccccgcggtggcggccgctctagaactagtggatcccccgggctgcaggaattcgcacgagaaccattaacctaagaacatcctaatcgaaaagtttcttggatagtccgtagccgcttgccctgttcgcatcttcgcgcgtggcgcacaccgctccagctctccttcgacgggcacggccgagccgccttcgtcttggccgcagcggtgcgcgctctccatggcgtcctaattagcctagccgcaacgccgcgcccgtgcctgcggcatggatgaaccccttcttggcaatggtcttaagaccagcgggaaaagagagagcctggtagtggccgaggtcagaaaacagaatgtaccttgctgggccactcatcngctgcatggatcctacagaacattgtccagatgatatctatcantgtttgtcggncaccttggntgagcttgcccctctcagtggcctcatcgccacctccttttgcangcgttactggcttcagnctattggtctggcatggcgagcacttggaaacactgtgtggccaatcgttcgggggcaaaagcagaatattcttcttgcattctaccagcaaagggcaatccttgggtccctctatnaaagccctgggggtt

SEQ ID NO: 27421 - protein, 76 aa, Zea mays
  misc_feature: Ceres CLONE 1400711-F
  misc_feature (5)..(5): Xaa is any aa, unknown, or other
  misc_feature (9)..(9): Xaa is any aa, unknown, or other
  misc_feature (12)..(12): Xaa is any aa, unknown, or other
  misc_feature (27)..(27): Xaa is any aa, unknown, or other
  misc_feature (32)..(32): Xaa is any aa, unknown, or other
  misc_feature (71)..(71): Xaa is any aa, unknown, or other
MISIXVCRXPWXSLPLSVASSPPPFAXVTGFXLLVWHGEHLETLCGQSFGGKSRIFFLHSTSKGQSLGPSXKALGV

SEQ ID NO: 27422 - DNA, 697 bp, Zea mays
  misc_feature: Ceres CLONE 1400712-F
  misc_feature: Encodes the peptide sequence at SEQ ID NO. 27423
aagctggagctccccgcggtggcggccgctctagaactagtggatcccccgggctgcaggaattcgcacgagaccattacctagaacgtcctaatcgaaaagcccccatcatatcttgtgaccctccctcagccgcgctgcgccttatcctacgattcacagctctctctggtcgaaggtctcacccatgctcaagaactacccgaccgtgagcgccgagtacctcgatgcctgtgcacaaggccagttgtaagttccgatctctcatcatcgagaagagatgcgccccgatcatgctccgactactggtgaactcctcttcaacgttcaacgtgactgctagaaccagtgtcccattcggtactataaaccatcagacactattgactcacggatctaacggcaggctggacatcgcgggtgaggatgctccagcacataatggacgaggtcccaaatctctcttactccgatttctaccagctcgcgtgaaattagcccaaagcacctccaccggggggcatgaaattccctttccacccgggtaaggaaaaagaagcctcagccccccaactgaggggccagccttctttgatgccactaagggttcctgaaccccctgaggggaagtttttggtcaaacaaatgggctttgaacccctcagaaaattgtttcccttctctggacgcccccacc

SEQ ID NO: 27423 - protein, 106 aa, Zea mays
  misc_feature: Ceres CLONE 1400712-F
  misc_feature: SWISSPROT Homolog: EC 1.11.1.11 L-ascorbate peroxidase
MPVHKASCKFRSLIIEKRCAPIMLRLLVNSSSTFNVTARTSVPFGTINHQTLLTHGSNGRLDIAGEDAPAHNGRGPKSLLLRFLPARVKLAQSTSTGGHEIPFPPG

SEQ ID NO: 27424 - DNA, 693 bp, Zea mays
  misc_feature: Ceres CLONE 1400717-F
  misc_feature: Translation starting site: 262
  misc_feature (274)..(274): n is a, c, t, g, unknown, or other
  misc_feature (319)..(319): n is a, c, t, g, unknown, or other
  misc_feature (329)..(329): n is a, c, t, g, unknown, or other
  misc_feature (417)..(417): n is a, c, t, g, unknown, or other
  misc_feature (418)..(418): n is a, c, t, g, unknown, or other
  misc_feature (426)..(426): n is a, c, t, g, unknown, or other
tggagctccccgcggtggcggccgctctagaactagtggatcccccgggctgcaggaattcgcacgagaccattacctagaacatcctaatcgaaaaagtttactggagcacgcaccgcagcgtctcccccttctgctcatcctccgtccctccgtcggaagggctggcgctaagggacgatccctccgtccgcccgtccgttcgacgggacctcggttggtttcgtcggtcgctgggaggacaggtgacggaacggtgatatgaggcggtggnttatgtgtaactgccactatgacgtcgaggaagatgaccacgccnaggaacaggncaaagctcagagcaataagaccgactccaagcagaagtcttcaaagcctcctggtagtcaacctgagccagagttctcccctcctacnnatgatgtncctgaattgtctttggatgatttgaaactaaagactgatgatttttggatcagtgctctgattgggtgagggttcttatggacgagtatatcatggcactttgggacgatggggagacaagcagcagttaaaaaaacttggtgcatctgaaaatgagccttaatgatggattttctcaaaacaggtctcactgggcttcaaagctaaaacatgaaaatctttggtgaagatggttggggtacctggggccaatggggaaattaccca

SEQ ID NO: 27425 - DNA, 708 bp, Zea mays
  misc_feature: Ceres CLONE 1400721-F
  misc_feature: Encodes the peptide sequence at SEQ ID NO. 27426
  misc_feature (356)..(356): n is a, c, t, g, unknown, or other
aagctggagctccccgcggtggcggccgctctagaactagtggatcccccgggctgcaggaattcgcacgagaccattacctagaacatcctaatcgaaaaattgcgcacaccttgatgctgggcatgagcaggacggggttggccggagcggcgctgcgggtggcgctgacggcgctgctgccgctggtcctgccggcgtactacgtgtacaagctgaccacgtacctccctcggcgcccgtctcccccgaggacgtcgccgggcaaaggtggtactcatcagccggcgccctcctccggcatcgggcgagcacctgggcctatggagtacgcggagggggggaagctactgcgncctttgggggggcggagggaaggcaaccccaaccctcccgggaaggggccggcgaacctcccccccttgggggcttggggcttccccccccgggggggccctccggccccccccccgggggggggcgtcccccccaggccccctcgggaaatgtgggggggggggtttttttcgtgcgggccgcgagaggggggggggggggggggcccgcccccccccccgcggggagacgcgcgcgggagtcccccccccgcccccggccagggggcgggggggaggggatccccccaccgcgccccccccgtcggccccccccccggcgacgtgcggcgggggggcggcggcggggcgc

SEQ ID NO: 27426 - protein, 197 aa, Zea mays
  misc_feature: Ceres CLONE 1400721-F
MLGMSRTGLAGAALRVALTALLPLVLPAYYVYKLTTYLPRRPSPPRTSPGKGGTHQPAPSSGIGRAPGPMEYAEGGKLLRPLGGRREGNPNPPGKGPANLPPLGAWGFPPRGGPPAPPPGGGVPPRPPREMWGGGFFSCGPREGGGGGGPPPPPRGDARGSPPPAPGQGAGGRGSPHRAPPVGPPPGDVRRGGGGGA

SEQ ID NO: 27427 - DNA, 679 bp, Zea mays
  misc_feature: Ceres CLONE 1400722-F
  misc_feature: Translation starting site: 193
tggagctccccgcggtggcggccgctctagaactagtggatcccccgggctgcaggaattcgcacgagaccatacctagaacatcctaatcggaactccaaagtttcgtccaccatttcgctcccgcaagcaccgatttgtttactgctctctccgacgcgcggcggcggagctccctacgacgactgaaccatgtgcggcggcgcgatccttgccaaccttcgcgagccggcgccgcgccggctcacagagcgggacatctggcagcagaaaaagaagctcaagaggggcggcggcggcggaacgcgctcgttcgcggcgggagacgatgaggacttcgaagccgactttgaggtcttcgaggccgactccagtgattcagatttggagctcagggaggggactggacgacgacgtcgtcgagatcaagcccttcactgcccagaggactttctccagcgatggcttaagcaccatgactagtgctggagcagggtcagccaaggagaagaaaaaggaatctatacgggggtatccgccagcggccttgggggcaagggggctgctgaaatcagagatcctcagaaaggggggtcggggttgggcttgggacttttcaataggcctggaggaggctgcaagaagcttatggtgccgaaaccgggcaggattccgggga

SEQ ID NO: 27428 - DNA, 577 bp, Zea mays
  misc_feature: Ceres CLONE 1400725-F
  misc_feature: Encodes the peptide sequence at SEQ ID NO. 27429
  misc_feature (84)..(84): n is a, c, t, g, unknown, or other
  misc_feature (102)..(102): n is a, c, t, g, unknown, or other
  misc_feature (272)..(272): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (309)..(309): n is a, c, t, g, unknown, or other
  misc_feature (371)..(371): n is a, c, t, g, unknown, or other
  misc_feature (372)..(372): n is a, c, t, g, unknown, or other
  misc_feature (461)..(461): n is a, c, t, g, unknown, or other
  misc_feature (488)..(488): n is a, c, t, g, unknown, or other
aaagctgggctccccgcggtggcggccgctctagaactagtggatcccccgggctgcaggaattcgcacgagaccattacctangaacatcctaatcgaaanaaacgagagcacccggaccagacgcccaagtcgatcgccatggcgatgaagccggcggcggcggctccccctaccccggccgcggcgcacagcgtgttcgtctacggcagcctgatggcggacgaggtggtccgcaccatcctcaagcgcgtcccgcccgccgccccggnccttcctccannnactacacgggttcacatcaggggncgcatttaccccgcgatcctggccgttgagagcaagagagttgctgggaggggtatcatggnntgtactgatgaaagagctcagcttcttgacgcgttttgagacgtggagtacacgaggacaagagttgagatatcattggctgactcttncgagaacatgctggctgacacttaccngtgaagtgatgcaaaagatctcaatcttttatgagaatggaactttggagggaaatgactggttcctgagccccctggggtgtaattgt

SEQ ID NO: 27429 - protein, 89 aa, Zea mays
  misc_feature: Ceres CLONE 1400725-F
  misc_feature (44)..(44): Xaa is any aa, unknown, or other
  misc_feature (48)..(48): Xaa is any aa, unknown, or other
  misc_feature (77)..(77): Xaa is any aa, unknown, or other
MAMKPAAAAPPTPAAAHSVFVYGSLMADEVVRTILKRVPPAAPXLPPXTTRVHIRGRIYPAILAVESKRVAGRGIMXCTDERAQLLDAF

SEQ ID NO: 27430 - DNA, 664 bp, Zea mays
  misc_feature: Ceres CLONE 1400730-F
  misc_feature: Translation starting site: 283
  misc_feature (415)..(415): n is a, c, t, g, unknown, or other
cgctctagaactagtgggtcccccgggctgcaggaattcgcacgagaccattacctagaacatcctaatcgaaaaagaaactgttccgctcccactccgatcggattcggtgggacggtggcatctatgcgcccgcggcaccgtcgctcaaactgtataaacctgcgctcgaacacttcgagctcacccgcaacctcctccgggaagcgcgatcgccatctcgaaggagctgagatccaagattccaagctcttctgtcagttgagggaagttgaagcaaaaatgttttacgggggatatgcttaccatggcaactcgtttgagcaaacataccgttgttatccagcatcgttttttgataagccacagctggaagggcgtgataaagtaataatgccaccttctgcccttgatncgtctgcttccttgcacatcgagtaccctatgctatttgagctgcacaatgatgcaacccaacgatttcacactgtggtggtttttggaggtttgtggcaaaagaaggcatgatcatcatgccctaatggatgatgcaaaacatgctgcttttcagaggggggacactgtccatggcaaaaatgcgactcttcccagggggcacatatgtgaaatggcacctcacacaactgattttctgggatattca

SEQ ID NO: 27431 - DNA, 621 bp, Zea mays
  misc_feature: Ceres CLONE 1400734-F
  misc_feature: Translation starting site: 160
  misc_feature: SWISSPROT Homolog: EC 1.2.1.3 Aldehyde dehydrogenase (NAD(+))
  misc_feature (368)..(368): n is a, c, t, g, unknown, or other
  misc_feature (383)..(383): n is a, c, t, g, unknown, or other
aagctggagctccccgcggtggcggccgctctagaactagtggatcccccgggctgcaggaattcgcacgagaccattacctagaacatcctaatcgaaaacatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcacctccacgagcccgacccaacatcaggtcatcgcagaggtcgtggaggcgtccgtgcacgactacgaggagggcatgcgcgcctgcttcgatgccgncaagacatggatggncgatcctgctcaaagcgaggagagatcggtaggcaaatcgtgatgcactgaaagcaaagctccatcaccttggcaggcttgtgtcacttgaaatggggaaaattcttcctgaaaggaatcggggagggtcaggaaatcatcgacatgggggatttatgtgggggggttaaagccgcaacctaatggatccctttatcccttcgggacgaccaaacttattggggggggggggggggga

SEQ ID NO: 27432 - DNA, 895 bp, Zea mays
  misc_feature: Ceres CLONE 1400735-F
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (31)..(31): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
gggtggttgccnnannnnnnaacaaaaacancnnntataccaaacgcgccgctctccaagctggcgctccaccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgcccaattttcagtgagcggcggcgatcggcttcggatcggcgaagcgcggcgaagcggagatggctgccgcgggggtgaatgccctgatcccgcgaggcggacccccgggccgccggcggaaaaggtaaaccggggagggcggcatcctgccgaaggcggccgcccaagggccgggtgtgggggtaatcctgttaaagcgaacgagggtgagggaatttttgaaaaacgccatttgagggaaacctgggagggcccctggttttcctaaaacctgaaaaccagcctccgcgggggggaggaaatttctggggcccgaaaatttcctcctcccctcccctcgaaagatacccgagcggcgcactttccccccgcgcccttttcggggacgaaaaggcccccccgcggtgaatcctcggccccccccgcgggcgatgtgtaaataaaataaaggcgggggcctcaccccacccacgacttctcccccgcccgcccccaatagattttctgtgggaagtcttgcatacgctacccccattgtcccccctgcctttttaacacctttcatgctgggcctgggtcgctccgccaagcgggtttgggcaatatgtggtcggccgctcgtcacgtcataacttatcccctcctcccaaacctcg

SEQ ID NO: 27433 - DNA, 686 bp, Zea mays
  misc_feature: Ceres CLONE 1400739-F
  misc_feature: Encodes the peptide sequence at SEQ ID NO. 27434
  misc_feature (358)..(358): n is a, c, t, g, unknown, or other
  misc_feature (370)..(370): n is a, c, t, g, unknown, or other
  misc_feature (470)..(470): n is a, c, t, g, unknown, or other
  misc_feature (479)..(479): n is a, c, t, g, unknown, or other
  misc_feature (481)..(481): n is a, c, t, g, unknown, or other
  misc_feature (508)..(508): n is a, c, t, g, unknown, or other
  misc_feature (543)..(543): n is a, c, t, g, unknown, or other
  misc_feature (544)..(544): n is a, c, t, g, unknown, or other
aagctggagctccccgcggtggcggccgctctagaactagtggatcccccgggctgcaggaattcgcacgagaccattacctagaacatcctaatcgaaaatcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattgncaggaacatggntgcgccgctcctggtgctcaacctcatcatgtacatcatcgtcatcggcttcgcgagctggaacctgaaccactttcatcacgggcagaccactaccccnggcgtgccngnccacggcgcgacgttctactttctggntgtcgccatcctggcccggcgtggtgggccccgcnntccaagctggcggggggtgcaccacggtgcgcggctgggcgccacgacaggctggccaacaaaggccggggtggtcggtcaatcgcttgggccattccgggggtttgcctttcgggttggcctggaaggaatacccccatcg

SEQ ID NO: 27434 - protein, 114 aa, Zea mays
  misc_feature: Ceres CLONE 1400739-F
  misc_feature (14)..(108): Pfam Name: AWPM-19 Pfam Description: AWPM-19-like family
  misc_feature (5)..(5): Xaa is any aa, unknown, or other
  misc_feature (9)..(9): Xaa is any aa, unknown, or other
  misc_feature (46)..(46): Xaa is any aa, unknown, or other
  misc_feature (55)..(55): Xaa is any aa, unknown, or other
  misc_feature (67)..(67): Xaa is any aa, unknown, or other
MAGIXRNMXAPLLVLNLIMYIIVIGFASWNLNHFHHGQTTTPGVPXHGATFYFLXVAILARRGGPRXPSWRGVHHGARLGATTGWPTKAGVVGQSLGPFRGFAFRVGLEGIPPS

SEQ ID NO: 27435 - DNA, 669 bp, Zea mays
  misc_feature: Ceres CLONE 1400740-F
  misc_feature: Encodes the peptide sequence at SEQ ID NO. 27436
  misc_feature (317)..(317): n is a, c, t, g, unknown, or other
  misc_feature (566)..(566): n is a, c, t, g, unknown, or other
  misc_feature (577)..(577): n is a, c, t, g, unknown, or other
  misc_feature (626)..(626): n is a, c, t, g, unknown, or other
  misc_feature (641)..(641): n is a, c, t, g, unknown, or other
aaagctggagctccccgcggtggcggccgctctagaactagtggatcccccgggctgcaggaattcgcacgagaccattacctagaacatcctaatcgaaaaaccccactccgccccacctccgcgcctcagatccatccccaaccggcaaccctagcgccgggttcctcctcctcggatccgcccgccgccgcgcggactccattgccagaggtgatcgagggggagagatagagcttgggtggtcggattagggagagagggaggggaggatgtccagacggtcgttgaacccgagccggcgggtggcggacggnggtctgccgacagtcggaggcctgttccaccccaagtcacgctcgcctcccgtgcttactattgccctagtcgtcctgggtgtcattcttctcgtcgcctacttcaacagcggctcaggtcggttaaagattctcggtgtaactgttacaagcagagagtctgtgacccagtctgaaggttcttgcacatcagaagttatgcgggtgctttcatatcttaaaaagcatatggaaatgcatgcaaaaggntctccatgtangccctgatagttgtacagtagtttctaatttgttgaaagaaagaaaggntgagcttggggagtnggagcttatgatttgaagatactgacag

SEQ ID NO: 27436 - protein, 103 aa, Zea mays
  misc_feature: Ceres CLONE 1400740-F
  misc_feature (102)..(102): Xaa is any aa, unknown, or other
MSRRSLNPSRRVADGGLPTVGGLFHPKSRSPPVLTIALVVLGVILLVAYFNSGSGRLKILGVTVTSRESVTQSEGSCTSEVMRVLSYLKKHMEMHAKGSPCXP

SEQ ID NO: 27437 - DNA, 686 bp, Zea mays
  misc_feature: Ceres CLONE 1400742-F
  misc_feature (426)..(426): n is a, c, t, g, unknown, or other
  misc_feature (454)..(454): n is a, c, t, g, unknown, or other
  misc_feature (455)..(455): n is a, c, t, g, unknown, or other
  misc_feature (533)..(533): n is a, c, t, g, unknown, or other
aaagctggagctccccgcggtggcggccgctctagaactagtggatcccccgggctgcaggaattcgcacgagaccattacctagaacatcctaatcgaaaaattcgcaccaccgccgcgccgcccaaaccctagccgccgccgccgccgccgccgccatggtcgccgtcaaccgccccctcgtctccgtgaaggccctagagggcgacatggtaaccgacgcccccggcatcgccttaccgcccgtcttcggggcgccgatccgccccgacgtggtcaggttcacccacaagctgctgtcctgcaacaagcgccagccctacgcagtctcccgccgcgccggccaccagacgtcggccgagtcctggggtaccggccgcgccgtgtctcgtatcccccgcgtccccggcggcggcacccaccgcngccggccagggagcgttcggaactgggnncccccgcgcggggccgcatgttcgcgcccaccaagaatctggcgcaagtggcaccgccgcgtcaacatcaacctccgncccgcgtcgccgtcgcctccgcgctcgccggccaccgccgtcccggccctcgtcccaggcgcgcggcaccgcaaatcgagtctgtccccgagatgccccttgtcatttccgactccgcggagtccattgagaagacctcccaggcgctcaaat

SEQ ID NO: 27438 - DNA, 679 bp, Zea mays
  misc_feature: Ceres CLONE 1400743-F
  misc_feature: Encodes the peptide sequence at SEQ ID NO. 27439
  misc_feature (541)..(541): n is a, c, t, g, unknown, or other
  misc_feature (573)..(573): n is a, c, t, g, unknown, or other
  misc_feature (665)..(665): n is a, c, t, g, unknown, or other
  misc_feature (667)..(667): n is a, c, t, g, unknown, or other
aagctggagctccccgcggtggcggccgctctagaactagtggatcccccgggctgcaggaattcgcacgagaccattacctagaacatcctaatcgaaaactcatcttgctctgaacgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcggggagctgctgaccggcgtgacatcgcccacggcggcgtgttgccancatcaaccccggtctggctgcccagaaaccgngggagaggcgtccagggcgggagcagggaggccagtcgcaaggaggggcgcagtccccagaaggggatagggttggagggggatcgatgtgncnatggggagggtg

SEQ ID NO: 27439 - protein, 156 aa, Zea mays
  misc_feature: Ceres CLONE 1400743-F
  misc_feature (31)..(104): Pfam Name: Histone Pfam Description: Core histone H2A/H2B/H3/H4
  misc_feature (123)..(123): Xaa is any aa, unknown, or other
  misc_feature (134)..(134): Xaa is any aa, unknown, or other
MDATGTGAGGKAKKGAAGRKAGGPRKKSVTRSVKAGLQFPVGRIGRYLKKGRYAQRVGSGAPVYLAAVLEYLAAEVLELAGNAAKDNKKTRIVPRHVLLAIRNDEELGELLTGVTSPTAACCXHQPRSGCPETXGEASRAGAGRPVARRGAVPRRG

SEQ ID NO: 27440 - DNA, 702 bp, Zea mays
  misc_feature: Ceres CLONE 1400745-F
  misc_feature: Translation starting site: 195
  misc_feature (635)..(635): n is a, c, t, g, unknown, or other
aaagctggagctccccgcggtggcggccgctctagaactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatctctctctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaaggcgcagtgcccgatcgtcgagcgcctcacaaactccctcatgatgcacgggcgcaacaacggcaagaagggcatggctgtccgcatcatcaagcatacccctggagatcattcacctgctcaccgatgccacccccatccaggtcgtcgtcgacgcgatcatcaacggtggaccccgtgaggatgccacccgtattgtccccctggggggtttggagggagggaaggcccggggatatctcaccccctggaggaggggggaaccagngccatcctacctcctcaccactgggggccagggggagaagggctttcccggaaacatcaaaaaccat

SEQ ID NO: 27441 - DNA, 691 bp, Zea mays
  misc_feature: Ceres CLONE 1400747-F
  misc_feature: Translation starting site: 425
  misc_feature (436)..(436): n is a, c, t, g, unknown, or other
  misc_feature (475)..(475): n is a, c, t, g, unknown, or other
  misc_feature (493)..(493): n is a, c, t, g, unknown, or other
  misc_feature (525)..(525): n is a, c, t, g, unknown, or other
  misc_feature (571)..(571): n is a, c, t, g, unknown, or other
  misc_feature (595)..(595): n is a, c, t, g, unknown, or other
  misc_feature (662)..(662): n is a, c, t, g, unknown, or other
aaagctggagctccccgcggtggcggccgctctagaactagtggatcccccgggctgcaggaattcgcacgagaccattacctagaacatctaatcgaaaaatctgatgccgtaacacaaggctgaatttttgttcggtctagccgacccgacgatggcgtccagcgacgggaaaccactgccaaccccggcctctgtggggcggcggcggcggcagcagcaccgcgccgcccgggcagccgaccacggtagcgtccaaggtgctggacatgggcgcggcggcaatgcagtcgttgcgccccgtgaagcaggcgaagcagcacatgtgcacgttcgcgctgtacgcgcacgacccgaagcggcagggtggagacgcaccactacgtctcccgcctcaaccaggacttcctccagtgcgccgtctatgactccgacnaagccgacgcgcgtctcatcgggcgtggagtacatcgtnggtcgaggaagatcttcnactcgctgcccggcgaaggagcagcggctgtngcactcgcacgcgcacgaaatcaaggcagggctggtgacgaggcgncacgtggcggggcttgtggagaangcggagctggaccactggccgcacggtcgggaaggtctgtgggacctggcaggggaccgcggaaccncctggcggtggcgccccccgctcaggggg

SEQ ID NO: 27442 - DNA, 694 bp, Zea mays
  misc_feature: Ceres CLONE 1400748-F
  misc_feature: Translation starting site: 390
  misc_feature (240)..(240): n is a, c, t, g, unknown, or other
aaagctggagctccccgcggtggcggccgctctagaactagtggatcccccgggctgcaggaattcgcacgagaccattacctagaacatcctaatcgaaaacccgaccctcctgatcgatcgagggccccttgttctagccagttgtccccttccctctcgccggcgttgctcctgcctgctccaatggccgctgcctctgccgcccccccacgaagacggcgacatcccccgcgacgnatgcggccgtgcagtacgactcctggcgggggggcgccgctggactccaggatggggaagttccggtcccttcggccaaaaagaatgagcttctgctgaagctggaggcagcaagcatcaacccagtggactggaaggggcaaaaaggcatgctgaggcctttcctgcctcggaaattaccttttatcccagtgactatggggcaggagtcggggttgatgttggcccaggaatcatgggtttccaagccggagatcaagtggttgctatgctcacctcatttaacggggggtgggctttggaaagaatgcttgggcatcaaaaaatcttgacggccaaaaggcccccttgaggtatctgctggccaaaaagggaagggttgcccattcgcccccgggattggccctccagggggttcggaaccatcggggcccaaggttgcaagggtaatggg

SEQ ID NO: 27443 - DNA, 678 bp, Zea mays
  misc_feature: Ceres CLONE 1400755-F
  misc_feature: Encodes the peptide sequence at SEQ ID NO. 27444
  misc_feature (317)..(317): n is a, c, t, g, unknown, or other
  misc_feature (361)..(361): n is a, c, t, g, unknown, or other
  misc_feature (384)..(384): n is a, c, t, g, unknown, or other
  misc_feature (387)..(387): n is a, c, t, g, unknown, or other
  misc_feature (397)..(397): n is a, c, t, g, unknown, or other
  misc_feature (414)..(414): n is a, c, t, g, unknown, or other
  misc_feature (509)..(509): n is a, c, t, g, unknown, or other
  misc_feature (537)..(537): n is a, c, t, g, unknown, or other
  misc_feature (556)..(556): n is a, c, t, g, unknown, or other
  misc_feature (678)..(678): n is a, c, t, g, unknown, or other
aagctggagctccccgcggtggcggccgctctagaactagtggatcccccgggctgcaggaattcgcacgagaccattacctagaacatcctaatcgaaaagaaaccctcgatacactcggctataaaatagcaaagggcacgacctcgtttcaaaccccctcgtcgctgctgcgtctctctctctcccgcaacctccagataataaaaaaacaataagcgaccatgttggtgtacaccgatcttctcaccggtgatgagcttctctctgactctttcccttacaaggagattgagaatggtattctttgggaagtngaaggaaagtggactaccaagggatgtgtagaggttaacattgntgccaacccatctgctgaggaanggntgtgagacgnaggtgttgacgactctngtgagaaggttgttgacattgtcgacactttcaggcttcaggagcagcccacttacgacaagaaaggggtcatcgcctacatcaagaagtacatncagcttttgacgcccaagctcaccccgnaacagcaggaggagttaangaagggtattgagggagctaccaagtaccttctcccccagctcagggactccaaatttcttggttgggaaggcatgcacgatgacagcactattgtctttgcttattacaggagggtgctan

SEQ ID NO: 27444 - protein, 53 aa, Zea mays
  misc_feature: Ceres CLONE 1400755-F
  misc_feature (46)..(46): Xaa is any aa, unknown, or other
MLVYTDLLTGDELLSDSFPYKEIENGILWEVEGKWTTKGCVEVNIXANPSAEE

SEQ ID NO: 27445 - DNA, 740 bp, Zea mays
  misc_feature: Ceres CLONE 1400761-F
  misc_feature: Encodes the peptide sequence at SEQ ID NO. 27446
  misc_feature (377)..(377): n is a, c, t, g, unknown, or other
  misc_feature (446)..(446): n is a, c, t, g, unknown, or other
  misc_feature (504)..(504): n is a, c, t, g, unknown, or other
  misc_feature (617)..(617): n is a, c, t, g, unknown, or other
aaagctggagctccccgcggtggcggccgctctagaactagtggatcccccgggctgcaggaattcgcacgagaccattacctagaacatcctaatcgaaaaacaaggaaaaacctagacacgaagtccaacccaaatctcaatatcccaaccctccgatccccatttccatccactccgacaccaatcctccgctccgaccaccgccggagaaatggggcggcgccgccggttcgcgcagctggacgatgacgacgacgacgacgaagacgtgcccatcaatttcaagccctcgggtggcgcctcctcctcggacgccaaacccaggaagccccagccgccgccgcagcagcgccgcggagtctccgatgacgacnacgaggacgtggagaaggtgggaacttgaggaggaggaggacgacgagaaggatctcgaggcaatgccngacgggccgaggaggaggagcgccgcgagcagaaggccgagacgaagactcgccgccngccggggacggcccaagcgccgccgcgacccggggagcgaggatgaggagcccgaggagctagagctgcaaacggaggatccccgttgaggaggagatcaccggaggcggggnccggtaactgtaggggacccgggtcagatcactgggcaagcggaaagaagcagaagaagcactatgcctcctttcgagtacgagggcaacagctttcgagctgggaggaccccgtggcttctc

SEQ ID NO: 27446 - protein, 114 aa, Zea mays
  misc_feature: Ceres CLONE 1400761-F
  misc_feature (86)..(86): Xaa is any aa, unknown, or other
MTTTTTKTCPSISSPRVAPPPRTPNPGSPSRRRSSAAESPMTTTRTWRRWELEEEEDDEKDLEAMPDGPRRRSAASRRPRRRLAAXRGRPKRRRDPGSEDEEPEELELQTEDPR

SEQ ID NO: 27447 - DNA, 732 bp, Zea mays
  misc_feature: Ceres CLONE 1400764-F
  misc_feature (439)..(439): n is a, c, t, g, unknown, or other
aagctggagctccccgcggtggcggccgctctagaatagtggatcccccgggctgcaggaattcgcacgagaccattacctagaacatcctaatcgagaaccagggtgcctagatcccgcccctcagttgcattctcggaagagaccatttccttcctcctgatctctcacggagttcctctccatggagacgccccgctctccgagcccccgcggcgaagggcccctcgattccgcgccggtgatgggtggtgcctccggtggcgggagccgtctacagaggtagagcgatcggccgaccctcgatccgaggtggggcgcatctgctgagcagggaggaaggtcaaggcatgcggaatccctccgcgctgctgcgacatgcacgcgcagaggacctggagtacctatacgtgtactgttcttaactcacgccccagtnataggaatcaacctggtctggaggctcagcttcatttgcgtgggtgtgaccatgatcgagtgcagcggagaagagactgcaccttgctgctctgatctgggttgccggctactgctgccgtgggtcaaaggatggagtttcccgaatgagaaatgggatcgctcaaggaaagcgtacagagcaactccctccctgtgacatgtaaagaatatgacgatcgcccctgcttttagaaagcctaatgatttctgtgccgtgccccctgaacataaagctgttggaaaaccatggga

SEQ ID NO: 27448 - DNA, 737 bp, Zea mays
  misc_feature: Ceres CLONE 1400765-F
  misc_feature (583)..(583): n is a, c, t, g, unknown, or other
  misc_feature (595)..(595): n is a, c, t, g, unknown, or other
  misc_feature (647)..(647): n is a, c, t, g, unknown, or other
ctggagctccccgcggtggcggccgctctagaactagtggatcccccgggctgcaggaattcgcacgagaccattacctagaacatcctaatcaaaaagatctacctgtctgttcttcgatcgagtctgagagatttgggaggaggagggaaacaaagcgaaagagcccatcttttttgtctttttggttcggtttcgtggttgcttcttttggaccccgcggaggagcccaccgtttctacaaaaacccaatctttgctgccttctcagcggtcgagatcgataggtttccagatctgaggctccgtgttctggctgtgagatcggaggcgcagcaatccgagcacgcagctagtagggaaagtatccgagaaaagttgcagattttgctgggggcaacggagcgagaacaagttactgcagaaggaaagggcaagggtgggggaggcgccggagatgagggatgctatcagctctgatggattatttgaaatcttgctcgggtccggatcaccggctgggcgtccccgcaaaggatcggatgcaccggccgccaggacgggctcctgggtacaaggacggnggcaggtcgccnatggtgagtctccatggccgtggtccaggcataacctattggaggacatagncgggtgaatccgggccgcttacacatcggagcctgactgcagcacccttcgcggggtctacaaggggcaggtggcccgaagaagcgggtt

SEQ ID NO: 27449 - DNA, 672 bp, Zea mays
  misc_feature: Ceres CLONE 1400768-F
  misc_feature (360)..(360): n is a, c, t, g, unknown, or other
  misc_feature (417)..(417): n is a, c, t, g, unknown, or other
  misc_feature (490)..(490): n is a, c, t, g, unknown, or other
  misc_feature (551)..(551): n is a, c, t, g, unknown, or other
  misc_feature (552)..(552): n is a, c, t, g, unknown, or other
  misc_feature (672)..(672): n is a, c, t, g, unknown, or other
tccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaatcaatttcttcgtccgccttcgcccctgcttacgtccccgctactaaccctangatcattctgtcttttctcgtttcttatccgactcttcttcgtttatgcctatcagnttatgaggttgaacgccttcagaagcttctctactagattagtgtaaatagtagactttgttcgagtttagtntggctggaaaatttagtctccgggtcccgtgtttatatctgctagcaataatggctggagnnaacggagagggtattggggggaaggggggaaggaacataaatagtctcaagagaaagcgggagagccccgctgcatattgctggctggcgtattctgccacctctgaattgcatcagcan

SEQ ID NO: 27450 - DNA, 681 bp, Zea mays
  misc_feature: Ceres CLONE 1400776-F
  misc_feature: Encodes the peptide sequence at SEQ ID NO. 27451
tggagctcaccgcggtggcggccgctctagaactagtggatcccccgggctgcaggaattcgcacgagaccattacctagaacatcctaatcgaaaacttttattcctccttggcaaggccatgccaccgtcgagcccaggaggcggaagtcaacgtaaccaagcgaacccatccatggcctccgctgctgccgtcgtctccctcaacgtcggcggcgagatcttccagaccaccaccgccacactttcccgcgccggcgcctcctccccgcttgcctccctcggtccctcctccccgtctgctccgcacttcctcgacggcgacccgcgcctctttgcccaactcctatccttcctccgccatggccgcctccttgctccgtcctatccctcagccacgctcctcgctgaggcgcgccacttcgcgctcgatggcgccctcctcgcttctctctccccggcctccgcctttgccccgctctcgctgcgcccttccgcgctcctcccgctcaccggccgcgtcgcgccctccgcccgtagcgctgtgcccctcgccgcctcacccggtctccctcgtcgccgcaaacgggggggggtcgtcacctgcttcgacgccgcgctcgcctcccccaccagcgtcctcacgcgctggcccgcgtgtttttttttcacccccggggg

SEQ ID NO: 27451 - protein, 186 aa, Zea mays
  misc_feature: Ceres CLONE 1400776-F
  misc_feature (26)..(111): Pfam Name: K_tetra Pfam Description: K+ channel tetramerisation domain
MPPSSPGGGSQRNQANPSMASAAAVVSLNVGGEIFQTTTATLSRAGASSPLASLGPSSPSAPHFLDGDPRLFAQLLSFLRHGRLLAPSYPSATLLAEARHFALDGALLASLSPASAFAPLSLRPSALLPLTGRVAPSARSAVPLAASPGLPRRRKRGGVVTCFDAALASPTSVLTRWPACFFFTPG

SEQ ID NO: 27452 - DNA, 702 bp, Zea mays
  misc_feature: Ceres CLONE 1400778-F
  misc_feature (355)..(355): n is a, c, t, g, unknown, or other
  misc_feature (397)..(397): n is a, c, t, g, unknown, or other
  misc_feature (434)..(434): n is a, c, t, g, unknown, or other
  misc_feature (435)..(435): n is a, c, t, g, unknown, or other
  misc_feature (451)..(451): n is a, c, t, g, unknown, or other
  misc_feature (470)..(470): n is a, c, t, g, unknown, or other
tccccgcggtggcggccgctctagaactagtggatcccccgggctgcaggaattcgcacgagaccattacctagaacatcctaatcgaaaagcattgcattgcataaacctctcgtgggaagtgcaaacaccaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggcaccgtccccttctacccggtccgcggagtccgccgccgccgcgncactgcgaacggcacgctgggtacccggagctctgcctgtcnacactcgcgggacatcccggacctacacaagaagcgnngttcccggacgtcatnttggcgcggccgtgaacgnaacggaggggaacggggggggtcgccaccgtccgcaacctgctcgaactaccctgcaggacagggtccctggtcgggggcgggaccgccctggacaatcaccgactgcccggaagcttgctgtcccacccccgaggggagaggcctccgcgcccgggaaccgccccactggggggccccccggcacggaccggggcgccccccccccccatacgaccacagcgcaccccccg

SEQ ID NO: 27453 - DNA, 729 bp, Zea mays
  misc_feature: Ceres CLONE 1400779-F
  misc_feature: Encodes the peptide sequence at SEQ ID NO. 27454
  misc_feature (350)..(350): n is a, c, t, g, unknown, or other
  misc_feature (351)..(351): n is a, c, t, g, unknown, or other
  misc_feature (407)..(407): n is a, c, t, g, unknown, or other
aaagctggagctccccgcggtggcggccgctctagaactagtggatcccccgggctgcaggaattcgcacgagaccattacctagaacatcctaatcgaaaaaacccccctttcccgccacaccatctcctcgccgcttcccgccacctctctcccatggcggcgccgtcggcggccacgcgcaggaaactgcagcgcaagttccgcctacgaggcttcaccctcaaggtggacgccctcgaggaggccgccgccttcctcgaccgcttccccgacgcccgaggacgacgcgctcgatctccctcctcgacgagctcgacaaggaaaccgctgcagtcgtcgatactggnncgggggacggggtcaagggccggtggtggccgctgcctggtcgagggccgagaggncgctctcaaagtgtggcgttcgccagcggcacaaagcggcaaggtctgcgccttgttggggtggggttggaacgcgttcccccctgggccccgggggtttccacttacgatcccatccaagaaaagggtttttttacgaggcaccccagggcaggaattaacttggcccatgggaaaaaaacttgggaaaaaaaagcttccccctttataggggataaggggattcaagggggttggctggcaaaaaactggtctcccggggtaaaaaattttcccccaaagcccggcttttttgaaacaaggtggggaaccgaaacacttg

SEQ ID NO: 27454 - protein, 153 aa, Zea mays
  misc_feature: Ceres CLONE 1400779-F
  misc_feature (65)..(65): Xaa is any aa, unknown, or other
  misc_feature (84)..(84): Xaa is any aa, unknown, or other
MAAPSAATRRKLQRKFRLRGFTLKVDALEEAAAFLDRFPDARGRRARSPSSTSSTRKPLQSSILXRGTGSRAGGGRCLVEGREXALKVWRSPAAQSGKVCALLGWGWNAFPPGPRGFPLTIPSKKRVFLRGTPGQELTWPMGKKLGKKKLPPL

SEQ ID NO: 27455 - DNA, 579 bp, Zea mays
  misc_feature: Ceres CLONE 1400780-F
  misc_feature (284)..(284): n is a, c, t, g, unknown, or other
tccccgcggtggcggccgctctagaactagtggatcccccgggctgcaggaattcgcacgagaccattacctagaacatcctaatcgaaaagattttcttcacccgtccacctcgtcttgcgctcctctgtctcggcgacgactgtgctaccgccgccgccgccgcaagacttcgtcgggcactttgccggcgacgatttcccaccagcccaacaggatcagaggaggtgatggcgaggagtgacagctgcctggcgcgcgtgggtgccggaattgctatcggntggcgcgggtcggcggagccgtcggtaaccttcgtccctaaacccctaaacactaggcttgcagcatcaatcccgtccgtgcgagccgcttcaacccgtcgggtgtttttttttttgggttggaagtaaaattattgtggcgatttccggaaatcttcctcgaggtagcttaggaacctacttcccctgggtttgggggggctaagcctaggggcaagatgggaaaaaactaaggggggttttttgggtaaaaggttacctaagggggttaagggaaggattccccggggggggc

SEQ ID NO: 27456 - DNA, 737 bp, Zea mays
  misc_feature: Ceres CLONE 1400787-F
  misc_feature: Encodes the peptide sequence at SEQ ID NO. 27457
  misc_feature (611)..(611): n is a, c, t, g, unknown, or other
aaagctggagctccccgcggtggcggccgctctagaactagtggatcccccgggctgcaggaattcgcacgagaccattacctagaacatcctaatcgaaaaaaccttcctctcccccgtaatcccagaaatttccgcccacaccaaccggcacctattccgtgggcgcgaaaccctaatcggcgcccgcctccctctccatggcggagcaggacgacgccgcggggcagagcccgctcgactccgttccgatcgacgaaacttgtgatgctgaagatatgcattctcctttgtccttttcttacagaagtcagcctaaatctgtgggagctggtcttagcaatatggggaacacatgcttcctgaacgcaactcttcagtgcatcactcacactgtaccgctttttctcaagcttcgctcaactgatcattccaccccatgctcatatgtaaggaatgggttttgttctttctgtgcccttaaagaacatgttgatgaatcaattcataggtcctggatctgttatagcaccagcaaatttcagagataatttaagaaagttatcgttcggatttttggccaggacagcaagaagatgcacatggaattnctacgttgcttgcttgaaactttgcacaagtggtactctttgatcccatggtcaaaaggcaagggctcatcccttggacgaaaaaaagtatacccaaccgagaattttttggaggacaacttgaaa

SEQ ID NO: 27457 - protein, 116 aa, Zea mays
  misc_feature: Ceres CLONE 1400787-F
  misc_feature: SWISSPROT Homolog: EC 3.1.2.15 Ubiquitin thiolesterase
MAEQDDAAGQSPLDSVPIDETCDAEDMHSPLSFSYRSQPKSVGAGLSNMGNTCFLNATLQCITHTVPLFLKLRSTDHSTPCSYVRNGFCSFCALKEHVDESIHRSWICYSTSKFQR

SEQ ID NO: 27458 - DNA, 682 bp, Zea mays
  misc_feature: Ceres CLONE 1400791-F
  misc_feature: Encodes the peptide sequence at SEQ ID NO. 27459
  misc_feature (379)..(379): n is a, c, t, g, unknown, or other
  misc_feature (436)..(436): n is a, c, t, g, unknown, or other
  misc_feature (556)..(556): n is a, c, t, g, unknown, or other
tggagctccccgcggtggcggccgctctagaactagtggatcccccgggctgcaggaattcgcacgagaccattacctagaacatcctaatcgaaaaagactctagtgtaccccagtcccggggtctagtctgagggccgttcccatggccaaccgggcgaggccactccacgccatctacatgaccagcagctcccatgaccctgacaagtgggcgcacctcgtcaaggagtacgcctcgcaatccttgctccgggaagccgccctcgtctacgccaggaacctgccccgccggacgcaccaccagcccctcctccccgtcctcctcaaggccgccgctgcctcctccccgaccgagctaggtctcggcaagccctcncatgcggaggccctcaagtccgccttttgcccgcgatctgctcgcggcaccacattngggtgtcgatgtacctgcaagtgtggcgcactcgcgacgggcggcagggcgttcgacgaaatgcgggaccggaacgtcatcagttacaccgctttctccccggtaccccccggggggggnaaataggaacgggccctggtcttcttttcgggggcatgggctcctggacgaccgtcccgggggcgagctgcgatccgggggtttccggaaaaggccccctggcgatggcctcgcaggggttccgag

SEQ ID NO: 27459 - protein, 138 aa, Zea mays
  misc_feature: Ceres CLONE 1400791-F
  misc_feature (97)..(97): Xaa is any aa, unknown, or other
MANRARPLHAIYMTSSSHDPDKWAHLVKEYASQSLLREAALVYARNLPRRTHHQPLLPVLLKAAAASSPTELGLGKPSHAEALKSAFCPRSARGTTXGCRCTCKCGALATGGRAFDEMRDRNVISYTAFSPVPPGGGK

SEQ ID NO: 27460 - DNA, 705 bp, Zea mays
  misc_feature: Ceres CLONE 1400794-F
tccccgcggtggcggccgctctagaactagtggatcccccgggctgcaggaattcgcacgagaccattacctagaacatcctaatcgaaaaattcggatttccttccgccttccgacagcggctgtctcggcgacccaaccccagcctgaccccacctcccgccgccgccgccgccgccgccgcgccttcgtcgtcaggagaagggtcccggtggctgcgtctctctcccctgcccccctgctccacactcggttcacgcgtcggctcgctaccgcaggccctcgactcgtacgcccgtccccggcggcgatccggccggcaccgtaaccctaggactccgacggagcaggaatgatgagtcatgaacaacaaattgtctcccttagtaaagggttctggggaaatgcgttcccccatagaaaactgggaaaagggagggcagtggaacgcaaagtagaataaatttttggtgaggcatccccctcggggggttttaaataaattcaggggcatgggaagccatttccaggggaccgcttaatctattgttctaacacaaacttattgggcatccaaggggggacggtgcattgtgaaataacgggttcttatatccttctgggaatttttccatggcaacaaacccctgacaaagaaattttggcggtcgtcttaaaaagtgggctcagggcgtagtaaaggag

SEQ ID NO: 27461 - DNA, 681 bp, Zea mays
  misc_feature: Ceres CLONE 1400795-F
  misc_feature (318)..(318): n is a, c, t, g, unknown, or other
  misc_feature (374)..(374): n is a, c, t, g, unknown, or other
  misc_feature (387)..(387): n is a, c, t, g, unknown, or other
cgcggtggcggccgctctagaactagtggatcccccgggctgcaggaattcgcacgagaccattacctagaacatcctaatcgaaaagaattgaaacgaaggcccgcgacgcgaggagcgagggaactaccaccggtctcggcgcctccgcgacgatagcctctccgacctcgagcgcggtccggttcctccctgcgtcagcacgcgagcccttggagcttcgagtcagatcccggcgggcgcccatggtggctctggtgccgttgagccgcgcgatgtagggttttcgcgcgccgcatagtaggagcgatggggcgnccggaagatgtccgcggcggcaccgccgtcctcggagctggtccaacgttgggcgnaagcgtcatcccnggaacttcgagctaaacacaaaacagactttgggagaatttgacgctgaccaaacagccactcagaacatttgcattttttcctattagccatggttacaatacttgaaaagattagcaacatattcctggggggaaaggggggggtttcttctttctcctaattgggtttattggtagcttctggaaccttgctcggccgtttccggatggtctgcataagaagcatgtggaggaattccttattatggctaatttgggggcctggcggcatttcattaggagtgggttcaca

SEQ ID NO: 27462 - DNA, 726 bp, Zea mays
  misc_feature: Ceres CLONE 1400797-F
  misc_feature: Encodes the peptide sequence at SEQ ID NO. 27463
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
tccccgcggtggcggccgctctagaactagtggatcccccgggctgcaggaattcgcacgagaccattacctagaacatcctaatcgaaaaatcacgaagagtcatcacgccatacgacacggaggacaccgagccggaggcgaagccggtgcgcagcgcgagagtagcggcgagtcggcgaccatcaagcaactgcatggccgcgttacccgccagcacccccgcccccgcccccgccccctccgaggaggcggagctcgtgccgacgctctcctcgctggagccggtctacggcgcgggcgcgcagctcgacgaggcgcgcctccgcttcgcccgcctcggggaccgcttccacgccgtctacggcgcccgccccgcgctcttcgcccgctccccagggaggatcaatctgatcggagagcacatcgactacgagggctactcggtgttgccgatgaccatccgccaggacatgatcgtgccatccgagggtcacggtgccaggtgagggcgccacgtcgacgacagacccctctgcgctacccgccgcccagacagggaattgcgtaaaaatccaatggggcctatttctggtgacacaggagtatatctgtaacagaggtaatctgcactgtgcctgcgcttgtagaagactagctgtgggctgatctggacctataggcgaatggtgccggggnnnnnnnnnnnnnnnnnnnnnnnnnnnn

SEQ ID NO: 27463 - protein, 103 aa, Zea mays
  misc_feature: Ceres CLONE 1400797-F
  misc_feature: SWISSPROT Homolog: EC 2.7.1.6 Galactokinase
MAALPASTPAPAPAPSEEAELVPTLSSLEPVYGAGAQLDEARLRFARLGDRFHAVYGARPALFARSPGRINLIGEHIDYEGYSVLPMTIRQDMIVPSEGHGAR

SEQ ID NO: 27464 - DNA, 657 bp, Zea mays
  misc_feature: Ceres CLONE 1400800-F
  misc_feature: Encodes the peptide sequence at SEQ ID NO. 27465
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (382)..(382): n is a, c, t, g, unknown, or other
  misc_feature (383)..(383): n is a, c, t, g, unknown, or other
  misc_feature (410)..(410): n is a, c, t, g, unknown, or other
  misc_feature (557)..(557): n is a, c, t, g, unknown, or other
tccccgcggtggcggccgctctagaactagtggatcccccgggctgcaggaattcgcacgagaccatacctagaacatcctaatcgaaaaaccaccatctccagctccatccgcaccaacatctccaccaaccgacacggcgaggagatgaacgcgtcgcagttcatggacaagcagatcctcggcctcgccgcctccgcctccccgtccggcggcggcgcgggggcggtggnnnggtgtggatctcagcgatctgatgatcccgatcccccaggaggacggcgaggaccgtctccgtcgccggcgtagcagtagcagcgtcaacggcacatcagacgacatgctacccagctacgatttccagccgagccggcaccggcgnngccaccgccgccgccccggtgtctcangcctcgtggggatcgttcgactccgagggaccctctgccctctgcctctgcctccagcgccgcttccacaacctcaagaggggtgagatattggagccacatgtgcctagagagggttaatgatgatagaaatagggggtaatttanatacccgttgtgttggggggcaatgaggatacccattgaacacacacccggctgatgcattttgcagggcgaagtgaaggtgtccgtccgccccgttatt

SEQ ID NO: 27465 - protein, 79 aa, Zea mays
  misc_feature: Ceres CLONE 1400800-F
  misc_feature (43)..(43): Xaa is any aa, unknown, or other
  misc_feature (52)..(52): Xaa is any aa, unknown, or other
MIPIPQEDGEDRLRRRRSSSSVNGTSDDMLPSYDFQPSRHRRXHRRRPGVSXLVGIVRLRGTLCPLPLPPAPLPQPQEG

SEQ ID NO: 27466 - DNA, 750 bp, Zea mays
  misc_feature: Ceres CLONE 1400804-F
  misc_feature: Encodes the peptide sequence at SEQ ID NO. 27467
  misc_feature (491)..(491): n is a, c, t, g, unknown, or other
  misc_feature (508)..(508): n is a, c, t, g, unknown, or other
  misc_feature (561)..(561): n is a, c, t, g, unknown, or other
  misc_feature (562)..(562): n is a, c, t, g, unknown, or other
aaagctggagctccccgcggtggcggccgctctagaactagtggatcccccgggctgcaggaattcgcacgagaccattacctaaaacatcctaatcgaaaaatctttttcctttcctaatccctcgtctcgtctcgtcttcgttcccctttcctcctgcgcaccccgtcttctcctccaccgcgtcaaaccccagcacaaatcaaccgcccgccgcctccgctcccctcccgtcccgaatcagccgccgcggtgcccaatccggccgatcccccctcctatccgccgcagagtcggcgcctctgggcctaccccgatgtatagcaacttcaaggagcaggcgatcgagtacgtcaagcaggcggtccaggaggacaatgccggcaactaccgtcaaggcgttccctctctacatgaacgcgctcgagtacttcaagacccatctcaagtacgagaagaacccaaggatcaaggaggccatcaccgccagnttcaccgagtactccgncgcggcgaagaaataccggccgtcctccaaggggcggcgccgggggccccggnncccaacgagggggagagcaaccgtcgccacgcgccccagaccagggggcagggaccggcgaccggggccacccggaaggggatgacctcccaagcagtcaaggtctccaggggcggggctcaacttctgccatcatcaccgaaaaagcccaacgtcagggtgggaaaacgacgtttgctgcccttcaa

SEQ ID NO: 27467 - protein, 89 aa, Zea mays
  misc_feature: Ceres CLONE 1400804-F
  misc_feature (38)..(38): Xaa is any aa, unknown, or other
  misc_feature (44)..(44): Xaa is any aa, unknown, or other
  misc_feature (62)..(62): Xaa is any aa, unknown, or other
MPATTVKAFPLYMNALEYFKTHLKYEKNPRIKEAITAXFTEYSXAAKKYRPSSKGRRRGPRXPTRGRATVATRPRPGGRDRRPGPPGRG

SEQ ID NO: 27468 - DNA, 686 bp, Zea mays
  misc_feature: Ceres CLONE 1400805-F
tccccgcggtggcggccgctctagaactagtggatcccccgggctgcaggaattcgcacgagaccattacctagaacatcctaatcgaaaactccgtcctaacaaaatcctccccgtattgagagccaaagaagaaaaaaaaaaaaggcaggaggccggcgaactacgcgaggaaaaattttctttcccgggaggctcgggagtcggacacgccacacgctttggtcaaaatcgtttccggttgttagcgcggctgctgctgccgctgctgtcgggggcgagcaggaaggggagcgaacgagcttggcagcagaaaaaaaagggggaaccggggaaaggaccctggtggaagcaccctgagtacgcgtggaggagcccgcgccgagaataaggggggaacccaatccgagagacatggactcggagcactggattctcgcgccctggccggccgccaagcgttacttaggcggcgcaagctcggccgggtccgacaaggggccccggaatggggacaccaagaaggggaattgtgcgggtgcaaaacccccgggcaacctgggaaaagggtgttggccgacggccctggaacctcggcaaacgcactgagacgcgagagggcgccggccccaatcgcaaaaaagaaagaaggagcgatacacccaggccacggacgcccgcgagcg

SEQ ID NO: 27469 - DNA, 750 bp, Zea mays
  misc_feature: Ceres CLONE 1400806-F
  misc_feature: Pfam Name: DUF593 Pfam Description: Protein of unknown function, DUF593
  misc_feature (349)..(349): n is a, c, t, g, unknown, or other
  misc_feature (398)..(398): n is a, c, t, g, unknown, or other
  misc_feature (475)..(475): n is a, c, t, g, unknown, or other
  misc_feature (601)..(601): n is a, c, t, g, unknown, or other
  misc_feature (640)..(640): n is a, c, t, g, unknown, or other
  misc_feature (666)..(666): n is a, c, t, g, unknown, or other
aaagctggagctccccgcggtggcggccgctctagaactagtggatcccccgggctgcaggaattcgcacgagaccattacctagaacatcctaatcgaaaagacgggggcgtttctcgatctgacgctcgcctgggcctgcctctgcctcgccgcgctcgccgccgccgccgcgcgcctcctcgcgctcctcggtctcccgctcccctgcacctgtgcgcgcccgcacctgccctgcctcctcgccttcctggtgcgctaccctccccgcgccgtcggatcccttcacgccgccctccgcgcccgcttccccttcgccggccccaccgacgacgaggcacgccttcanaaaaggggtggaggaagagggggggaggaggaaggccatcgatgtgcgnaaggaggaagggggattttcgtcgccgcgtggaggcgcgcgccgagctgcagatggagctcgagaaagagcgcagcngccgcggcgtcggcggccgaggaggccatgtccatgatcctgcgcctgacagaaggagaagtcggcgcttgagattgaggcgcgacagcagcgccgaaccgctgacgagcgctgcgccttctacgnaggacgaggtcgaggagctccgggacatcgtgctcgtgngggaagcgtgaggtgcgcgcgttgcnccaaggaggttgacgcctaccgacgcctgctcggttttagcgctaccgaggaagaccagggaggaggatgaccaacaggagatg

SEQ ID NO: 27470 - DNA, 690 bp, Zea mays
  misc_feature: Ceres CLONE 1400808-F
  misc_feature (225)..(225): n is a, c, t, g, unknown, or other
  misc_feature (238)..(238): n is a, c, t, g, unknown, or other
  misc_feature (291)..(291): n is a, c, t, g, unknown, or other
  misc_feature (296)..(296): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (336)..(336): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (356)..(356): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (375)..(375): n is a, c, t, g, unknown, or other
  misc_feature (376)..(376): n is a, c, t, g, unknown, or other
  misc_feature (384)..(384): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (421)..(421): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (444)..(444): n is a, c, t, g, unknown, or other
  misc_feature (454)..(454): n is a, c, t, g, unknown, or other
  misc_feature (459)..(459): n is a, c, t, g, unknown, or other
  misc_feature (460)..(460): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (492)..(492): n is a, c, t, g, unknown, or other
  misc_feature (508)..(508): n is a, c, t, g, unknown, or other
  misc_feature (510)..(510): n is a, c, t, g, unknown, or other
  misc_feature (526)..(526): n is a, c, t, g, unknown, or other
  misc_feature (534)..(534): n is a, c, t, g, unknown, or other
  misc_feature (567)..(567): n is a, c, t, g, unknown, or other
  misc_feature (568)..(568): n is a, c, t, g, unknown, or other
  misc_feature (578)..(578): n is a, c, t, g, unknown, or other
  misc_feature (579)..(579): n is a, c, t, g, unknown, or other
  misc_feature (596)..(596): n is a, c, t, g, unknown, or other
  misc_feature (604)..(604): n is a, c, t, g, unknown, or other
  misc_feature (612)..(612): n is a, c, t, g, unknown, or other
  misc_feature (629)..(629): n is a, c, t, g, unknown, or other
  misc_feature (630)..(630): n is a, c, t, g, unknown, or other
  misc_feature (637)..(637): n is a, c, t, g, unknown, or other
  misc_feature (646)..(646): n is a, c, t, g, unknown, or other
caaagctggagctccccgcggtggcggccgctctagaactagtggatcccccgggctgcaggaattcgcacgagaccattacctagaacatcctaatcaaaaaggacccttgtttgcctatacgctgccagcctgccttttctaagttcttcttcatcgctccacccccaccccttctctctcgtagcaacgtttggggcgccgtcgctgccgctctactcgggngggcccaagggtntccttttgggggtttgcgggggggccccccctttttcccccccccgggggggngaagnannnnnnnnnnnnncnnnnnnnnnnnnnnnnnnnnccccnccccccccnnncccgccggncnnnnggggnnnngggggnngggggggnggggggnnnggggggggggggggnnnnnnnngggcgnggcggccgnnncccccccccccnccggcccgcngcccnncgccgtgggnnnggcgggcgtcttgttttttnttttttttttgtgggngnctgtcgggttgtgtgnttttctgnttgtttttttgttcgtgtgttttgtttggtgtnntgttgtttgnntctttttctttttgtcntgtggtcntggggggnggggggggcgggcgggnngggggcncggggtggnttggggggtgggcgcggtgtgggggggggtgggttgggtgggtt

SEQ ID NO: 27471 - DNA, 657 bp, Zea mays
  misc_feature: Ceres CLONE 1400812-F
  misc_feature (657)..(657): n is a, c, t, g, unknown, or other
tggagctccccgcggtggcggccgctctagaactagtggatcccccgggctgcaggaattcgcacgagaccattacctagaacatcctaatcgaaaaacccgacccgcctccaactccaagccaagccgccatggcggctccgcccgcgaccaccgccacgactcaccaccgcgcgctcctcccgcccacgcgcacccacgccgccgctacgcactccgcgctccgcctcccgctccgcgcgcatccccacgcccacgcccagcgcgcgcgcctcaccgccgccgctgccccggcccccgcgggcgtcgacggcctccctcgagtcctccgccgcggggaagcctacggtgctcggggccgagaagctcggcggcgcggcgcttgcgctgctgcgagaattcctcgacgtcgactgctcctacggcctctccccgaaggacctccgtgccaagatctcgctctgcgacgcgctcatcggtcaggtccgggaagaaaggtccggccgcgaacatcctctaaggcgacccgggggctagtttcccggcttcgagcacccgcacccggaagtctcaccctcctaaacattatattttattacattaaaaattattatccaaacaaacacattattatctacacaacacggtacaaaaccn

SEQ ID NO: 27472 - DNA, 709 bp, Zea mays
  misc_feature: Ceres CLONE 1400815-F
  misc_feature: Encodes the peptide sequence at SEQ ID NO. 27473
  misc_feature (134)..(134): n is a, c, t, g, unknown, or other
  misc_feature (194)..(194): n is a, c, t, g, unknown, or other
  misc_feature (321)..(321): n is a, c, t, g, unknown, or other
aaagctggagctccccgcggtggcggccgctctagaactagtggatcccccgggctgcaggaattcgcacgagaccattacctagaacatcctaatcgaaaaacatcccagtgccgagtgtccccacacaaccnagcggaagcttcggtcgaacagagggagtaagcagttgcgtttcgcattgcgcggcgccnatgggggcgtcggggaagtggatcaagtcgctggtggccctgaaggcgcccgagaaggcggcggggcacaggggcggtcgcaaatggcgtctctggcggagctcgtcggccacgtccagggcagcgncggcgagggcagtgcgctggcgtccgagtcttcttccgcgtcggccgactcgttcaactcggcctcgcccgccctggtccgggcggcgcccaaggatttcctggtcataggaaagaatgggccggcgttcgcatccataccgccttccggggattcttgggagacggccgttgaagggcctgaaaggcatcctccgggtgcaagggctggggcggcggccggggcggtgggaaggaaatggggcgtcacgccttaaggggatggacgccctggtggggggggggaggaaaacggcccccgggaaagccccgggggcgcccccctcgcgtgatggggcccggcttcaagggggcagggagcgccttcaaggggtggggggaagttttct

SEQ ID NO: 27473 - protein, 78 aa, Zea mays
  misc_feature: Ceres CLONE 1400815-F
  misc_feature (43)..(43): Xaa is any aa, unknown, or other
MGASGKWIKSLVALKAPEKAAGHRGGRKWRLWRSSSATSRAAXARAVRWRPSLLPRRPTRSTRPRPPWSGRRPRISWS

SEQ ID NO: 27474 - DNA, 688 bp, Zea mays
  misc_feature: Ceres CLONE 1400817-F
  misc_feature (215)..(215): n is a, c, t, g, unknown, or other
  misc_feature (309)..(309): n is a, c, t, g, unknown, or other
cgcggtggcggccgctctagaactagtggatcccccgggctgcaggaattcgcacgagaccattacctagaacatcctaatcgaaaaaacgatcggtcgggactccggactcgggagtcggcactcgggtctgcgacgtctcgtctcggctcggctcggctgcccggagccccttggcttcgttccatgcggtgttccgggcggcggtgctaagnaagcgctgaggagcagcgctgtgatgccctacgcgcttctctaggtcggggacctgcttgatcccgatgtcgtacgcgggcgccgtgtcgtgancagcctctaggtccccctgggcgtgatcgccgacgagaaataacggcccctctgggcgggggggtgtgcagtattacctcggcctgcctacgccatcttccagggtgctagaagagcgcgaccatggagaaatgcttggagctagccaggggccggaaggtcaggccagctgggctgcgaaacagccggtgccagccccggtcccgggtgtggccattatggctggtgggacacggagggactggcaagggggggcgcgtggagcccccccactcttttgccgtgaccgcttccagccgtggtccaattgtagccacgtgaaaagggataatgaaatgtcgagaggtcgtctacacaccccaccacacccgtccacaac

SEQ ID NO: 27475 - DNA, 746 bp, Zea mays
  misc_feature: Ceres CLONE 1400819-F
  misc_feature: Encodes the peptide sequence at SEQ ID NO. 27476
  misc_feature (104)..(104): n is a, c, t, g, unknown, or other
  misc_feature (254)..(254): n is a, c, t, g, unknown, or other
  misc_feature (569)..(569): n is a, c, t, g, unknown, or other
  misc_feature (603)..(603): n is a, c, t, g, unknown, or other
  misc_feature (643)..(643): n is a, c, t, g, unknown, or other
  misc_feature (701)..(701): n is a, c, t, g, unknown, or other
caaagctggagctccccgcggtggcggccgctctagaactagtggatcccccgggctgcaggaattcgcacgagaccattcctagaacatcctaatcgaaaacncacctccaagtccaaaagcgaagcctacgcccgccccaacggtgaaaacgtcggaaccctagatccctctcacggtcgcgcctgtgctccaaaaccttagatccgacatgcatcagcccagagcccgctacccacccgggtatggctccngcgggggaggcggtggcgggggaggcggtagtggagtaggaagaggaggcagcggcggcggaggaaaccacaactactacggccggaacacacatccacagcatcaacaccactaccagcagcagcagcagcactcgcataggaactcctcgcaccagcagcagtggctgcggcgagaccagggccccgccgttgcggggccagtgtctggaaacgctgtgcctaagacggcgcctcagcttgacgctgttgactcgagttctcaagattggaaggctcaactaaatataccagctccagacacacgctacaggnacagaggatgtcactgcaacaaaaggcaatgagntttgaggattatttcttgaaacgtgagttgcttatgggantattggaaaaggggattttgaatggcatctcctattcagaagaaagcattcctatggnttgactggaaatgatattcttgcaaggcgaaaatggcactggaaa

SEQ ID NO: 27476 - protein, 129 aa, Zea mays
  misc_feature: Ceres CLONE 1400819-F
  misc_feature (15)..(15): Xaa is any aa, unknown, or other
  misc_feature (120)..(120): Xaa is any aa, unknown, or other
MHQPRARYPPGYGSXGGGGGGGGGSGVGRGGSGGGGNHNYYGRNTHPQHQHHYQQQQQHSHRNSSHQQQWLRRDQGPAVAGPVSGNAVPKTAPQLDAVDSSSQDWKAQLNIPAPDTRYRXRGCHCNKRQ

SEQ ID NO: 27477 - DNA, 671 bp, Zea mays
  misc_feature: Ceres CLONE 1400825-F
  misc_feature: Translation starting site: 448
  misc_feature: SWISSPROT Homolog: EC 1.3.5.1 Succinate dehydrogenase (ubiquinone)
cgcggtggcggccgctctagaactagtggatcccccgggctgcaggaattcgcacgagaccattacctagaacatcctaatcgaaaagttttttcgtctccaccgccgctctcctttccagtctccaccaccgctcgtctccccgtaccgcccgcaacccccctcccctgcgagatccggggcgcgatgtggcgcagctgcgtctcgcggggcctctccagggccaaggcctccgcctccaggctcctctccacggcgtcgtcgtccctacacggtggtcgaccacacctacgacgcagtgggtggtgggggccggcggcgcggggctccgggtggtgatcggcctctccgagcacgggtgtgggggcgcgtgcatcaccaagctcttccccacgcgctcgcacaccgtcgcgcgctcagggaggcataagtgctgcccttggacacatgagggaagatgactggaggggggctatgcatgacactgttaaggcaacctatttgggcgcccgaccccgagtccatgcactaaaggtggggataggcgccaatgggttgtctatgaggttgggatctatggactactcttctctagaactgaaaagggaatggaaatacacgatttctttgtgcgcgatggctcaagttttggttcgagtttctggccctgc

SEQ ID NO: 27478 - DNA, 681 bp, Zea mays
  misc_feature: Ceres CLONE 1400827-F
  misc_feature (449)..(449): n is a, c, t, g, unknown, or other
  misc_feature (553)..(553): n is a, c, t, g, unknown, or other
  misc_feature (558)..(558): n is a, c, t, g, unknown, or other
  misc_feature (571)..(571): n is a, c, t, g, unknown, or other
  misc_feature (629)..(629): n is a, c, t, g, unknown, or other
aaagctggagctccccgcggtggcggccgctctagaactagtggatcccccgggctgcaggaattcgcacgagaccattacctagaacatcctaatctaaaaatcgagctgagctgagcatcatggggtagtgtgtgtgtgaggcgatagagaagctagtgctcataaccaaccaccactcagtcctcctcctctaccctttcccttccgccgcgttcctacttggtcctagagggagagagatctcgaactccaagggcgcatgctccggttgctagctacgatgccgtgtgcgtagctgcggcagcccttgatcgatcaatcgatcgcttgtgcggaaggagccggatcgagtggagtcagctagctagatactccgtggtcggccgtcggtcgtggacgtacgccagaagagggagctagagaagaataccgtacagctgcttccnacatggcagctgcctcgtctgcccaactggtcggacttcgcgacgggcagatggagatgcagccgcagcagcagcaggcgccgcctcctccctcttgtgaacanccggncgcgcgccgccangaaagagcggaccaaccgcagactgaaggggggaggggacgcgctttccccagacgcnatgcgacaaaacggttcgggggtgcagggtgcaaaaaggggttccagcggaa

SEQ ID NO: 27479 - DNA, 711 bp, Zea mays
  misc_feature: Ceres CLONE 1400828-R
  misc_feature (711)..(711): n is a, c, t, g, unknown, or other
cgaattgggtaccgggccccccctcgaggtcgacggtatcgataagcttttttttttttttttttagagacctgtctcataaaaagttctggttaaaccttaagtttagacgttctttttctcgtcgttacagctaatgtgaccaaaactaggatcgtggtgatccctatacccagcaagaccaccacccagggagagcaagtcccgtcgctgcacatcgtgccgatccagccctcctcttgttccgccaactgtctgtgctgccccgccatggattgctgagctttcagcatcagatgttcctgggtaaatattttcttagcatgatcataaagttccatgtcaaggctgttcagcgagataatttgttttaaaattgcatcggggaccagcttccgtgcctctttcgaccaccttgcttcctccactttctttagtgatattttacgacggctagattgggacttccgcagtttagcgatgcaagtttcataagcttccatcagtttagccacagccatatttccttttccttgttcgtcgctggtagagttcagggcttccttattttgccaaccctgtgtgttattcagatgttcgcttgcttcttcatccccgggctccaccatggatgggtgtgagtcagactcactgtgcagatcttcccttgaaatccaaattccatgtcccaaattgtaaaagcccctgtgn

SEQ ID NO: 27480 - DNA, 695 bp, Zea mays
  misc_feature: Ceres CLONE 1400831-F
  misc_feature (258)..(258): n is a, c, t, g, unknown, or other
  misc_feature (346)..(346): n is a, c, t, g, unknown, or other
  misc_feature (355)..(355): n is a, c, t, g, unknown, or other
  misc_feature (398)..(398): n is a, c, t, g, unknown, or other
  misc_feature (442)..(442): n is a, c, t, g, unknown, or other
  misc_feature (695)..(695): n is a, c, t, g, unknown, or other
tccccgcggtggcggccgctctagaactagtggatcccccgggctgcaggaattcgcacgagaccattacctagaacatcctaatcgaaaagtgtcgtcttcctctccgccgcttctcctgtccaccctcgactgcttgcgcgtgacctgagccgccgccgcctacatccgctcatccccgcgcccgcctcaaccacgccgccaccgaccacgtataatcctgcctccccttcgcgcggtttcgaggctcgtttcctnttgggatcgttcgtctgccccgaccgcgtgggcgcttccttcttcgggatctcgctggaccgagcggccagggctaagggattcaggnccatggcgntggcggcgcgtcctcacccagattgcaaggcatcgaccagcanaagcaatctacatggaactagttgctcctccccccctttggggnttcttcgaagtgacatccacttcaggtggcagggattagacatttaccagagaggaaccagtcaagttacattggtagcctgggcacgccggtccgaagactagaatcaccaagcggaacttctctgcttaaagagaattacaagaggggccccagaagggggcatacaataatttgaaaggccaccctccttaatttcaaacctgcagcacttttcggataaggaaaaaggtttgaaagggttagaagcttn

SEQ ID NO: 27481 - DNA, 715 bp, Zea mays
  misc_feature: Ceres CLONE 1400833-F
  misc_feature: Translation starting site: 372
  misc_feature (313)..(313): n is a, c, t, g, unknown, or other
  misc_feature (349)..(349): n is a, c, t, g, unknown, or other
  misc_feature (454)..(454): n is a, c, t, g, unknown, or other
  misc_feature (580)..(580): n is a, c, t, g, unknown, or other
  misc_feature (607)..(607): n is a, c, t, g, unknown, or other
tccccgcggtggcggccgctctagaactagtggatcccccgggctgcaggaattcgcacgagaccattacctacaacatcctaatcgaaaaacaaaatctcatttgagcgtgcaagctccttcgcctcgaaccctctcgcgcttggctttctttcactctccagggctccactcccatctcgccgccgcagccatggcgatcacagcgccaactcccgacatcctcggcgagcgccaatccggccaggacgtccgcacgcagaacgtgatgggcttgcggggcggtggccaacatcgtcaaatcctcgctcgngccccgtcggtctcgacaagatgctagtggacgatnattggtgatgttacaatcacaaatgatggagcaaccatacttaagaatgttggaagttgagcatcaagccgccaaggttctttgttggagttggctgagctccangaccgtgagggttaggagatggaactaaacttccgttgtcatcataaagcggcagagttactcaagagagggcaatgattcttgtgaaaaagaataagatccatccaaccttctataatcagtggncctacaggcttttgctatggcgtgaanctgcaaaataatgtgttggagaaaaaagtaaaaccatcccaaggtttgacaaaacttgggaaaagaatccccttatcaactctgaaaaaacctagcatggtctttcaa

SEQ ID NO: 27482 - DNA, 658 bp, Zea mays
  misc_feature: Ceres CLONE 1400834-F
  misc_feature: Encodes the peptide sequence at SEQ ID NO. 27483
  misc_feature (316)..(316): n is a, c, t, g, unknown, or other
  misc_feature (427)..(427): n is a, c, t, g, unknown, or other
  misc_feature (428)..(428): n is a, c, t, g, unknown, or other
  misc_feature (475)..(475): n is a, c, t, g, unknown, or other
  misc_feature (535)..(535): n is a, c, t, g, unknown, or other
  misc_feature (658)..(658): n is a, c, t, g, unknown, or other
cgcggtggcggccgctctagaactagtggatcccccgggctgcaggaattcgcacgagaccattacctagaacatcctaatcgaaaaagggaccaaatcaactcaagtcatcgagtccacagctcgcgcgcgctgccgccagccaatcgctctgcctccggcctccgcagcccaaaaccacctcggccccacttcttctctccgtcgccccctgtttgcccaacccatggcgacccacgccagcgacaatggcagcgggcacgcggagtggcggttcgctcgtgcggcgaaggagggtgcgctggccgtggccggngacaagatgagcatccggggcggcgcggttcaagatcagcgcgagcgtggacgggcgcgacccgcggcccgtgctgccgcttgcgcacggggacccctcggtggtcccggnncttccgcacgcgccgaggccgaggacgccgtggccgcgcgcctcggnacgggcaaggtcactttaccccggccggggtcggcctcccaaagcccgcggggttctggnggagacctggcaaggggacttccaaaaagttggaactggaggaattttccccccccgtgaggacaagacccagggagggggggctctcaaaccctggcccaaccgggcggaaaataattttcn

SEQ ID NO: 27483 - protein, 122 aa, Zea mays
  misc_feature: Ceres CLONE 1400834-F
  misc_feature (68)..(68): Xaa is any aa, unknown, or other
MATHASDNGSGHAEWRFARAAKEGALAVAGDKMSIRGGAVQDQRERGRARPAARAAACARGPLGGPGXSARAEAEDAVAARLGTGKVTLPRPGSASQSPRGSGGDLARGLPKSWNWRNFPPP

SEQ ID NO: 27484 - DNA, 640 bp, Zea mays
  misc_feature: Ceres CLONE 1400836-F
  misc_feature (638)..(638): n is a, c, t, g, unknown, or other
tggagctccccgcggtggcggccgctctagaactagtggatcccccgggctgcaggaattcgcacgagaccattacctagaacatcctaatcgaaaaaattttctcagtctcgagcgcccgcgtccctcgccccgtcgcgactcgcgacttcgcgagtcgccccgtcccagcctcccagccgtcccggctccccgcgaccccgccctccggcagtccggcgcgggggctcctctccgatccggtgagccgaacgaggatcccaactccccgaagaaagcggccacagacagagccagggtggctcggctctcctctcacagactgcgccgcagcgcctagcgctcggctgacatacgctccggacgtactggcctcgcgtccccgcacctgctgacgacatgcgactgtggtgataacattggactgcagagaccgccctgtctggcccttgagcgttatgagcgactgcaggacggacatgaactcgctgccagacaacggcggcccagatgaccatctcatgcaagcgtcgcgcggaaccatctgacgctgaaagaggaggtcttcatcaccgaggggggaatcatccacgaaatacccatcgggcaaaaagatctccccgaccgcgacgacgaanaa

SEQ ID NO: 27485 - DNA, 688 bp, Zea mays
  misc_feature: Ceres CLONE 1400837-F
  misc_feature: SWISSPROT Homolog: EC 5.4.2.1 Phosphoglycerate mutase
  misc_feature (398)..(398): n is a, c, t, g, unknown, or other
  misc_feature (417)..(417): n is a, c, t, g, unknown, or other
  misc_feature (435)..(435): n is a, c, t, g, unknown, or other
  misc_feature (489)..(489): n is a, c, t, g, unknown, or other
  misc_feature (558)..(558): n is a, c, t, g, unknown, or other
  misc_feature (625)..(625): n is a, c, t, g, unknown, or other
  misc_feature (637)..(637): n is a, c, t, g, unknown, or other
tccccgcggtggcggccgctctagaactagtggatcccccgggctgcaggaattcgcacgagaccattacctagaacatcctaatcgaaaaattaatatcgccgcggcctcgcacctccatctgttctatatcgccccattgctcgctcgccaagagttcttcttgttaggcaaggcaaaagcagaagcaaaaaaagaaaggtcttgttgccgaatggggagctcagggttctcgtggacgcttccggaccaccccaagctccccaaggggaaaccggtgggctgtcgtcgtgctggacggatgggggcgaggccaaccccgaccagtacaactgcatccatgtcgctcagactcctgtcatggactcgctaaagaatggcgctcctgagaaatgagnactagtgaaggctcatgancaagctgtgggtctccantctgatgatgaatggccaccaaggtgaagttggcacaatgccttttgtggttgntcgaattttccgccaaggtgctaaagcttgtcgatcaagctcttgcctccggaaagattattgaagggnaaatggggtccactacatcaaagaactttttgaaagtggtactctccccttaattgggttggtgaangaaaagggggtntcccatccccgtcttggatcaactgcagatacttctgaaaggggggcgggg

SEQ ID NO: 27486 - DNA, 676 bp, Zea mays
  misc_feature: Ceres CLONE 1400838-F
  misc_feature: Encodes the peptide sequence at SEQ ID NO. 27487
  misc_feature (323)..(323): n is a, c, t, g, unknown, or other
  misc_feature (342)..(342): n is a, c, t, g, unknown, or other
  misc_feature (422)..(422): n is a, c, t, g, unknown, or other
  misc_feature (434)..(434): n is a, c, t, g, unknown, or other
  misc_feature (437)..(437): n is a, c, t, g, unknown, or other
tccccgcggtggcggccgctctagaactagtggatcccccgggctgcaggaattcgcacgagaccattacctagaacatcctaatcgaaaaagcacctccattcccagccacgagacgacgaaaccctagcctccctccccctctctcaccaggccaccacctcgccggaacccggcgcctcgaaggagcacgggatcatcggccgccgtcggccgcggctgcggaggagcggtgtaagatgttgaacggcggcggcggcggccagaagaagcggaacacgaagatcgagccctatcggcaccgcgtagagaccgaccccaangtctttcgacagtcgtggncggaagctccatgacgccatccgcgagatctacgacacaacgccagcggtctctccttcgaggagctctacaggactgcnttataacatgtnatngaaacagtttgctcctcagctccatggagaaactcccagaaacatgaaaggagcatcttgaagagagggcacaggtaataagcttggtccaagggggggttgtccccgggaaaaattccccgcaaaatgggatggccctaaacaggggttggacagggttaagaaatcccgggggggatagggggcggggaattatttcccccaaaaaaaaaaaccggtctcaaaagtggtaaagttgg

SEQ ID NO: 27487 - protein, 38 aa, Zea mays
  misc_feature: Ceres CLONE 1400838-F
  misc_feature (28)..(28): Xaa is any aa, unknown, or other
  misc_feature (35)..(35): Xaa is any aa, unknown, or other
MLNGGGGGQKKRNTKIEPYRHRVETDPXVFRQSWXEAP

SEQ ID NO: 27488 - DNA, 699 bp, Zea mays
  misc_feature: Ceres CLONE 1400840-F
  misc_feature: Encodes the peptide sequence at SEQ ID NO. 27489
  misc_feature (415)..(415): n is a, c, t, g, unknown, or other
  misc_feature (416)..(416): n is a, c, t, g, unknown, or other
  misc_feature (536)..(536): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (577)..(577): n is a, c, t, g, unknown, or other
tccccgcggtggcggccgctctagaactagtggatcccccgggctgcaggaattcgcacgagaccattacctagaacatcctaatcgaaaaagtgtgagagctcgattcgttgccgtccacttgtctcacggcctgtcgccatctccttcctggttttttcatccgaccatccccggctcctccgcgccgtcggcgacgactccatcgagtcactcggccgcagcaaccggcgaccatgtaccgagtcgcctccgggctcggcgccctcaagaggcatggggcaaatgctcaaatgatgaatgctgcaattaggtgtgccagcacaagtgtttgcacagaggtcttccgggtggcttgtgggacctggttgacctggtgcgcgttcaaatgaaataccctcctccagatttcaannctttccggggagtgactattccctcctccgctgcctgacccatggggtggaggctggcaaaacaagagtcacaacactttcccaatgggtgttaaaatagcctctgagacatctgcgggnatcatcttggtcctggtggagtttagnnnnnngatttgggnttcgtgtatatgaagcacctggaaacaacaggtgccagtcaaactggttgaagacaatggccttcacaaccactgccaacagggaagtgaatttggtttgtgcgtgaaattgaggcaattag

SEQ ID NO: 27489 - protein, 51 aa, Zea mays
  misc_feature: Ceres CLONE 1400840-F
MYRVASGLGALKRHGANAQMMNAAIRCASTSVCTEVFRVACGTWLTWCAFK

SEQ ID NO: 27490 - DNA, 706 bp, Zea mays
  misc_feature: Ceres CLONE 1400841-F
  misc_feature (313)..(313): n is a, c, t, g, unknown, or other
  misc_feature (323)..(323): n is a, c, t, g, unknown, or other
  misc_feature (324)..(324): n is a, c, t, g, unknown, or other
  misc_feature (366)..(366): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (508)..(508): n is a, c, t, g, unknown, or other
  misc_feature (566)..(566): n is a, c, t, g, unknown, or other
  misc_feature (567)..(567): n is a, c, t, g, unknown, or other
  misc_feature (574)..(574): n is a, c, t, g, unknown, or other
  misc_feature (602)..(602): n is a, c, t, g, unknown, or other
tggagctccccgcggtggcggccgctctagaactagtggatcccccgggctgcaggaattcgcacgagaccattacctagaacatcctaatcgaaaacttcccctctctcgcccctcctccctccgtctcgtctcccaggtcatggcaaaagctggagcaccgggaaaaataacaagtgggagataaacaggaagagctaggtgaataacttggagaaaaaggtcccccacaccccccacgcaggtgaatactacaagtagcagtacaaggaagagagccaatctgcccgtgactgccagtgagttgctcggngtgtggtggnnttagttgaggtcacgatgaatgggaggcgggctgatgatgancccagagcgctgtttccctggcgccacaaaactttcgtggatctcctgcagcagaacggcgacaagaaacctgggcttcgcctcctcatgggccgcagacgtcctccggcgacagtgcgtgatgnnnnnnnnnnnagnnntnatctcggtggacccaccgccagacagcttcccggacggccggtggaggacgacagccnnatgaccnacgttgagggacattcgagggagctggnagcgcccgcatggtggcgcgaccggcatggaagctgaaagcgggctcagggaagctgcaggcagagcccgcggcaaggatccaatgggtttaaagcggtggggg

SEQ ID NO: 27491 - DNA, 682 bp, Zea mays
  misc_feature: Ceres CLONE 1400843-F
  misc_feature (198)..(198): n is a, c, t, g, unknown, or other
  misc_feature (619)..(619): n is a, c, t, g, unknown, or other
  misc_feature (627)..(627): n is a, c, t, g, unknown, or other
  misc_feature (663)..(663): n is a, c, t, g, unknown, or other
  misc_feature (667)..(667): n is a, c, t, g, unknown, or other
  misc_feature (668)..(668): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
ggagctccccgcggtggcggccgctctagaactagtggatcccccgggctgcaggaattcgcacgagaccattacctagaacatcctaatcaaaaaaggccagcgtggaaactggaaaagctgcctccgccaaatccaaaccaaacgggacggtcgccggaggaagcatacccgaaactcccctcccctctccttacnataaccgcgaggcggcggctgacgtcgcttagccgctttcccacaccttcgccgccgcctatactcctgcagaaatagcccgaggggagggcggttgctgctgcatcgatgttcggcgttgcttccctcgccgcacgcgggatccatttgacggacggaccgaccgagcgactcacccggccaccgagagccatggggcagaggtagagccacagaaagggggacgggagcaagcacgatgggcggtggagctcctttcagcagcaggcgtcggtacagtgagcggccggtggatgaggccactaagagcagaacccaagcaccggctactacggagcgccggtggcacaacaggggaggagggtactaccagacggacccaggcaccggctactacggcgcggcggtgccacagcagggnaggagggnacgccgcgccggaccggaacaagcccgcccgctggngccnntgctgggtcnnnng

SEQ ID NO: 27492 - DNA, 750 bp, Zea mays
  misc_feature: Ceres CLONE 1400844-F
  misc_feature: Translation starting site: 172
  misc_feature (576)..(576): n is a, c, t, g, unknown, or other
  misc_feature (588)..(588): n is a, c, t, g, unknown, or other
  misc_feature (604)..(604): n is a, c, t, g, unknown, or other
  misc_feature (605)..(605): n is a, c, t, g, unknown, or other
  misc_feature (642)..(642): n is a, c, t, g, unknown, or other
  misc_feature (686)..(686): n is a, c, t, g, unknown, or other
  misc_feature (709)..(709): n is a, c, t, g, unknown, or other
caaagctggagctccccgcggtggcggccgctctagaactagtggatcccccgggctgcaggaattcgcacgagaccattacctagaacatcctaatcgaaaaattccacccgcttcccccagcctcacgaaaccctaacgccgccgccgcttcacaggtaagccgccgtcatggtctccggttccggcgtatgcgcgaagcgcatcgtggtggacgcgcgccaccacatgctgggccgcctgtcgtcgattatcgccaaggaactgctcaatgggcagaaggtggtcgtcgtccgctgcgaggagatctgtatgtcgggtggactcgtacgccagaagatgaagtacctccgctttctccgcaagcggatgaacaccaagccatcccatgggcccatccacttccgcgccccgtccaagatcctgtggcgcaccatccgcgggatgattccgacaaagaaccaaagaggggggaggcggctctggcgaggctcaagacgtacgagggcgtcccgccgccgtacgacaagaccaagcgcctggtcatccctgacgctcttaaggtcctgaggctgncacctggacacnagtactgcctccttgnntgagctttctaggaggtcggatggactacatgaacantccagggagctttggagagaagaggaggagaaagctagggtggnctatgagaggaggagcagctggncagctgcgcctaaagctgagctacgccgaggaaaaagtagg

SEQ ID NO: 27493 - DNA, 743 bp, Zea mays
  misc_feature: Ceres CLONE 1400846-F
  misc_feature: Translation starting site: 239
  misc_feature: SWISSPROT Homolog: EC 3.6.3.14 H(+)-transporting two-sector ATPase
  misc_feature (709)..(709): n is a, c, t, g, unknown, or other
aaagctggagctccccgcggtggcggccgctctagaactagtggatcccccgggcttgcaggaattcgcacgagaaccattacctaagaacatcctaatcaaaaacccagatctcatctgcgacgacctcctccctcccgatcccgctccgtctccccccaccgccaccgctgccgctgccgcctcccccaccgaggtcttgtcttcggcgatccagccggagcccgcggcggcgacgatgtacgggtgggagatgctgtcgttcaacatacacgatgggttcctggaggccatcgtgcggggcaaccgctcgggcctcctcaccgccgccgactacaacaacctctgccagtgcgagaccctcgacgacatcaagatgcacctcaccgccaccgagtacgggccctacctccagaacgaaccttcacccttgcacacaacgacatttgtggagaagtgcactcttaaactagtcgatgagtacaagcacatgctgtgccaggccactgaaaccactatctacgtttttgcagtatataacttatggccactgatttgacaatgttgtctttattgtaactgggacactgcatggagagagatgttaacgaactttttggagaatgccacccatttgggcatgtttgacagcattgcattcacttgctgttgctcaaacatgcggagctttttatagaattggtctagncgatacacactgggcccttaacttctcaagtgat

SEQ ID NO: 27494 - DNA, 686 bp, Zea mays
  misc_feature: Ceres CLONE 1400849-F
  misc_feature: Encodes the peptide sequence at SEQ ID NO. 27495
  misc_feature (663)..(663): n is a, c, t, g, unknown, or other
ccccgcggtggcggccgctctagaactagtggatcccccgggctgcaggaattcgcacgagaccattacctagaacatcctaatcgaaaaagcaaactgtcccctccctgcgcgctgtgcaccttcgcagcttgctatgctcacttcgctccgtacgtgctcttcctcgcaggcgcttctagtgacttctccccgggttccgcccaaatgaggcgtacctgcctgcgccattcagccgcggccttcgcatagttcgtcgcgccctacccattctcgtcctaccgcggtgctgacactgccgagctatcagggcgaacaaaactggaataacggaaatcacattagtgcataatgaatgctgaggcagaaagcaccagtatgttaccgctgtcatggttgtcatatgggtccaagatcaatggttccaatacaagtaccaccatcatcagactttgagagtatcctgtcaccagagccaatctacagtgatcttcagttgaaagagatgaactacaatgcagcagcaatggatgaaagcactgagttccttcacttgattcttagtggcaatgatgaaggaacaatagcacactgaattacaggtttggggatgttgggggacttctatgtctcagaaaacttttctgctctccatttgatagnttggatgggttttacaaatggag

SEQ ID NO: 27495 - protein, 79 aa, Zea mays
  misc_feature: Ceres CLONE 1400849-F
MLRQKAPVCYRCHGCHMGPRSMVPIQVPPSSDFESILSPEPIYSDLQLKEMNYNAAAMDESTEFLHLILSGNDEGTIAH

SEQ ID NO: 27496 - DNA, 674 bp, Zea mays
  misc_feature: Ceres CLONE 1400854-F
  misc_feature (397)..(397): n is a, c, t, g, unknown, or other
gctctagaactagtggatcccccgggctgcaggaattcgcacgagaccattacctagaacatcctaatcgaaaaaaattcaatccggtctcagtggttggcccgccgctgccagtgccagatcgaatcggactctcggctcgtgtgcagcccaccggcgagacgccgaagctatatttttatgcccatctgatccgatgcgtggtgtggcgtcgtctccgcttttactagatcatcagtagccagctcaggagccgagcctggtcagggtagccaagcccatcccggtcctctcccggcgtcttctccctccgcaccgcggctccggcgatggcgcccgtcggctccgcgctgcgtcggctctacctctccgctaccaactgggtcgtcttcttcgnatggggcgcagggctgttaactacgcgggtctgaccgctgcggtttgagcggccacaaggcgccttacgccggccgtcgaggggcccgcctgcagtttcgcgcagacgccgcccttttggggggaacgttctgggcccccgaaggggttgggggaagggtctccggcccccggcagattttcccaagattggtgtcccggattgtcccttgacggagttggccctctggaaaagtttcccccaaaacccactgcgcgccttcttggggtttacccgg

SEQ ID NO: 27497 - DNA, 740 bp, Zea mays
  misc_feature: Ceres CLONE 1400855-F
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (29)..(29): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (62)..(62): n is a, c, t, g, unknown, or other
  misc_feature (63)..(63): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (288)..(288): n is a, c, t, g, unknown, or other
  misc_feature (295)..(295): n is a, c, t, g, unknown, or other
  misc_feature (440)..(440): n is a, c, t, g, unknown, or other
  misc_feature (508)..(508): n is a, c, t, g, unknown, or other
  misc_feature (509)..(509): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (549)..(549): n is a, c, t, g, unknown, or other
  misc_feature (650)..(650): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (718)..(718): n is a, c, t, g, unknown, or other
  misc_feature (719)..(719): n is a, c, t, g, unknown, or other
nggggggggnnnggnnggggggggggggnggggggggggggggnnngaaggggggggggggnngtccccgcggtggcggccgctctagaactagtggatcccccgggctgcaggaattcgcacgagaccatcacctagaacatcctaatcgaaaaacatcgatcagtcgcgtgtctaggtttcccctctcaccatagcgcccgctctgtcgcccttcgttcacctctccttcctctcctccctgactgccagggagaggggatttcccaccccgccccgnnngggggnggggggncccgggggtctttccctgagaaaaaacataaagattggggggatcttccccccccggggggtttttggggggagggaaaatattttcgcgggggggggagaaccctttttttctctcgaaaaaaaacctcccccctataaatagnaaaaaaagaggggggggcaccccccccccccagggaaggtggggggttttttcccccccccccccccnncccgggggggggggggccccccccaaaagagcgaannncncggaaaagaggaggggcgtcgggttccccccccccccagggaaagatttgggggggggaaaaaaaaattatttgttgcgggggggggcggggggggggggnggggggccccccccccccccnnnaaaaaacacccccccccccccccccccccggggggaaannnnatnnggtgtggtggcgggaaaaaaa

SEQ ID NO: 27498 - DNA, 689 bp, Zea mays
  misc_feature: Ceres CLONE 1400856-F
  misc_feature: Encodes the peptide sequence at SEQ ID NO. 27499
tggagctccccgcggtggcggccgctctagaactagtggatcccccgggctgcaggaattcgcacgagaccattacctagaacatcctaatcgaaaactctccccaccggctaaccctagcagcggcacgcgggcgacggcgaccagtagagggctagtcgcgccaccggcgaagggattcagcggtctacccgtcctccgacacaggcgcggcggcgtcctgcagattattattggtttgttgcaaaatgtctacggaagtgactttgaacaattctggtggttctgaatctgcattgctgttactggaacagcttgctgaagtttttggaaagttgaaactcacaccgaaacatttctgcaattgcaaaatggcataaaatgggaagatattgaagggcatttcctcagccttgatgagtcgaacagaagcaagtttgatgaactggtagagaaggagaaggctttaaaagaaaaaaaagctgaaactttgaaaaattgttggcaagaaaagaaggttaaagtttcctaccaaggaacatggccctcccctggaatccagctttcaggaacttaaggggatggcttgctgttctctttctcctagaaaagggtttccgacacaaaaaaaataagggcgggagcttttgcttgaaaaatactttgaaagacaaagtgggaaaaccaaa

SEQ ID NO: 27499 - protein, 43 aa, Zea mays
  misc_feature: Ceres CLONE 1400856-F
MSTEVTLNNSGGSESALLLLEQLAEVFGKLKLTPKHFCNCKMA

SEQ ID NO: 27500 - DNA, 667 bp, Zea mays
  misc_feature: Ceres CLONE 1400860-F
  misc_feature: Encodes the peptide sequence at SEQ ID NO. 27501
tcaccgcggtggcggccgctctagaactagtggatcccccgggctgcaggaattcgcacgagaccattacctagaacatcctaatcgaaaagtcatagagagccacaggccacaggcaagacaggcaggaggatcggacgagtcggcgaggaagctgcctgcttttcagatagagttattaagatggcgttgcttcggctgcttgccctgatctccctgctcttcgcagtggccactcctgtcagggacatcgcccacgatgcctgctcgtcagaagtgaaggatttccagcacctgaacaacagctcggggctccacctgacgctgcaccacccgcagagcccctgctccccggcgccgctgcccgccgacctccccttctccgcggtgctcgcccacgacggcgcgcgcatcgcgtcgctcgccgcgcgcctcgccaagacgccgtcctctcggcccaccttgcttgacgagagccgcgcggggtcgtcgtcgtcgtcccccgatgacgagtccctcgcgtccgtgccgctcggcccaggcacgtccgtcggcgtgggcaactacgtcacccgcatgggccctcggcacgccggcccagtcgtacgtcatggtcggtgaacacggggtccttcgctcacctggctcccgtgctccccctgcggtg

SEQ ID NO: 27501 - protein, 145 aa, Zea mays
  misc_feature: Ceres CLONE 1400860-F
MALLRLLALISLLFAVATPVRDIAHDACSSEVKDFQHLNNSSGLHLTLHHPQSPCSPAPLPADLPFSAVLAHDGARIASLAARLAKTPSSRPTLLDESRAGSSSSSPDDESLASVPLGPGTSVGVGNYVTRMGPRHAGPVVRHGR

SEQ ID NO: 27502 - DNA, 612 bp, Zea mays
  misc_feature: Ceres CLONE 1400861-F
  misc_feature: Encodes the peptide sequence at SEQ ID NO. 27503
ggagctccccgcggtggcggccgctctagaactagtggatcccccgggctgcaggaattcgcacgagaccattacctagaacatcctaatcgaaaaagccagcaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggcggaatctcccgggacgcctctccgtccgcgcctccgcgacggtggtagcggcaccgcggcgggagacggatcccaagaagcgggtggtgatcacggggatggggctggtctccgttttcgggaacgatgtagacgcttactacgaccgcctgctagtcggggagagcggcatcgggcccatcgaccgcttcgacgcttctaagttccccacccgctttggccggccagatccgggggcttctccttcgagggatacatcgaccggaaagaaagacccgccgccttgatgatggcctcccgaaactgggatcctcagggggaaagaaag

SEQ ID NO: 27503 - protein, 115 aa, Zea mays
  misc_feature: Ceres CLONE 1400861-F
  misc_feature: SWISSPROT Homolog: EC 2.3.1.41 Beta-ketoacyl-acyl-carrier-protein synthase I
MQSLLLPTAAVAPVAPPCGRRNLPGRLSVRASATVVAAPRRETDPKKRVVITGMGLVSVFGNDVDAYYDRLLVGESGIGPIDRFDASKFPTRFGRPDPGASPSRDTSTGKKDPPP

SEQ ID NO: 27504 - DNA, 668 bp, Zea mays
  misc_feature: Ceres CLONE 1400868-F
  misc_feature: Encodes the peptide sequence at SEQ ID NO. 27505
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (526)..(526): n is a, c, t, g, unknown, or other
  misc_feature (527)..(527): n is a, c, t, g, unknown, or other
  misc_feature (635)..(635): n is a, c, t, g, unknown, or other
  misc_feature (636)..(636): n is a, c, t, g, unknown, or other
  misc_feature (668)..(668): n is a, c, t, g, unknown, or other
cgcggtggcggccgctctagaactagtggatcccccgggctgcaggaattcgcacgagaccattacctagaacatcctaatcgaaaatttttctgctgcccagccgccgtccgtccgcgcttcactatccttcattccctcccctgtcagcgacgactgggtaggctaccgccgccgccctacgctaggtgcccatctcttcgccggcgaagagcgcccaccaagctccggccaagggcgtgatggcggctgtaggcagcttgaagccggggatggagactcttcatgtgcaggactacaaggacgcgcctccggccaaggccgcggtagagagcctccagccggcgatggagagtctgcatgtgcaggattacaaggacgcgcctccggccaagggcgtggccgccgccgccgccgtagggagcttgcagccgnnnggcggagatcctgcaggtgcaggactacaaggacgctaacatggtattatggtgcttacccggcttatgcctatggagcctatggtggnntgggggggagtacccatacctgagccatgatggagcacagacaccaactgctggtacctatgctgacatgtactatggtatgcttcccatatggtgttgcaccatggnngcatgatggtcaagatttatgggtcacagaan

SEQ ID NO: 27505 - protein, 77 aa, Zea mays
  misc_feature: Ceres CLONE 1400868-F
  misc_feature (65)..(65): Xaa is any aa, unknown, or other
MAAVGSLKPGMETLHVQDYKDAPPAKAAVESLQPAMESLHVQDYKDAPPAKGVAAAAAVGSLQPXGGDPAGAGLQGR

SEQ ID NO: 27506 - DNA, 657 bp, Zea mays
  misc_feature: Ceres CLONE 1400877-F
  misc_feature: Translation starting site: 181
  misc_feature (270)..(270): n is a, c, t, g, unknown, or other
  misc_feature (306)..(306): n is a, c, t, g, unknown, or other
  misc_feature (326)..(326): n is a, c, t, g, unknown, or other
  misc_feature (331)..(331): n is a, c, t, g, unknown, or other
cgctcttgaactagtggatcccccgggctgcaggaattcgcacgagaccattacctagaacatcctaatcgaaaagagctgagctctagtgatagactggtaggtcctagctgcgcgcacgtgcactaggagggagccatactgcgcgcgcggcattccgtccatcgtcggtcgattggtatggcgggtcgtcggggcgactcggcgcctgcggcgccgttgctggagaacaaggcggcgccggcgtcggaggcggaggcgggcggcggntaccaccaccacaactactactactacgtggacggntggcccggggtgcgccgtgnaccgncgcaaggcggcgagcccgggcatcccctacgccaacttcatctacgtctggatcgtcaccctctgcacagccctacccatctcatcgctgttccccttcttgtatttcatgataagggacctggacgtcgcttgaaagaccgaaaaattcggcttctacgccgggttcgtaggggccccggtcatggtccgaaaaaggttgacttccacccgctgggggataagggggacccgattggggggaaccctggcccccgggttcggaacccccctggggccgggttaaacccggggtggccctgaggaaaataagggtggccccccccc

SEQ ID NO: 27507 - DNA, 644 bp, Zea mays
  misc_feature: Ceres CLONE 1400878-F
  misc_feature (389)..(389): n is a, c, t, g, unknown, or other
  misc_feature (453)..(453): n is a, c, t, g, unknown, or other
  misc_feature (486)..(486): n is a, c, t, g, unknown, or other
  misc_feature (541)..(541): n is a, c, t, g, unknown, or other
tccccgcggtggcggccgctctataactagtggatcccccgggctgcaggaattcgcacgagaccattacctagaacatcctaatcgaaaaatgcgtaatcgtctttcggaattgaatctctccatgtcatggcgctctgagcaagtacagctgcagtcagtgagagaaatgtaggcaccacaaatcagtccagcaaatccctgctcgtgctctaccaaaaaatccagtctttttccagcccaaatccgcctcttccgctgctgccataaagtccggactttacgaggctttcacgacgtgcgagatttctgttatcgatctccacgaacccgatagcctgccataaagtctgcacagacgcttcgcattgcttcaaccaaagatccantcaaactctgcaccccagaaagctagtacgatctcggggggacatgaagcgcctgcagtgcttncagcagagcagcgggcgcgcaaatggtggcggncccgggaagcgccttgagcgcggctgtccctggcgatacaaaaaagcaagggtcngggccaagaacctcgtaccgccgcaggcgccaggatcccgggcgggggaaaaagaattggggaaccccacctgccaaagtgggaaaaccggggaaaggttggg

SEQ ID NO: 27508 - DNA, 660 bp, Zea mays
  misc_feature: Ceres CLONE 1400881-F
  misc_feature: Encodes the peptide sequence at SEQ ID NO. 27509
  misc_feature (488)..(488): n is a, c, t, g, unknown, or other
  misc_feature (511)..(511): n is a, c, t, g, unknown, or other
  misc_feature (605)..(605): n is a, c, t, g, unknown, or other
  misc_feature (660)..(660): n is a, c, t, g, unknown, or other
cgctctagaactagtggatcccccgggctgcaggaattcgcacgagaccattacctagaacatcctaatcgaaaaacaagccaaacgtgcagctgaggaatcgcaacggcagtgacgtgtgcgcgttgccaaataaagctactatactagtcaccgctcgattgccgtcgcagccgcccgccggccggagatgggtgcgccggcgctgtcgtccgtcgtcgtggtggccacggcggcagtggtttgcctgtgcggggcctttgcgcaggcgcaggacatggacagcgagtgggcgcggccggcctaccgcgggttcttcggcgccccggccgggtcgctgctgccgcagtcggacgtggacctgctggagttcccgctgaacctggagtacctggagacggagttcttctgctgggtccgctctggggtacggcctcgacgccatcgacgccacctcaaccggcggcgggcgcccttccatcggcggnccagtccgcgtccctcacccgtnaattcccgcgagggcaaccccccagtctgtttaccaagaagtcgggaccctcagggcgtcaagcaaaaacgttgaggggtttccccgaggccgntgctggacatcagcgcggccaactttcggcaagatcatcgagcaagcgctgaaan

SEQ ID NO: 27509 - protein, 131 aa, Zea mays
  misc_feature: Ceres CLONE 1400881-F
  misc_feature (100)..(100): Xaa is any aa, unknown, or other
MGAPALSSVVVVATAAVVCLCGAFAQAQDMDSEWARPAYRGFFGAPAGSLLPQSDVDLLEFPLNLEYLETEFFCWVRSGVRPRRHRRHLNRRRAPFHRRXSPRPSPVNSREGNPPVCLPRSRDPQGVKQKR

SEQ ID NO: 27510 - DNA, 659 bp, Zea mays
  misc_feature: Ceres CLONE 1400882-F
  misc_feature: Encodes the peptide sequence at SEQ ID NO. 27511
  misc_feature (355)..(355): n is a, c, t, g, unknown, or other
  misc_feature (361)..(361): n is a, c, t, g, unknown, or other
  misc_feature (365)..(365): n is a, c, t, g, unknown, or other
  misc_feature (366)..(366): n is a, c, t, g, unknown, or other
  misc_feature (373)..(373): n is a, c, t, g, unknown, or other
cgctcttaactagtggatcccccgggctgcaggaattcgcacgagaccattacctaaaacatcctaatcgaaaaagaggctaaacccccgtctaaccctgctgccgtgccgcttgccactactccgcttcgttctccgccgcctccccggacgtccggaaacttctagattgaagggggatagccattggcgtcaacgtgtgtgatggaggtcaggggactggggcagctcctggcggcgctggccgcggcgttcttcgtccgcgccatcgcgggacccggccccgccctccttccgccggcggaggacacggaggccgacgaggccgacgcggaggctggcgagggagggtggntggtgntgtnncccccgngaccattccgggggctcgcatcacctgcgcactgaagaacaagggtggggaagtggcacggtttctgttggcaaatgggtccggggaggcgaaaaccggtgaggctgcttgaactattgggcccatcgggctctgggaaaacaacttttagtcactgcgctagcagggaatcgcgccgcattgtctttcttgcatcttttcgcggatcttcgttgcagcgtggtccgcctatcctcgcccgcggtctattcgcacggctggaatcggcacgaagacatgataccag

SEQ ID NO: 27511 - protein, 67 aa, Zea mays
  misc_feature: Ceres CLONE 1400882-F
  misc_feature (51)..(51): Xaa is any aa, unknown, or other
  misc_feature (53)..(53): Xaa is any aa, unknown, or other
  misc_feature (54)..(54): Xaa is any aa, unknown, or other
  misc_feature (57)..(57): Xaa is any aa, unknown, or other
MEVRGLGQLLAALAAAFFVRAIAGPGPALLPPAEDTEADEADAEAGEGGWXVXXPPXPFRGLASPAH

SEQ ID NO: 27512 - DNA, 640 bp, Zea mays
  misc_feature: Ceres CLONE 1400884-F
  misc_feature (211)..(211): n is a, c, t, g, unknown, or other
  misc_feature (237)..(237): n is a, c, t, g, unknown, or other
  misc_feature (293)..(293): n is a, c, t, g, unknown, or other
tggagctccccgcggtggcggccgctctagaactagtggatcccccgggctgcaggaattcgcacgagaccattacctagaacatcctaatccaaaaacaccaacccgttctgcctccgcttcgatcatggggtggtcgcgctttcgtcgccgccatcaacggtgtcgctatctcctccctatccggcgtccgcgatgctcgccacccctncctcccccacgcgtcgggacgctcgnccatgggctcgcctccctcccctccggtccgctcgctcccttccgcccttcgtcgnggcgcttggaaaaggtcagcagccccaactccccagcgggcctctcgcccactctccctgacgccggatccccgcgtcccacattggcgggggtgggtcgacccagtccgtcatgcctgaggggaattttccacacggccggggggggttcgcctcggcgcggttcgaaaccgcccccgaggggaaccaaaaagcccccccaccccgggggggcccccccaccccccttccacacaaaaccgcgattccccgccccaaggggaaaacggggggttccccccccccccccgggggccccccccccccgcggagaacccccccgggccgtggaaagaaaggggccaccc

SEQ ID NO: 27513 - DNA, 667 bp, Zea mays
  misc_feature: Ceres CLONE 1400886-F
  misc_feature: Encodes the peptide sequence at SEQ ID NO. 27514
gctcttgaactagtggatcccccgggctgcaggaattcgcacgagaccattacctagaacatcctaatcgaaaactaggctttcagccgctctcctagtctcctactctcctctcagccgtcgccgtcgctctccacaccgctctcctctctcctccgagccgcagctcttctctctccctctcccctgcgtgccgccactgcgggcaccctgcacgccgccgctgcgtggccctacacgccaccgctacgggtgccctacgcgccgccgtcactgctccagctctcctctgtttcccagccaatgccgccgctctaactccccaaggcatcgccccgacgacggctcaacgaagccccgtcgacgcctcgcggacgccctgcgccgcagcgggcgctttacgctccatggcaaggcgcgttagatgcctcaggttccacaggcgccttagcgcctaagcgacgctaaggcggcgcttcagataagcatgcttttgaataagatgggaaggattaaagctcatgtgaaagattctaagactacatttgctatccaagcggttgcttttcttatttcccaaaagctcaaccaggctcctggatggttaaggattccagcaaaggaaaaagacttccagtggaaaaaaactaattttggggccggaact

SEQ ID NO: 27514 - protein, 60 aa, Zea mays
  misc_feature: Ceres CLONE 1400886-F
MLLNKMGRIKAHVKDSKTTFAIQAVAFLISQKLNQAPGWLRIPAKEKDFQWKKTNFGAGT

SEQ ID NO: 27515 - DNA, 659 bp, Zea mays
  misc_feature: Ceres CLONE 1400888-F
  misc_feature: Translation starting site: 138
  misc_feature: SWISSPROT Homolog: EC 1.6.99.5 NADH dehydrogenase (quinone)
  misc_feature (489)..(489): n is a, c, t, g, unknown, or other
  misc_feature (598)..(598): n is a, c, t, g, unknown, or other
gctctagaactagtggatcccccgggctgcaggaattcgcacgagaccattacctagaacatcctaatcgaaaagatctccccaatccgaccagaccggcaggcaccttcgactcgagcggagcaggcgaggcagagatggcgctgcgacgggcgctcctcagatcggtcaacttctcccccgacagcaaggctgcaattgagtacttttattctttctcaagggcacagtctgcttgttctctcaatggtgctggtctttgtcctgctagtagatcatttagcacccaggctgccactacgtcaagcacaccacagcctccacctccaccaccccctccggagaagactcactttggtggtctcaaagatgaggatcgcattttcaccaacctctatggtctgcatgacccttttctgaaaggcgcggtgaagagaggtgactggtataggaccaaggatttggtgattaaggcggcagactgatggntcattgaaatggaagaatcaggtctttcgggtcgtggagggtgcaggttttccctctggtctgaaatggcctttatgcccaaggtttctgatggacgccttccttatcntggtgttaatggctgatgagagtgagcctgggacttgcaaagatagagaatcatgcgccaa

SEQ ID NO: 27516 - DNA, 656 bp, Zea mays
  misc_feature: Ceres CLONE 1400898-F
  misc_feature: Encodes the peptide sequence at SEQ ID NO. 27517
  misc_feature (510)..(510): n is a, c, t, g, unknown, or other
  misc_feature (537)..(537): n is a, c, t, g, unknown, or other
  misc_feature (613)..(613): n is a, c, t, g, unknown, or other
gctctagaactagtggatcccccgggctgcaggaattcgcacgagaccattacctagaacatcctaatcaaaaaaggtcgagcctagggttagggtttcgtccctccggccccgattcgaaccaatccgcctcggcctccgccgcgccatggccgccggctccatcgtggtggacttcccttccatgggcgccgccctctgcttccccagcctcgattcactcctccgcgactccgcctcgggcttcctcgctgccgtctccaacgccccagcccccggcgcagccgacctcaccaactttcaccgcgtcttctcgcgcgtcctcagcgcctacccggacccaccgctcgaggctgtctggttcttctccgcgctctccttccacgaccgtcccgacgacctccgctccctgctccagctcctctccgccttcaccgcctcctcgcccggcaccgccaagccgcttgcccttctcgccccctgtcgtttccgagctcttccacgccgaanagccgcgcagggaacgagaccctcccnttttgagggcgtcctcagctacatcagcatctgcagcaaccgcttgccccttttttaaaacggtgggggccacggnaaaacgctgtgaggctgctgcccggcccttgggggagctcggc

SEQ ID NO: 27517 - protein, 148 aa, Zea mays
  misc_feature: Ceres CLONE 1400898-F
  misc_feature (121)..(121): Xaa is any aa, unknown, or other
  misc_feature (130)..(130): Xaa is any aa, unknown, or other
MAAGSIVVDFPSMGAALCFPSLDSLLRDSASGFLAAVSNAPAPGAADLTNFHRVFSRVLSAYPDPPLEAVWFFSALSFHDRPDDLRSLLQLLSAFTASSPGTAKPLALLAPCRFRALPRRXAAQGTRPSXFEGVLSYISICSNRLPLF

SEQ ID NO: 27518 - DNA, 667 bp, Zea mays
  misc_feature: Ceres CLONE 1400901-F
  misc_feature: Translation starting site: 305
  misc_feature: SWISSPROT Homolog: EC 2.7.11.1 Non-specific serine/threonine protein kinase
  misc_feature (476)..(476): n is a, c, t, g, unknown, or other
  misc_feature (529)..(529): n is a, c, t, g, unknown, or other
  misc_feature (549)..(549): n is a, c, t, g, unknown, or other
  misc_feature (643)..(643): n is a, c, t, g, unknown, or other
ccccgcggtggcggccgctctagaactagtggatcccccgggctgcaggaattcgcacgagaccattacctagaacatcctaatcgaaaattttcccctcctccctcctcggctcgtctctgttcccctttccctcctgcgcaccccgtcttctcctccccgcgtcaaaccccagcacaaaaagcaaccgcccgccgcctcctcgctcctctcccgaatcagccgtcgcggtgcctaatccggccaaccccccctccgatccgcgggtgcccgccgcagaggcggcgcctccgggcctcccccgatgtatagcaacttcaaggagcaggcgatcgagtacgtcaagcaggcagtccaggaggacaatgccggcaactacgtcaaggcgttccctctctacatgaacgcgctcgagtacttcaaaacccacctcaagtacgagaagaaccccaagatcaaggaggccatcaccgccnagttcaccgagtacctccgccgcgccgaggagaatccgggcggtcctcgatanggggcggcgcatggcggggnccccaaacgggtgggaaacgcagctgtcgccacgcgccccaagacagggggcaaggaattggggacggaggccaccgggaggggatgaactccngagcagtccaaggctttgaggggc

SEQ ID NO: 27519 - DNA, 672 bp, Zea mays
  misc_feature: Ceres CLONE 1400903-F
  misc_feature (179)..(179): n is a, c, t, g, unknown, or other
  misc_feature (277)..(277): n is a, c, t, g, unknown, or other
  misc_feature (305)..(305): n is a, c, t, g, unknown, or other
  misc_feature (306)..(306): n is a, c, t, g, unknown, or other
  misc_feature (320)..(320): n is a, c, t, g, unknown, or other
  misc_feature (321)..(321): n is a, c, t, g, unknown, or other
  misc_feature (333)..(333): n is a, c, t, g, unknown, or other
tccccgcggtggcggccgctctagaactagtggatcccccgggctgcaggaattcgcacgagaccattacctagaacatcctaatcgaaaagaatataaggcaaaaattctgggccggccactgcccagatcccgccgacattctccaaaccaaccgtggcggcgatgaggaaggcggnggtgacctccgcctccagcggtggaggagaaggatgccgtgcggtggtggcctcaacctcggtgtgaagctgaacgtgctgctactgctggtggtggntggcacccaatctggtgtccctggtacnnactctccctcgggnncgcaccgttggncgccggtccttctccaggagcaacggtgacggcgacaaggatctggttcttgatcccggcagctggaaagcatccgcggcgggggggggcccaagtttgaccaactcccggttggtggtccccttccccgccggtttcgggcgggggggggtttgggctttaaatccccgccttggcccccgggggatatccgctgggtcccgggaacccgggggtttcctcccccgggtaaaggggcaaaaattccccaaaggggttttggccccgaaaaaacccctttttccttgggcgagggcctcccctcctcccccggggtggcgcaccccccccccccggggg

SEQ ID NO: 27520 - DNA, 658 bp, Zea mays
  misc_feature: Ceres CLONE 1400906-F
  misc_feature: Encodes the peptide sequence at SEQ ID NO. 27521
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (464)..(464): n is a, c, t, g, unknown, or other
  misc_feature (488)..(488): n is a, c, t, g, unknown, or other
gctctagaactagtggatcccccgggctgcaggaattcgcacgagaccattacctagaacatcctaatcgaaaaaacgcctccaccacgaggcacgcaacaattagaacacatcttgccgccgccgaggacgacggcgatgatgtggcgttcgcgagctcgtgcgctgctcctactccgctcgaccattacccggccaccgccaccacctccacaaccatatcccactcgaaccctaacccgagtcccacctccccgcttcctgtcctcctccccggatcccatccccgattcctcctccgccgccgccgcggatcccttccctgaagccttctcctccccgaccaaggcttctcaagatgccgctgaggccggagaggaaacctgagctcgatgtgggaggaagctggcgacgccgacgacatctttgcctccccggcagcgccgacgccgtagcgacnnnanggaggaggtcgcccgatcctgcgnccggccgtggagtccacccccgggaggacgagatcgcctccaccctcgctgacatgaaccggtggacttcaacgagccctcccctaggcgcagtccttctttgctgctgatcaatggctcctgtaaaaaagttgatttccctgtttcactaatgcccgcgaagaataacc

SEQ ID NO: 27521 - protein, 82 aa, Zea mays
  misc_feature: Ceres CLONE 1400906-F
MMWRSRARALLLLRSTITRPPPPPPQPYPTRTLTRVPPPRFLSSSPDPIPDSSSAAAADPFPEAFSSPTKASQDAAEAGEET

SEQ ID NO: 27522 - DNA, 651 bp, Zea mays
  misc_feature: Ceres CLONE 1400911-F
  misc_feature (558)..(558): n is a, c, t, g, unknown, or other
gagctccccgcggtggcggccgctctagaactagtggatcccccgggctgcaggaattcgcacgagaccattacctagaacatcctaatcgaaaaaaacaacgccgcgacgagaagagagaagagggcgggcatcggccagtgggggctcggaggccgagggaggcgaggaaagcggcgggtgccgggccgcccgcgccggtgccgaggccctcaccagtcaccaccccctcccctcttccgtctgtcccccgcttgccgccaccgccgctgcctgctcgcgacccttcccccttttaacgctcccgcggccccgcgtcgtgctcccttttgtcgccgctgccttcgtgcccgtactcgcgggttctcctcgctcctcaatctccgcgcctggggcgcggcgttcgccgccggatctgggcgcgggacggtgcccggaacggcgatggggcgcgggtgggcgctccggttgggcgcccgcggcgctcgcggttctcgtccctcgtgtcagtggctctgcttccacttgtcagttccgacgatggaccaacacctgccnagggtgttgtcaggggctgggcggatcctcaacggggcgcgtgaaggacggggacaaactgagcctcaaggatttgctcttcttcctcccatt

SEQ ID NO: 27523 - DNA, 657 bp, Zea mays
  misc_feature: Ceres CLONE 1400913-F
  misc_feature: Encodes the peptide sequence at SEQ ID NO. 27524
  misc_feature (657)..(657): n is a, c, t, g, unknown, or other
gagctccccgcggtggcggccgctctagaactagtggatcccccgggctgcaggaattcgcacgagaccattacctagaacatcctaatcgaaaaccccgtccctccactccttccgtcgagcacttggcactgccaatggcggcagccgcccacaccccttcgatgcgcgcaagccgcctcctttcctcctgagatcgacgcacctcctcctctcgtactccattcccgctccaagttcgtttcttcggcaccgagccatcgcacggccgcccctgcatctcgtcctgctctcaggtccttggcctccgccgttcttcgacaggggcgcgccccggtgcccactccgcgaaatccgagtccctcgtgcagctccgtagggtgggagagatccatcaggcggtgagcggtaggaggcgcccgcacaactgaggggacgggcaatggcggccgtggcaggcccactctgcacgtggctcgtcgccgcgtgcttgtctgcggcttgcgacgcaaaagagtacaagcagaagcattgctgccccagcggaagcggcgctgggggcggcgtcatgctcggacagcgccgccgccgcctcggcgcgcggcgtcgcggattggcgcgctctggaatggctatggctgttgccttacaagctgn

SEQ ID NO: 27524 - protein, 71 aa, Zea mays
  misc_feature: Ceres CLONE 1400913-F
MAAVAGPLCTWLVAACLSAACDAKEYKQKHCCPSGSGAGGGVMLGQRRRRLGARRRGLARSGMAMAVALQA

SEQ ID NO: 27525 - DNA, 621 bp, Zea mays
  misc_feature: Ceres CLONE 1400916-F
ggagctccccgcggtggcggccgctctagaactagtggatcccccgggctgcaggaattcgcacgagaccattacctagaacatcctaatcgaaaactgctcctctaccccttcctctcccggcgaccagctggcctctcctttgttgaggcgagagaccccccaccgatccggcgatggacgccgcgtccaggccgcctcccgcccacggagcaggggtccggcgtccgcgcccgttggtggagtctgtctcctggtactgagaataaaaacagggcctaaaattgttgttgagggcagaaattttgttcctggggcgaaaaggggctgggacccggaatcaaaaaaaaaaaggggaaggaagggggttcaaaaaaggaaaaggggggggattaaggacccctttttaccggggcctccccgaaaaaattttttatttggccgccaataaaaaaaccccccccttgtgaaaacccccaactctggggggttttgcaaaaaaagggaaacccctttttgttgggggagaaatttttttccccttgggggaaaaaaaattgggggggaaaaaaaagggggggtttttttttaaaagggcgcggggggagaaaaatatctggg

SEQ ID NO: 27526 - DNA, 614 bp, Zea mays
  misc_feature: Ceres CLONE 1400918-F
  misc_feature: Encodes the peptide sequence at SEQ ID NO. 27527
gctctagaactagtggatcccccgggctgcaggaattcgcacgagaccattacctagaacatcctaatcaaaaaaggaccgtccacctccaccatctttcctcttcctcctgcgcctccaccccttcccttccatcgcctcccacccggagactcctcttcctctctgccgcgccgatcgattggcccacccatcgatcgagcacggggaagaagattccagtccggagtggtttcaaatcggacgggttcgctgcccgtgtggctgtcggctatggcggcaatgtatgcctcggcagataagaacgccgtcttccgcaagcttcgcgccaaatcggacaacaagatgtgctttgattgcaacgccaagaacccgacgtggacgtccgtcacctacggcgtcttcctctgcatcgactggtcggaggcgcaccgcatcctctggagccacgtctccttcgtgagatcagcaaatttggattcatggactccacaaaaactgaaaatgatggtctatggaggaaaaacccgtgcgcaagatattcttaaacagcatggtggagcccatggcggaaaacttgaccagagtatacttttagagctgctagcttgtac

SEQ ID NO: 27527 - protein, 113 aa, Zea mays
  misc_feature: Ceres CLONE 1400918-F
  misc_feature (11)..(112): Pfam Name: ArfGap Pfam Description: Putative GTPase activating protein for Arf
MAAMYASADKNAVFRKLRAKSDNKMCFDCNAKNPTWTSVTYGVFLCIDWSEAHRILWSHVSFVRSANLDSWTPQKLKMMVYGGKTRAQDILKQHGGAHGGKLDQSILLELLAC

SEQ ID NO: 27528 - DNA, 617 bp, Zea mays
  misc_feature: Ceres CLONE 1400921-F
  misc_feature: Encodes the peptide sequence at SEQ ID NO. 27529
  misc_feature (441)..(441): n is a, c, t, g, unknown, or other
  misc_feature (514)..(514): n is a, c, t, g, unknown, or other
  misc_feature (515)..(515): n is a, c, t, g, unknown, or other
cgctctttactagtggatcccccgggctgcaggaattcgcacgagaccattacctagaacatcctaaaaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgccctcttcgcgcccccgatcgcccgattccttcagggccaaagttacagatgttccagtgtttaccaacagagtttctcgtacgtaccgggcaaaatcattgacagttccagatcacggagttgatgtgtgtcctttggaatacaatgagtatgtcccctgccatgatgnagcctatataagcagcttgaagagcctggatacatctaggcatgaggatcttgaaagtatttgtcctcatggnnagaagcggttgttttggtttgtgccccctcaaatgactacagataccaatagatggcaacagccgagatacgtagggcgagaatggcaccattccatcttgt

SEQ ID NO: 27529 - protein, 162 aa, Zea mays
  misc_feature: Ceres CLONE 1400921-F
  misc_feature (104)..(104): Xaa is any aa, unknown, or other
  misc_feature (129)..(129): Xaa is any aa, unknown, or other
MRRWWSPALAAVEPRSVQLLLLGVALVAASFYAGTLFGSSASPALVLPSSRPRSPDSFRAKVTDVPVFTNRVSRTYRAKSLTVPDHGVDVCPLEYNEYVPCHDXAYISSLKSLDTSRHEDLESICPHGXKRLFWFVPPQMTTDTNRWQQPRYVGREWHHSIL

SEQ ID NO: 27530 - DNA, 766 bp, Zea mays
  misc_feature: Ceres CLONE 1400924-F
  misc_feature: Encodes the peptide sequence at SEQ ID NO. 27531
  misc_feature (1)..(1): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
nggcctttcccttttaggggnnnnnnnnnnnnnnnnnnnnnnnnnnnnnnnnnnnnntggagctccccgcggtggcggccgctctataatagtggatcccccgggctgcaggaattcgcacgagaccattacctagaacatcctaatcgaaaaattcgcccatcccacctaccatggccaccgcctccggaactgacgccggtgcccagccgcgcgacgagcccagcctcctccccttcgcgtccttctcgctcggtctctccatgcgcgcggcgggcacccccacactcgtctccgtcccctccaccctccacctccccactcaaatctctacactcgacgtctgcctccacccctccgccgcgtagtcctcctcccgccgcagcacccgcctcaattccgccacctcctccgtcatcgccccgctgtcctcctcaacgccacggctctcccgctccttgcccttcgggagcggccgccgcagtaggggcgccgccgcacgctcgtctgattccgcgccggactccgcctccaggaccatgagccgtttccccccgaaagggggggggacagccctccatcccccccgtttttgttttccaatgcggggaaattggggaaggcccccctttggggttgcaaggggagggttccaaaacggggcaaaaatcctgggcggaaatccctgacaaacatggggcgggggcacccctttcccgggggttggccaaccttcccttacccacgggggaaaaactctcaaccg

SEQ ID NO: 27531 - protein, 64 aa, Zea mays
  misc_feature: Ceres CLONE 1400924-F
MATASGTDAGAQPRDEPSLLPFASFSLGLSMRAAGTPTLVSVPSTLHLPTQISTLDVCLHPSAA

SEQ ID NO: 27532 - DNA, 622 bp, Zea mays
  misc_feature: Ceres CLONE 1400926-F
  misc_feature: Translation starting site: 168
  misc_feature (491)..(491): n is a, c, t, g, unknown, or other
gctctagaactagtggatcccccgggctgcaggaattcgcacgagaccattacctagaacatcctaaaaaaaaagagccgacgtcactcctcccgatctgggcgcggacgccaacgacgcgacggcccaagtcgcgacgccaccagctccccatcccctcggacgccatggaggaagctcgcgaccacaggctctcctccaccgccggccgccccttcctctctggcttctgcgccgcggcgctccgacgtaagcccctcggcgcccgcgcctccgccgccgccgccgccaccggcgagggccttgtgcggcagctcggcgtcctcgacctcgtgctgctcgggatcggtgcgtccatcggcgccggcatattcgtcgtcactggcaccgtcgcccgcgacgccggcccaggtgtcacgaatcagttttgttcttgctggagctgcgtgcgtgctcaatgccctgtgctatgctgaactgggcgtctcggntccctggctgtgggttggggggagcatacttgtacacggtacgcagcggttcaatgagatcacccgccttcttggtcttcaactcagagtggatgggtggattaaaccatatcggcgcaagcaagcattgg

SEQ ID NO: 27533 - DNA, 669 bp, Zea mays
  misc_feature: Ceres CLONE 1400931-F
  misc_feature: Encodes the peptide sequence at SEQ ID NO. 27534
  misc_feature (386)..(386): n is a, c, t, g, unknown, or other
  misc_feature (422)..(422): n is a, c, t, g, unknown, or other
  misc_feature (431)..(431): n is a, c, t, g, unknown, or other
tccccgcggtggcggccgctctagaactagtggatcccccgggctgcaggaattcgcacgagaccattacctagaacatcctaatcgcaaagtcgtcgtccactcgttcgtcgctgctccctcctccaccaccttccagtcctgtccagtgccgccgccttgccctgccctcccctcccttcccccgattaccctcgcggttgacctcgccaatccggtcccgcctccgtataaatccgcccttctcgcccccgctccgaccacaaaccctagcggcgcgccccggcatgggctagggttcccgcggcgatggagtgggacagcgattctgacggcggcgatgacgaggaggaagaagaggtccgccccgggggtggggacgcggncccggggttctcgctgaccatcgagggcgtgctggncgcgtgcgncatggtggtctccgacgcgctcgagcccgacttccccatcatctacgtcaaccgcgggttcgagagctccactggatacagcgccgaggaggtgcttgggaggaactgccggttcctacaatgcagaggaccatttgctcagaggagccatccccttgttgatgcagcaggtgttactaggattcgaagatggttagatggaaggactgaatttcctgcggatttgttaattttaaaa

SEQ ID NO: 27534 - protein, 120 aa, Zea mays
  misc_feature: Ceres CLONE 1400931-F
  misc_feature: SWISSPROT Homolog: EC 2.7.11.1 Non-specific serine/threonine protein kinase
  misc_feature (26)..(26): Xaa is any aa, unknown, or other
  misc_feature (38)..(38): Xaa is any aa, unknown, or other
  misc_feature (41)..(41): Xaa is any aa, unknown, or other
MEWDSDSDGGDDEEEEEVRPGGGDAXPGFSLTIEGVLXACXMVVSDALEPDFPIIYVNRGFESSTGYSAEEVLGRNCRFLQCRGPFAQRSHPLVDAAGVTRIRRWLDGRTEFPADLLILK

SEQ ID NO: 27535 - DNA, 661 bp, Zea mays
  misc_feature: Ceres CLONE 1400932-F
  misc_feature: Encodes the peptide sequence at SEQ ID NO. 27536
  misc_feature (467)..(467): n is a, c, t, g, unknown, or other
  misc_feature (561)..(561): n is a, c, t, g, unknown, or other
  misc_feature (612)..(612): n is a, c, t, g, unknown, or other
  misc_feature (629)..(629): n is a, c, t, g, unknown, or other
cgcggtggcggccgctctagaactagtggatcccccgggctgcaggaattcgcacgagaccattacctagaacatcctaatcgaaaaaactcgaaccgaagggacgaccgagcggagtctagactcgagagcaacctcgacctcccggatctctctcccacccacgcctcgtcggcgccgtcgtctgctgcagagatggcctcccccgacctgctcttcaatctgcggaacctcttctacctgggcgcctaccaggcagccatcaacaacagcgacgtcccggccctcgacgccgacgccgccgctgagcgcgacgccatcgtcttccgctcctacatcgccctcggctcctaccagctggtgatcagcgagatcgactcgtcagccgctacctcgctgcaggccgtgaagctgctcgcgctgtacctcagtgaagacaaggaaggtgctatctccagtctcaaggnaatgtttgagtgattcagcaattgaaagcatccttgttctggcggttgattgctgaatctctctccacaaactacccctcgacaggggcccggngatgtgcccaacgaagcccgatcgccctggcagggcgccgccgtctccggnggagataggctgcgggnaggaagccgtgcccacctgctccttgcggctg

SEQ ID NO: 27536 - protein, 94 aa, Zea mays
  misc_feature: Ceres CLONE 1400932-F
  misc_feature (91)..(91): Xaa is any aa, unknown, or other
MASPDLLFNLRNLFYLGAYQAAINNSDVPALDADAAAERDAIVFRSYIALGSYQLVISEIDSSAATSLQAVKLLALYLSEDKEGAISSLKXMFE

SEQ ID NO: 27537 - DNA, 636 bp, Zea mays
  misc_feature: Ceres CLONE 1400933-F
  misc_feature: Encodes the peptide sequence at SEQ ID NO. 27538
  misc_feature (405)..(405): n is a, c, t, g, unknown, or other
  misc_feature (467)..(467): n is a, c, t, g, unknown, or other
gctctagaactagtggatcccccgggctgcaggaattcgcacgagaccattacctagaacatcctaatcgaaaaagtcgtgcccgcttgtttcccttgctcgccttcacccctcgccgccgccgccgccgtcgccgtcgcaagcgacgatgctcgacatcaacttgttccgcaccgacaagggcggcaacccagaccttattcgcgagtcccagcgcagtcggttcgcctccgtcgagctcgtcgacgaggtcatcgccctcgacaaggcatggcgcgaaaggcagttcgagctggacaagatccggcaggagctcaacgctaccagcaagaagatcggcaagctcaaagccagcaagcaagaagaggaagcgaagaagctcatggagagcacagacgaaattangaaaaggttggcagccaagaagttgaggtgcagggagccaagagcacccctcgacgcaggtncacgacgattggcaacatcgtgcatgagtccgtggcagtcagcgacgacgaggcaaacaataaaatgtacggacttttggagagagagaggaaaggataatttgaagaccacgtggacctttgccagatgtttggtttgcccattgggaaaagggggctgatgggcttg

SEQ ID NO: 27538 - protein, 159 aa, Zea mays
  misc_feature: Ceres CLONE 1400933-F
  misc_feature (1)..(99): Pfam Name: Seryl_tRNA_N Pfam Description: Seryl-tRNA synthetase N-terminal domain
  misc_feature: SWISSPROT Homolog: EC 6.1.1.11 Serine--tRNA ligase
  misc_feature (86)..(86): Xaa is any aa, unknown, or other
  misc_feature (107)..(107): Xaa is any aa, unknown, or other
MLDINLFRTDKGGNPDLIRESQRSRFASVELVDEVIALDKAWRERQFELDKIRQELNATSKKIGKLKASKQEEEAKKLMESTDEIXKRLAAKKLRCREPRAPLDAGXRRLATSCMSPWQSATTRQTIKCTDFWRERGKDNLKTTWTFARCLVCPLGKGG

SEQ ID NO: 27539 - DNA, 676 bp, Zea mays
  misc_feature: Ceres CLONE 1400934-F
  misc_feature: Encodes the peptide sequence at SEQ ID NO. 27540
  misc_feature (397)..(397): n is a, c, t, g, unknown, or other
  misc_feature (472)..(472): n is a, c, t, g, unknown, or other
  misc_feature (510)..(510): n is a, c, t, g, unknown, or other
  misc_feature (581)..(581): n is a, c, t, g, unknown, or other
  misc_feature (599)..(599): n is a, c, t, g, unknown, or other
  misc_feature (612)..(612): n is a, c, t, g, unknown, or other
  misc_feature (613)..(613): n is a, c, t, g, unknown, or other
  misc_feature (625)..(625): n is a, c, t, g, unknown, or other
  misc_feature (640)..(640): n is a, c, t, g, unknown, or other
  misc_feature (676)..(676): n is a, c, t, g, unknown, or other
ggcggccgctctagaactagtggatcccccgggctgcaggaattcgcacgagaccattacctagaacatcctaatcgaaaaacctcaggcctcgctcagatctctccgcccgggtccatcttcccaccccaaaccttctcccgcctctctcgtcaacgccgcccgacgagagggatggcggccttgcgggctccggccgcaacgctcctcgtcctcctcgccctagcggcggccggcggcgtggcggccgacggctccgatcaccggtacaagattcgcgagcccgtcccgctctacgccaacaaggtcggcccatttcacaatcccagtgaaacatatcgatatttcgacctgcctttctgctctcctgacaaagtgaaggagaagagcgagcccntttggggaggttctcaatggcggcatcggttagttgatgcgccttacaagcttgattccccgtgacgaagttgantcccaaggcagtttgctcaaagaagttactacagaggntgggtagtggaagttcccggaatgcagtgggctaaggactactaacttccagatggtactaatgatgatcntcccacctgtggcgcttncatcggtaaaagnntgagaacggcgnccagggatgatcccngagcgagtggaaaaatactatctgtacagggcacan

SEQ ID NO: 27540 - protein, 95 aa, Zea mays
  misc_feature: Ceres CLONE 1400934-F
  misc_feature (75)..(75): Xaa is any aa, unknown, or other
MAALRAPAATLLVLLALAAAGGVAADGSDHRYKIREPVPLYANKVGPFHNPSETYRYFDLPFCSPDKVKEKSEPXWGGSQWRHRLVDAPYKLDSP

SEQ ID NO: 27541 - DNA, 653 bp, Zea mays
  misc_feature: Ceres CLONE 1400937-R
  misc_feature: Translation starting site: 203
cgaattgggtaccgggccccccctcgaggtcgacggtatcgataagcttttttttttttttttttgggtgcaactgcaaggagaacagattaacatcacatcagtggtcagcaacaagatccattaacaccacgcaaggtccacaaaagcctttaggtgcagcttactactctccatctcactatttacgtttcactacattatgtacagtcatccaactgttgccatgcgcccatacttgcctgctccaccaactgatgctccaatctcatccttgcacctcccagacgcagtaacctccattgttccaccaccgttgctacccccacccccacgtccgtctcccttgcgtggactagcacactttctgcagatgaaattttcagggatttcctcaaaatcacttatcccagagcacctggtatgctgccagactccacatatgtcacaagctagcatccgttccccatcatcatccttggccccacatgagcagtccaccgtccagttctccaaacccctctccatcctgaactgtacaattctcctgtaatccccagtgcaacgtccccttactcgaagcaactggcctgatccaagcacatgcttcacgggggttgtatcactgaaattttggaaatcacgggagcttt

SEQ ID NO: 27542 - DNA, 665 bp, Zea mays
  misc_feature: Ceres CLONE 1400939-F
  misc_feature (472)..(472): n is a, c, t, g, unknown, or other
  misc_feature (473)..(473): n is a, c, t, g, unknown, or other
ggagctccccgcggtggcggccgctctagaactagtggatcccccgggctgcaggaattcgcacgagaccattacctagaacatcctaatcgaaaagaaaaagagcgtatttcttcttcctcaccctcctcgaggaagagagagggcagctccggagccgcacgggcgcgagcgaggcaggcagtggctcctcccccctcctttcgatatcagctcatcgattcgtcctatcacacacatatcattaccgctcctcttcctcacctatgcttgtcctctaactcattggcagaagagaaaaaaaaagtccttgttgagttgttgtatcgggttctggtggtgactgttactggggtttccttgcccggttcttgatttgcgcaaggacagatttgccgtcctctcgggttccgccgtgcggtgctgaatcctccttccctgttccttcccttaggtttggacgggaaagggnntaggaaagtggacagaaagaaaatttgcaatttggacccaggggggaaagaggttcagagcaagaatccgaggcgggaggagccgctggcaatccgtcggaggggggacatggatgagccagacgctcctgagagcggtgaccatggaattgttggatggcaacaatggcagctcccagagagagccccttg

SEQ ID NO: 27543 - DNA, 619 bp, Zea mays
  misc_feature: Ceres CLONE 1400940-F
  misc_feature (137)..(137): n is a, c, t, g, unknown, or other
cgcatacaactagtggatcccccgggctgcagtaactcgcacgagaccattacctagaacatcctaatcaaaactgtccctccactcctcccgtcgagcacttggcactgccaatggcggctcccgcccacaccccnttcgatgcgcgcaagccaccttctttccccgtgagatcgacgcacctccccctctcgtgcttcattcccgctcgtcgttcgtttcttcggccccgagccgtcgcgcggtcgcctccacatctcgtcgtgctttaaggtctttggcctccgccgttcttggacaggggcacaccactgtccaccggtgcccactacgcgaaatacgagtccctcgtgcggctccgtagggtggaagagatccatcaggcggtgagtgggaggggcggcgtccacacaaccggaggggaggggggcaatggcggccgtggcagggccactctgcacgtggctcgtcgccgggtgcttatctgcgggatgcgaggttgaagaggacaagcagaagctttcctgcgcaagcggaaaccgcgcctggggggcggggtctggttcgggaagggcccccacctccaggcgggtggttcggctatggcgcgcctggggag

SEQ ID NO: 27544 - DNA, 646 bp, Zea mays
  misc_feature: Ceres CLONE 1400941-F
  misc_feature: Encodes the peptide sequence at SEQ ID NO. 27545
  misc_feature (646)..(646): n is a, c, t, g, unknown, or other
acccgcggtggcggccgctctagaactagtggatcccccgggctgcaggaattcgcacgagaccattacctagaacatcctaatcaaaaaacagattagcttaaacacgcgctcgcgtacagtgaagaaatggctgatggcgatgcagccatcttagtcccctaccctgataccctctccctctccgtctccatggccgcccctcctctggtgtttgtcgccgctgccatagccgcgctcgccatcctcgtcctcatcctcgttgtcttcgccttccggagatggtggtggtggtggagacagcgccgcccgctccaggccgaggcggaggcctcgaccccggtcgctgtccaggaggaggatatatatagggcctcttctttccggaaatcgcgacgatcactctagacaaagtaattattttcttggaagctctgtaggagaaccttcaaagattcaaacaaataggagtaacacttcccctagaagtcatgcaattgctgatacagggaggacttatccagatgaatgttgtgctacaccaggagaaactcatgtaatcaatattgaaaatgatacttctgaagagtttcgattacgaagcacattaagacggacatcaccagcaaaattgacaacacctggn

SEQ ID NO: 27545 - protein, 92 aa, Zea mays
  misc_feature: Ceres CLONE 1400941-F
MADGDAAILVPYPDTLSLSVSMAAPPLVFVAAAIAALAILVLILVVFAFRRWWWWWRQRRPLQAEAEASTPVAVQEEDIYRASSFRKSRRSL

SEQ ID NO: 27546 - DNA, 610 bp, Zea mays
  misc_feature: Ceres CLONE 1400942-F
  misc_feature: Encodes the peptide sequence at SEQ ID NO. 27547
tccccgcggtggcggccgctctagaactagtggatcccccgggctgcaggaattcgcacgagaccattacctagaacatcctaatcgaaaaaacaaaagaatgttagaacgggaaagagagaagaaggcactggaactctgaagcgtcgcagaacgctcctccctctaaggctccgacctccgtgcctcgcgcgccctcgcccttgccctcgccctcccccaccaacccaaaacccgatccgttgctcgctgctcagggtccactactgatccgctccacgcgagctcccttgtccccgcgtcacactcgcgcccaagcaagcggttgctgcaaaggaagcctcccctgatggctctcgtgacctcgggctcgggtgccgaccaggtgatcgctaggtggcgatgaacggcggcgccgacccaagtgcaaccaccgtgcgtgctactgtcgtgcaggcgtccaccatcttccacgacacgcccgccactcttgataaagcagagagattgatagcagaggctgctgggtatggttcaccagttagttgtctttcccaaaggtttttatggaaggcttatcctccgggaatcccccttttggttttcgggg

SEQ ID NO: 27547 - protein, 69 aa, Zea mays
  misc_feature: Ceres CLONE 1400942-F
  misc_feature: SWISSPROT Homolog: EC 3.5.5.1 Nitrilase
MNGGADPSATTVRATVVQASTIFHDTPATLDKAERLIAEAAGYGSPVSCLSQRFLWKAYPPGIPLLVFG

SEQ ID NO: 27548 - DNA, 560 bp, Zea mays
  misc_feature: Ceres CLONE 1400943-F
  misc_feature: Encodes the peptide sequence at SEQ ID NO. 27549
  misc_feature (301)..(301): n is a, c, t, g, unknown, or other
cgcggtggcggccgctctagaactagtggatcccccgggctgcaggaattcgcacgagaccattacctataacatcctaatcgaaaacgactcactctctctgaaaactaggaaccccactcccctcccgaaactaccgccgccgccgctgccgccgtgatccaggtctcccgccccgcctgagatctcgacctcttcactcctcgccgctactgctcgccctcccgcgtatcctcgtatcagctctcaggttttcagcctgatcaaaccggtgtacccagccgtgcatgactgcattgcntcgactcgccggaagagcagcttcgcggagcagggtcgtaatagcggcggacggcggcaccccctcctgtcggcttggtccgggcagcgcccggaggggcgttcccagggccgaaaaaggaaaacgggtggaaccaaggggcggccccgggggcctttggggggccccggaagccggggcccgggggggaaaaattttcggggggggcggggggggtttctttccccaggggggaggggttaaagggcccaagtggggg

SEQ ID NO: 27549 - protein, 91 aa, Zea mays
  misc_feature: Ceres CLONE 1400943-F
  misc_feature (5)..(5): Xaa is any aa, unknown, or other
MTALXRLAGRAASRSRVVIAADGGTPSCRLGPGSARRGVPRAEKGKRVEPRGGPGGLWGAPEAGARGGKIFGGGGGGFFPQGGGVKGPKWG

SEQ ID NO: 27550 - DNA, 782 bp, Zea mays
  misc_feature: Ceres CLONE 1400945-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (26)..(26): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (41)..(41): n is a, c, t, g, unknown, or other
  misc_feature (42)..(42): n is a, c, t, g, unknown, or other
nnnnnnnnnnnnnnnnnnnnnttttntttttaaannnnttnntttttgtcctcctaaaactggtactccacgcggtggcggccgctctttaactagtggatcccccgggctgcaggaattcgcacgagaccattacctagaacatcctaatcgaaaaagctaggttcctatgcccaaagccacacagcttcttctccttctagttctccttcctcctctcctcaccggaaccttgatctaatctcttccatcctagcttgctcgccgctgccagactctcctccgcctgcaaccactcccatgtcacaggtttctcctgtcttctccgtcgcccgagcgcacgccggagcaggagggcgagccgtggcagccgctctcctgcttcactcgtcgtccctttgctctgctgccgctcagccattcatggttctacggggtgccctctccacccagagcgacgccgttccaagacgccccccccccccctcccccggcgccgccctggtctttctttcggccgacctccgacgatcgaacggtggcttccagtcgtgaataggccatgcgtcccgcgtttctatccaaggacagcgaggccccgtcgtccgaggcaccaacgccgatcgcaatgcctacgttgccttgtacattgtaccagggagggctccagacaactacctcccacggggggggaaggacggatccattatccgtagcactcgatcggcctctcggtcccttccctcattcgttacccgtcttggcggaagcttccatctctt

SEQ ID NO: 27551 - DNA, 670 bp, Zea mays
  misc_feature: Ceres CLONE 1400946-F
  misc_feature: Encodes the peptide sequence at SEQ ID NO. 27552
  misc_feature (390)..(390): n is a, c, t, g, unknown, or other
  misc_feature (417)..(417): n is a, c, t, g, unknown, or other
acccgcggtggcggccgctctataactagtggatcccccgggctgcaggaattcgcacgagaccattacctagaacatcctaatcaaaaattgtagagcagtgcgacagagttccccgatcgaagcagattgaggtccactgtgctgtactgctgtgcgtcaatcatggaagcaatccaccttgcctacgtgctcgtcttcctcttgcccatcctcctcctccgtctccggcgccgcgggcctcctccagtcaagcggccacgaacaacgacggcccactgcccgcaccccagcccggtcctgggcaacaccctccacttcatccgcaaccgccgccgcttcttcgactggtacgcgaacatgctccgcgccgcgccgtccgggcatagnaaaggctgtgatgccctttgattacgnagccactgagtaaccacagacggctcgaccagaagacgaccatctcatgcgctgcagaattggactagtactccaagggcacgctcttccgtgacgtcaccgcggatctcatcgatgaattactcttcgccgccgacacaagactctgtagcgtccagtggaagatcggcatcgaacgccttctcggcgccgtcgctcagaagggtggcgactgtgtacatccaatgggcctgcggaggagactgactgacgt

SEQ ID NO: 27552 - protein, 81 aa, Zea mays
  misc_feature: Ceres CLONE 1400946-F
  misc_feature (75)..(75): Xaa is any aa, unknown, or other
MEAIHLAYVLVFLLPILLLRLRRRGPPPVKRPRTTTAHCPHPSPVLGNTLHFIRNRRRFFDWYANMLRAAPSGHXKGCDAL

SEQ ID NO: 27553 - DNA, 818 bp, Zea mays
  misc_feature: Ceres CLONE 1400949-F
  misc_feature: Encodes the peptide sequence at SEQ ID NO. 27554
  misc_feature (1)..(1): n is a, c, t, g, unknown, or other
  misc_feature (17)..(17): n is a, c, t, g, unknown, or other
nttcccccccccctggnccccttcccccccccccctttttaagtttttttcaaacttggactccccgcggtggcggccgctctataatagtggatcccccgggctgcaggaattcgcacgagaccattacctagaacatcctaatcaaaaaaacggcaatgtctccgctgccccgcatcgtgctcctcgccgtcgccgccgccgccgccgcagcggtcacggcgtcagccacgtcgctcagcggcgcggcgaacgacctactccccaagtacggcctcccgaaggggctcatcccggactccgtcgcctcctacagcttcgacgaggccacgggcgccttcgagatccacctcgccggcacctgctacgtccacttcggctcccacctcgtctactacgagaggaccattaaccggcaagctctccaagggcgcccatctcggaccctctcccggcgtccaggcacaagaagctctttcctcctgggtctacgttcacggggtatgggtcgcgacacccccgacccagggccacccatcgaagtttcacaggccggactttccttctacggaagtcgcctatccgggcactcgaatgttgttgcacgagggggcccccccctggcggcctctcccagcggttccccccccgcaccttgaccccgcccccccccctgtcgcccgcacccccctgacactctggactccccccccccctcttgttcagggtctatcgcgccggggcacctattaatgccaacccccactattgagcacccacctaaaaagacctaggaaaccatctaagcgcaccagcag

SEQ ID NO: 27554 - protein, 166 aa, Zea mays
  misc_feature: Ceres CLONE 1400949-F
MSPLPRIVLLAVAAAAAAAVTASATSLSGAANDLLPKYGLPKGLIPDSVASYSFDEATGAFEIHLAGTCYVHFGSHLVYYERTINRQALQGRPSRTLSRRPGTRSSFLLGLRSRGMGRDTPDPGPPIEVSQAGLSFYGSRLSGHSNVVARGGPPLAASPSGSPPAP

SEQ ID NO: 27555 - DNA, 674 bp, Zea mays
  misc_feature: Ceres CLONE 1400950-F
  misc_feature: Encodes the peptide sequence at SEQ ID NO. 27556
ccccgcggtggcggccgctctataactagtggatcccccgggctgcaggaattcgcacgagaccattacctagaacatcctaatcgaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactaacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacacctccccgggctcgcccgcgcagcgcttcgtgtcggaggacggcgtcatcacctcgcgcccgcgtttgctggccggaggaagctgtatcaacgccggcttctacacgcgggccagcgacgactacgtgggggggcgtctgctggaaacctggccgcccccggggcgggcttaccgggtggatcgaaaaccttcgcccccccacacgcccctcggccccctctacccgcgcccccgag

SEQ ID NO: 27556 - protein, 89 aa, Zea mays
  misc_feature: Ceres CLONE 1400950-F
  misc_feature: SWISSPROT Homolog: EC 4.1.2.10 Mandelonitrile lyase
MARFADTLSDTSPGSPAQRFVSEDGVITSRPRLLAGGSCINAGFYTRASDDYVGGRLLETWPPPGRAYRVDRKPSPPHTPLGPLYPRPR

SEQ ID NO: 27557 - DNA, 693 bp, Zea mays
  misc_feature: Ceres CLONE 1400951-F
  misc_feature: Encodes the peptide sequence at SEQ ID NO. 27558
  misc_feature (316)..(316): n is a, c, t, g, unknown, or other
  misc_feature (372)..(372): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (467)..(467): n is a, c, t, g, unknown, or other
tccccgcggtggcggccgctctagaactagtggatcccccgggctgcaggaattcgcacgagaccattacctagaacatcctaaccgaaaaaacccaggcaacacagcaatcagcagaaaaacatctccttggccttccatccatatgatccatccctccaggctccagctaactccaaactaccctctggttcgactcgcgttcgcatcgcaagcagcagcgtaccatcgaggcaatggcggtgatggccgaagtagtgtcgaccaccggcgcggcgctccggagcccggccacgcagcagccggcggcggcggncgcggcgaagggcaccgacgctgagaagctccagttcatcgaggacatgacctccnacgtggacgccgtgcaggagcgcgtgnnntgggggagatcctcgcccgcaacgcggacaccgagtacctctccagcagtgcgggcctcgccgggnggtacggaccgcgccaccttccgcgccagggtgccgatggcgaactacgaggacctgcagccgaaaatcggggcaatcgccgaaggggacgttcccccttcctggcggggcaaccgggtcccgaattcttaccagttccggaaaggccgggggggaggggaaattcatggcccccattgaggagagggttaacccccccgcggggggggaaagccccaaatgcccc

SEQ ID NO: 27558 - protein, 136 aa, Zea mays
  misc_feature: Ceres CLONE 1400951-F
  misc_feature (27)..(27): Xaa is any aa, unknown, or other
  misc_feature (46)..(46): Xaa is any aa, unknown, or other
  misc_feature (55)..(55): Xaa is any aa, unknown, or other
MAVMAEVVSTTGAALRSPATQQPAAAXAAKGTDAEKLQFIEDMTSXVDAVQERVXWGRSSPATRTPSTSPAVRASPGGTDRATFRARVPMANYEDLQPKIGAIAEGDVPPSWRGNRVPNSYQFRKGRGGGEIHGPH

SEQ ID NO: 27559 - DNA, 754 bp, Zea mays
  misc_feature: Ceres CLONE 1400952-F
  misc_feature: Encodes the peptide sequence at SEQ ID NO. 27560
  misc_feature (457)..(457): n is a, c, t, g, unknown, or other
  misc_feature (673)..(673): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (699)..(699): n is a, c, t, g, unknown, or other
  misc_feature (701)..(701): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
aaagctggagctccccgcggtggcggccgctctagaactagtggatcccccgggctgcaggaattcgcacgagaccattacctaaaacatcctaatcgaaaaatccaattcacaggctcaccacaccaaccaacaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccgcgacgccgccccaccacgcccgatggccgccgtaaggtcgctgctccgctcgtcggcctcccttcttcgcgccgcccccgncctcgcgagatcctcggctaccacgcgtccgtctcttcggcgcgcattggctgctcctcctcgcctcctcaggtcgcccgtcgaggtcgagcttctggcgtggagtcgcttctgcctctgcacaccgccaccggcggggaacgcatgacgtccatgctcgccgctcctggcaaggggctcggctggctcaccaagctgaaaactgacggagatacnccccccctgggggtgtagaannncancncacannnnnnnnnnnnntnnnnnnnnnnnnnnnnnnnnnnnnnnnnnnnnnnn

SEQ ID NO: 27560 - protein, 143 aa, Zea mays
  misc_feature: Ceres CLONE 1400952-F
  misc_feature (95)..(95): Xaa is any aa, unknown, or other
MSGRGKGGKGLGKGGAKRHRKVLRDNIQGITKPAIRRLARRGGVKRISGLIYEETRGVLKIFLENVIRDAAPPRPMAAVRSLLRSSASLLRAAPXLARSSATTRPSLRRALAAPPRLLRSPVEVELLAWSRFCLCTPPPAGNA

SEQ ID NO: 27561 - DNA, 717 bp, Zea mays
  misc_feature: Ceres CLONE 1400953-F
  misc_feature: Encodes the peptide sequence at SEQ ID NO. 27562
gctggagctccccgcggtggcggccgctctagaactagtggatcccccgggctgcaggaattcgcacgagaccattacctagaacatcctaatcgaaaaacaccttccctcggtcccttccatctcctagccgccgccgccgccgccgctgcccaaaaccctacctaccctcttcttcccctcactctcctttcatctccattctaatggcggcccaacccgtccggcgaagctgctagtgcttgtatctactatcttcatcaggtacttcgcgatcctactgaagtattccccgccgccgctgccatggccaccctcaaccctttcgaactccttggcgccgacgacaacgacgacccgacgcagctgattgcggcggcggcggctgctgctcagaaagccgagacgaagaagtccgccgtggcgcctggctgggaaggctgcccagcctgcggcgaccaccaagttcccgaccaagcccgtcctccctcgcaagacggttcggatgccacgcggcggtgctcatcagctcgtggaggcttttggccgtgagaacgtggccgtgtcagaagttgaacggggatatggccagaaccggggcttcggtggtgacaatggcatgacttccaggggaggttaggttggcgagggcatagggaaagggggctgtaactgggggaccggaagaaaaagggaaaaaaacctcctccccggacc

SEQ ID NO: 27562 - protein, 81 aa, Zea mays
  misc_feature: Ceres CLONE 1400953-F
MATLNPFELLGADDNDDPTQLIAAAAAAAQKAETKKSAVAPGWEGCPACGDHQVPDQARPPSQDGSDATRRCSSARGGFWP

SEQ ID NO: 27563 - DNA, 692 bp, Zea mays
  misc_feature: Ceres CLONE 1400954-F
  misc_feature: Encodes the peptide sequence at SEQ ID NO. 27564
  misc_feature (302)..(302): n is a, c, t, g, unknown, or other
  misc_feature (329)..(329): n is a, c, t, g, unknown, or other
  misc_feature (347)..(347): n is a, c, t, g, unknown, or other
  misc_feature (393)..(393): n is a, c, t, g, unknown, or other
  misc_feature (419)..(419): n is a, c, t, g, unknown, or other
  misc_feature (436)..(436): n is a, c, t, g, unknown, or other
  misc_feature (437)..(437): n is a, c, t, g, unknown, or other
  misc_feature (472)..(472): n is a, c, t, g, unknown, or other
  misc_feature (692)..(692): n is a, c, t, g, unknown, or other
tccccgcggtggcggccgctctagaactagtggatcccccgggctgcaggaattcgcacgagaccattacctagaacatcctaatcaaaactttctgctgcccagccgccgtccgtccgcgcttcactatccttcattccctcccctgtcagcgacgactgggtaggctaccgccgccgccctacgctaggtgcccatctcttcgccggcgaagagcgcccaccaagctccggccaagggcgtgatggcggctgtaggcagcttgaagccggggatggagactcttcatgtgcaggactacnaggacgcgcctccccggcaggccgcgntagagagcctccagccgncgatggagagtctgcatgtgcaggatttacaggacgcgcctccggncaagggcgtggccgccgcccgcgtangaagcttgcagcccggnnggcgaaaacctgcaggtgcagactaccaggaccgnaacattgaattatggcggctaccccgtttatggctatggagcctatgggtggttgggggggagaacccaatcctgggcctggggggaagcaaaaccccattggggggaccctaggggaaatggaaaaggggattgccccattggggggggacacccgggggatgagaggcaaaattaagggggctcaaattaacaaacccccggaaaaaaaacaaaaaan

SEQ ID NO: 27564 - protein, 113 aa, Zea mays
  misc_feature: Ceres CLONE 1400954-F
  misc_feature (20)..(20): Xaa is any aa, unknown, or other
  misc_feature (29)..(29): Xaa is any aa, unknown, or other
  misc_feature (35)..(35): Xaa is any aa, unknown, or other
  misc_feature (50)..(50): Xaa is any aa, unknown, or other
  misc_feature (59)..(59): Xaa is any aa, unknown, or other
  misc_feature (65)..(65): Xaa is any aa, unknown, or other
MAAVGSLKPGMETLHVQDYXDAPPRQAAXESLQPXMESLHVQDLQDAPPXKGVAAARVXSLQPGXRKPAGADYQDRNIELWRLPRLWLWSLWVVGGENPILGLGGSKTPLGGP

SEQ ID NO: 27565 - DNA, 729 bp, Zea mays
  misc_feature: Ceres CLONE 1400955-F
  misc_feature (281)..(281): n is a, c, t, g, unknown, or other
  misc_feature (310)..(310): n is a, c, t, g, unknown, or other
  misc_feature (318)..(318): n is a, c, t, g, unknown, or other
  misc_feature (419)..(419): n is a, c, t, g, unknown, or other
gctggagctccccgcggtggcggccgctctagaactagtggatcccccgggctgcaggaattcgcacgagaccattacctagaacatcctaatcgaaaaatccaatccccgggccaccactacctgcctgcccgtgcccacgcttcttctcttctcctccccaagccccagccccagccccagctaccgcgccccctcctgtctgttccaccagcgtcggcctagctacctgcccgtcccctctccgagtacggtcggaaagctcagctgaaggatctggnctgggcgccctccggacgacgggacaggntctgtttngtcttcataaagtagagcactagctagaaagaactatcacacgcatcagctatcaaaatggcaagcttaagattgacctcaaagttgggacatgcttgccntaacagaagccactgatagctttggagttgtaatcccgtccggattgcctgcttgaacaaaaagggttgaacctcccaattttccgaaaggtggcaccccttttggggaagccccaagaaaaatccccaaaaaattccgggtttttgggaaaacccgaaaaccctttgccattccgaaacaaaaaattcccggagggcccatgttggggccccaaacccccctaaacacgggggggggttccatcctccctccccaaaaaaaagggggggggttcaaaaagagcgggaggtctccccaagggggggcgcg

SEQ ID NO: 27566 - DNA, 765 bp, Zea mays
  misc_feature: Ceres CLONE 1400957-F
  misc_feature (291)..(291): n is a, c, t, g, unknown, or other
  misc_feature (652)..(652): n is a, c, t, g, unknown, or other
  misc_feature (653)..(653): n is a, c, t, g, unknown, or other
  misc_feature (685)..(685): n is a, c, t, g, unknown, or other
gctggagctccccgcggtggcggccgctctagaactagtggatcccccgggctgcaggaattcgcacgagaccattacctagaacatcctaatcgaaaaaaaaaaacgcacggggagcttggagacttcacgacaaatcgacgatcgccgcttctcttggccattgtagagggagagagagagcgcgagcgacctaggtcagtcggtttcggttttgggcgtcagcttcagctatccgcgaccgcgacgatgggtctgcgcgtggccgccaccgcgccagctccgggcggncgtgcgcgtgctcggcaggggcgccgcgcgcgtgacgccgcgaccgtggggcgcctgtcggcggcaggagacgcttctcccggggggatggccgtcgcgaccaccgaggccacccccacaatcggcgggggggggccccgggaggaacagggggcgggaggctagggaactccaggaggggggtggggggccatccctccgggggggcggccgggaaccaggttttttccggcttacaaaacgccggggccaagtcccggggggctctattggtaggcgcgatcctgcctcctggacggggcgcgtgggcgatttggcgttaaacgggggggttcaaaagggggtccacattccgcccggnntttcccagcgccgcgattccgcggctgtcgcncccttctccccggagggcaacggatttccccggccaggggggggcaacacggcgggacgggatgcgcgcgcgacgggccg

SEQ ID NO: 27567 - DNA, 753 bp, Zea mays
  misc_feature: Ceres CLONE 1400958-F
  misc_feature: Encodes the peptide sequence at SEQ ID NO. 27568
  misc_feature (270)..(270): n is a, c, t, g, unknown, or other
  misc_feature (271)..(271): n is a, c, t, g, unknown, or other
  misc_feature (283)..(283): n is a, c, t, g, unknown, or other
aaagctggagctccccgcggtggcggccgctctagaatagtggatcccccgggctgcaggaattcgcacgagaccattacctagaacatcctaatcgaaaaaaccccaccagaccttcaaccgctacatttccgtcactaccggagccgccactccgacgaacgcgggcggcggagcggaagcgaaccagagcaccggtaaaaagaaaagatgaggcttgggagtataaacggcttggcggtcacgcagcttaaacttggcatccttgcnngtctcatggtgntgggtctctggaatggggagagggctcgtcatactacgattccgaaatccctccagcaagatccgtgggttctgactcatccggttactccgaggttgggagaccagcaaaccttcccgaagaaaaactttcaagggggaaattgatccccccgggtaaaaagggaaaagaaaaaaagcgggttaaaaaagggggcgggcccccttgggaaacaaagggtattttttgtttagttcaaaaaagggaaaaaaaaccccccccccggaaaaaaaaaaaagcggcacagggagggggggaagggttttttttgaaataaaaaaccattttaccccggggttggtgaaaaaaaaggtttttaaaaagggggggcccccacaccaccccccaaaaaaatttccccgaaaaaaaaaaaagaagccccccctgtttgggggagaaaaaatatagcccccccccccccttaaaaaaaa

SEQ ID NO: 27568 - protein, 72 aa, Zea mays
  misc_feature: Ceres CLONE 1400958-F
  misc_feature (21)..(21): Xaa is any aa, unknown, or other
  misc_feature (25)..(25): Xaa is any aa, unknown, or other
MRLGSINGLAVTQLKLGILAXLMVXGLWNGERARHTTIPKSLQQDPWVLTHPVTPRLGDQQTFPKKNFQGGN

SEQ ID NO: 27569 - DNA, 663 bp, Zea mays
  misc_feature: Ceres CLONE 1400965-F
  misc_feature: Encodes the peptide sequence at SEQ ID NO. 27570
tggagctccccgcggtggcggccgctctagaactagtggatcccccgggctgcaggaattcgcacgagaccattacctagaacatcctaatcgaaaacagctttgctttgtagttgtagcgctagcaccttaattggtctctgagctgaggtgcactactagctagctagtcgtgcaggaagaggaaggaatataatggctgagcgggaggtcctcgaaggcggtacgactacggcaggcgctctgtggcggaggtatgcaccgcacgcccagatggtgctgccgcatctgtgctacacgctcatgtacttcatcaccgaggccgccttcaaccaggggctcaacccctacgtctacatcacctaccgccatctgctcgtcgccgtcctcatctggcccttcgcatactacctggagaaggcgctgaggcctaacatgacgctcatgctgttcgtggagatattcgtgctctcccttctcggggcgagcttaactctgcacatgtacttcgcgagcctgaatacacgtcaccaacgttcgtcacttccggggtgaacatcatccccctcgatgacggtcgtcatcgccatcatcctcaggattgaatatcgtgggacgtgaaaagcctacgcgggggctccaaggtctcatgggaccgaggtg

SEQ ID NO: 27570 - protein, 119 aa, Zea mays
  misc_feature: Ceres CLONE 1400965-F
MAEREVLEGGTTTAGALWRRYAPHAQMVLPHLCYTLMYFITEAAFNQGLNPYVYITYRHLLVAVLIWPFAYYLEKALRPNMTLMLFVEIFVLSLLGASLTLHMYFASLNTRHQRSSLPG

SEQ ID NO: 27571 - DNA, 746 bp, Zea mays
  misc_feature: Ceres CLONE 1400968-F
  misc_feature (554)..(554): n is a, c, t, g, unknown, or other
  misc_feature (590)..(590): n is a, c, t, g, unknown, or other
  misc_feature (678)..(678): n is a, c, t, g, unknown, or other
aagctggagctccccgcggtggcggccgctctagaactagtggatcccccgggctgcaggaattcgcacgagaccattacctagaacatcctaatcgaaaaattcttttctgctgctgcgaccgtaggatcggcgtccagcagcctcgccgcgtcggtatggttttcccttggcccacacatcctagctcttccgcattcttgaatttcgtggtcgaggattagggggtttctcgtgcgctggtccaatttcgcgctaatcgtcctgttcctgcctcggattactcgccttctcgtggtccccatctgttcttggcgttcgcacgcttgccgtgcggcgggcagggctgcagcagcagccggcagcgcgtgcatcttgcgaccccctttccaagaaccagctgcaagctttggccttttccgcctgccgtacccgaaatcccgcaagaaactccacccaagaaaaaagcggcgccccttttggctggctggctgccattcctcacgccccacgagtttggtgaggctttgaaacgagcacagttcacaagacgngagctggcgggtgggtgtttcctcgtcggagatggnagggaaatttgccgcccgcaacatggtccccaggcggaggcccttcgatttggggggcagcgtttccacttcgccgtccaccccaggngctcagtttttaccagggatgtcttcgctgccccccgcgcgagccagatggcgagcttcgggaaaggt

SEQ ID NO: 27572 - DNA, 734 bp, Zea mays
  misc_feature: Ceres CLONE 1400971-F
  misc_feature: Pfam Name: DHFR_1 Pfam Description: Dihydrofolate reductase
  misc_feature (328)..(328): n is a, c, t, g, unknown, or other
  misc_feature (481)..(481): n is a, c, t, g, unknown, or other
  misc_feature (504)..(504): n is a, c, t, g, unknown, or other
  misc_feature (576)..(576): n is a, c, t, g, unknown, or other
  misc_feature (634)..(634): n is a, c, t, g, unknown, or other
aaagctggagctccccgcggtggcggccgctctagaactagtggatcccccgggctgcaggaattcgcacgagaccattacctagaacatcctaatcgaaaaacacagccgccgctgtttcttcatcttactcgtgctcggcacgcaggcgacggcgacggcggcggcgttcaggctcgggctctcagcgacggtatcagtggtctcccgcctctcgccagtcgcgtcgcgccctcgcctccggtcctctgcacaccgtccggtgaccttgtgttgtaagtttttccagcactgcttgctcacccatttctcaattagaaaacctcanattctgtccctgagcaccaaatcaagaccataccaatttagtgagtccggacagatggcaatggccgcagttctggccaatggtgattcgcagggtcgtcctcagaggaactatcaagttgttgttgctggcactcgtgacatgggcattggnaagggatggggtcttgccatggnaagcttcctggtgatcttaaattcttttaagagcttacactaactacatctgatcctggtcaaaagatgcangtaatatgggaaggaaacatgggagaagctttccggtaagtcagggcatttgcctggncgtttgatgcatactactcgaatctggaagttttgattttgcaacatagagatgttgtaatctggggaaagatggagtcttgcttagactggtacatcca

SEQ ID NO: 27573 - DNA, 653 bp, Zea mays
  misc_feature: Ceres CLONE 1400973-F
  misc_feature: Encodes the peptide sequence at SEQ ID NO. 27574
  misc_feature (508)..(508): n is a, c, t, g, unknown, or other
  misc_feature (564)..(564): n is a, c, t, g, unknown, or other
tggagctccccgcggtggcggccgctctagaactagtggatcccccgggctgcaggaattcgcacgagaccattacctagaacatcctaatcgaaaaactctccaatctcgccgccaaggctcaccgcaccatggggaccttcaccgcgggctcctccctctccctcgtcttctcccacccgcactcccactcccgccaaccatccgcccagggggccaccgccagctcccacctccacctgcatccgcgcgccagccgcgcgcgctgcgcctcttccgacacgacgggcacgaagcaccgccgcccagcgaaggagaacatccacgaggaggaggcgcggctcccaggcccggcccagggtttctctgcgtggtacgagcccttcccgccggcgcccggaggcgacccgaacgagcgctactcgctggacgaggtcgactaccgctccagctcggggggcctcctcgacgtgcgccactacatggaggcgctggtccgctacccggngtcctactggcgtgacctcttcgactcccgcgtcggccgcaccgcctgagcctacngctcgtgcgactgcgaccaagaaggaggtcgtgctccccgagatcgactacggacacatcgtctccctcttcgaggccactccgacctc

SEQ ID NO: 27574 - protein, 141 aa, Zea mays
  misc_feature: Ceres CLONE 1400973-F
  misc_feature: SWISSPROT Homolog: EC 4.2.3.1 Threonine synthase
  misc_feature (126)..(126): Xaa is any aa, unknown, or other
MGTFTAGSSLSLVFSHPHSHSRQPSAQGATASSHLHLHPRASRARCASSDTTGTKHRRPAKENIHEEEARLPGPAQGFSAWYEPFPPAPGGDPNERYSLDEVDYRSSSGGLLDVRHYMEALVRYPXSYWRDLFDSRVGRTA

SEQ ID NO: 27575 - DNA, 650 bp, Zea mays
  misc_feature: Ceres CLONE 1400975-F
  misc_feature: Encodes the peptide sequence at SEQ ID NO. 27576
tggagctccccgcggtggcggccgctctagaactagtggatcccccgggctgcaggaattcgcacgagaccattacctagaacatcctaatcgaaaagcaaggatggttttcagcaactagtttctgaacagcgtgtccgctgtctggtctgtcaaaataatcttggtaaccagtgccaaaatgattgctgggggaggctattttgatggttctcatgaccatattctcatggaaggatcaatgatccatgattcttcacaatcttccatctatgacaatacagatgttgaacagcagaacttcagatttgcgccctttatcatagaagatcactccaatccagccaaccttacctctgaggctgcaaagggtgatagaccaaatttcaacacccagctgggggattgacatccgagcaggaaccatagtgattcacctggatgcaaagaaagtccccccccggcaaaaaaactggaaaaattttgggggtcccccggcggtcataatgggggggggcaaaaaaaaattatttctcttttttccccccccaaaaaaaaaaaaaaggccccccccaaaaaaaaaaaaaaaagagggggggaaaaaaaaaaaaaagggggcccccggggggtgttttaaaccaccccccccg

SEQ ID NO: 27576 - protein, 75 aa, Zea mays
  misc_feature: Ceres CLONE 1400975-F
MIAGGGYFDGSHDHILMEGSMIHDSSQSSIYDNTDVEQQNFRFAPFIIEDHSNPANLTSEAAKGDRPNFNTQLGD

SEQ ID NO: 27577 - DNA, 736 bp, Zea mays
  misc_feature: Ceres CLONE 1400978-F
  misc_feature (333)..(333): n is a, c, t, g, unknown, or other
  misc_feature (419)..(419): n is a, c, t, g, unknown, or other
  misc_feature (449)..(449): n is a, c, t, g, unknown, or other
  misc_feature (579)..(579): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (619)..(619): n is a, c, t, g, unknown, or other
  misc_feature (620)..(620): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (670)..(670): n is a, c, t, g, unknown, or other
  misc_feature (671)..(671): n is a, c, t, g, unknown, or other
  misc_feature (674)..(674): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (706)..(706): n is a, c, t, g, unknown, or other
  misc_feature (707)..(707): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
ctggagctccccgcggtggcggccgctctagaactagtggatcccccgggctgcaggaattcgcacgagaccattacctagaacatcctaatcgaaaaagatcgttccgtaagggcacccatcgtcatagatacgattcatagcttctgccactacttgtgcgcgaagagccaagaaatgcgtcaggggttgtgaagggaaggagtgccgatggccggtggccacccggcgccgctgcggccggtggtggttgcgatgaaaggcacccatggtctggcaagtccacggcggcgcgcggcatcgcgaccgcgctttgctgtccgctcctggacnaggacgatgtgagggactgcatgttgcccctagagggcttggctgctgctgggatgctcaacgacctctccctacgcgtgttgtgncgtatggctgagcgccaggtaaggcttcgnactgtctgtcgtcatcgattcaccgctgtcacgccgctctcacctcgacatgctgacacgcctagcccgtgtgcttggtggtcctcgtggagtgtcgccctggtgataacgagtaatggcgcggagctgnaaaagcgtggcggtttnnnnnnnnnagggggggggggggnnggggnnnnnnnnnnnnnnnnnnnnnngggggggggggggnnngggggggnnggnttttnnngggggggggggnnnggggggggggnnttggggnnngggttttttggggggggtgt

SEQ ID NO: 27578 - DNA, 670 bp, Zea mays
  misc_feature: Ceres CLONE 1400982-F
  misc_feature: Translation starting site: 144
  misc_feature: Pfam Name: Syja_N Pfam Description: SacI homology domain
  misc_feature (299)..(299): n is a, c, t, g, unknown, or other
  misc_feature (319)..(319): n is a, c, t, g, unknown, or other
  misc_feature (401)..(401): n is a, c, t, g, unknown, or other
ccccgcggtggcggccgctctagaactagtggatcccccgggctgcaggaattcgcacgagaccattacctagaacatcctaatcgaaaaaaccgaagcaatccgacctgagaccaagacccgcaccacgcggctcgccgccgatggcgaacgccgacgccgacgaagcgccgctgctctctgtggaacacctccgtccaggatcctgcagccgcgagctcgagctgcgggagttccgcgaccgctacgtgatccgttcgctcgacggcgccgccgctttcgccgtccttcgctccggnggctccatccgccctctctncccagaggaagccgtagctgagagcgactgcaaggtttccagaatatacgggggtggtaggcaccataagattgctcgctgnaagctatgtactcgttatcacttctcagaaagatgctggctcttatcctggctcccctgtgtaccaagtgaactcaatgaaattcttatgctgcaacgaggctatcaagcacttgactccacagaaagaaaggatgaggcatacttcatgtctctcctgagaatgcagaaactaccttggggattgtatatccaaccgaacgggatttgacctaaacttgagagggcatcccagtggctggcggggaggaactaacccctatgaagcgg

SEQ ID NO: 27579 - DNA, 693 bp, Zea mays
  misc_feature: Ceres CLONE 1400989-F
  misc_feature: Encodes the peptide sequence at SEQ ID NO. 27580
  misc_feature (569)..(569): n is a, c, t, g, unknown, or other
aagctggagctccccgcggtggcggccgctctagaactagtggatcccccgggctgcaggaattcgcacgagaccattacctagaacatcctaatcgaaaacagctttgctttgtagttgtagcgctagcagcttaattggtctctgagctgaggtgcactactagctagctagtcgtgcaggaagaggaaggaatataatggctgagcgggaggtcgtcgaaggcgggacgacgacgggaggcgggctgtggcggaggtatgcgccgcacgtccagatggtgctggcgcagctgtgctacacgctcatgtacttcatcaccgaggccgccttcaaccaggggctcaacccctacgtctacatcacctaccgccatctgctcgtcgccgtcctcatctggcccttcgcatactacctggagaaggggctgaggcctaaaatgacgctcatgctgttcgtggagatattcgtgctctcccttctcggggtgagcttaactctgaacatgtacttcgcgagcctgaagtacacgtcccccaacgtcgtcacttccgtggtgaacacatcgnctcgatgacgttcgtcatcgccatcatcctcaagaaggaaaatcgtggacgggaaaacctacccgggtccccaagcccaaggacggggggcccttccccgggggccccctgatcttgaacaaga

SEQ ID NO: 27580 - protein, 125 aa, Zea mays
  misc_feature: Ceres CLONE 1400989-F
  misc_feature (124)..(124): Xaa is any aa, unknown, or other
MAEREVVEGGTTTGGGLWRRYAPHVQMVLAQLCYTLMYFITEAAFNQGLNPYVYITYRHLLVAVLIWPFAYYLEKGLRPKMTLMLFVEIFVLSLLGVSLTLNMYFASLKYTSPNVVTSVVNTSXR

SEQ ID NO: 27581 - DNA, 760 bp, Zea mays
  misc_feature: Ceres CLONE 1400991-F
  misc_feature: Encodes the peptide sequence at SEQ ID NO. 27582
  misc_feature (559)..(559): n is a, c, t, g, unknown, or other
  misc_feature (564)..(564): n is a, c, t, g, unknown, or other
  misc_feature (565)..(565): n is a, c, t, g, unknown, or other
  misc_feature (574)..(574): n is a, c, t, g, unknown, or other
  misc_feature (603)..(603): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
aaagctggagctccccgcggtggcggccgctctagaactagtggatcccccgggctgcaggaattcgcacgagaccatttacctagaacattcctaatcgaaaaagtgtgagagctcgattcgttgccgtccacttgtctcacggcctgtcgccatcttccttcctggttttttcatccgaccatccccggctcctccgcgccgtcggcgacgactccttcgagtcactcggccgcagcaaccggcgaccattgtaccgagtcgcctccgggctcggcgccctcaagaggcatggggcaaatgctcaaatgatgaatgctgcaattaggtgtgccagcacaagtgttgcacagaggtcttccggtggcttgtggacctggttgactggtgcgcgttcaaatgaaatacctcctccagatttcacactttccgggagtgactatttcctcctccgctgcctgaccatgtggaggctggcaaaacaagagtcacaacactttcccaatggtgttaaaatagcctctgagacatctgcgggatcatcttgttctgttggagntatgnnttgattggnggttctgtatatgaagcacttgaacaacnagtgccagtcaactggtgaagacatgccttcacaccctgcacaggnnnnnnnnntttggtgtgcgtgaattgaagaaaataggtgcagtgcaagcatctgctgcccgtggatgatagctacactacggagcctgagatactgctggaaaaagggttt

SEQ ID NO: 27582 - protein, 85 aa, Zea mays
  misc_feature: Ceres CLONE 1400991-F
  misc_feature (84)..(84): Xaa is any aa, unknown, or other
MMNAAIRCASTSVAQRSSGGLWTWLTGARSNEIPPPDFTLSGSDYFLLRCLTMWRLAKQESQHFPNGVKIASETSAGSSCSVGXM

SEQ ID NO: 27583 - DNA, 755 bp, Zea mays
  misc_feature: Ceres CLONE 1400994-F
  misc_feature: Encodes the peptide sequence at SEQ ID NO. 27584
  misc_feature (1)..(1): n is a, c, t, g, unknown, or other
  misc_feature (2)..(2): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (38)..(38): n is a, c, t, g, unknown, or other
  misc_feature (52)..(52): n is a, c, t, g, unknown, or other
  misc_feature (748)..(748): n is a, c, t, g, unknown, or other
nnggggnnnnnnnggggggggagccccacgggggggtnggtgggggcagccncacataactggagctccccgcggtggcggccgctctagaactagtggatcccccgggctgcaggaattcgcacgagaccattacctagaacatcctaatcgaaaaacacccgcagcaccgcatcactccgcctcgtcccccacttctcgcacttccgcttcagattccaccgtgcccaagagtcacgaggcggcggcgggtcacgccgacgtactctcaggtgctgcggtgggactgcccctgctgctgccgcgggggcggcggaggggaggatggccgcggcgacggcggaggacatggtgcgggcgagggtgcttgaggatgaggtgttccggatcgacgcgtcggaagcggcgcgcgccgccgcgtggcccagcctctcgttcgaggacccgcgggggaggtaggcgccgcatgacggggccgacatgcccgccgttgacccgttaattgctaggtcggaggcggaggggatacccagaagggcgggaaaaaagcattcccgtcctgggaacatctttctaagtttaccgggagaacacggggggcccaactacgaaacgcaccgggagaaacaaagtcttccacatgggaataccacatggcattgtttgttattggaagcccaacgaaacccaatttaaaagggttaccaagacgccaacccccattgcgcggttttggactgaaaccccnacaaagg

SEQ ID NO: 27584 - protein, 44 aa, Zea mays
  misc_feature: Ceres CLONE 1400994-F
MAAATAEDMVRARVLEDEVFRIDASEAARAAAWPSLSFEDPRGR

SEQ ID NO: 27585 - DNA, 726 bp, Zea mays
  misc_feature: Ceres CLONE 1400996-F
  misc_feature: Encodes the peptide sequence at SEQ ID NO. 27586
  misc_feature (397)..(397): n is a, c, t, g, unknown, or other
  misc_feature (506)..(506): n is a, c, t, g, unknown, or other
  misc_feature (507)..(507): n is a, c, t, g, unknown, or other
  misc_feature (541)..(541): n is a, c, t, g, unknown, or other
  misc_feature (545)..(545): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
tggagctccccgcggtggcggccgctctagaactagtggatcccccgggctgcaggaattcgcacgagaccattacctagaacatcctaatcgaaaatcttcaagggcacagccgcgcggccaccaccaacaccacctggccccgtccttcctttcttgtgttgccgctaggccatacacacacgacgtcgctgctccgcatggccaacgccaatggctcgtccaccggtgcaggccatagcgacctcgtcagggccatttcgcacgagcagcaccaggcgttcatggcctccgtgccccgggccgcaccgggcggggtgaatgtgcaccaccagcagcacttccaccaataccccgccggcttgatcccagcgccggtggcactgccggttcacgnaccgggtggtgccgtcacagacgtctccgtactccgccccagatcgcggtgccgccgccgccgccaccactcatcgcatctccagaccaccgcctgcactccctgccgnnctaccggatgctaccagctggactattctccaantggncaacgctgctgcgccttcgcagcagcacacatannnaataaagggggttttgctgactggggaacgcacagcaatgcgctcatgtccttggctcaggcccactagttttggtaacaacgggagcagcatatcaaacacatggattatacatcaaaactatccccgtacacacgcatactgg

SEQ ID NO: 27586 - protein, 149 aa, Zea mays
  misc_feature: Ceres CLONE 1400996-F
  misc_feature (66)..(66): Xaa is any aa, unknown, or other
  misc_feature (103)..(103): Xaa is any aa, unknown, or other
  misc_feature (114)..(114): Xaa is any aa, unknown, or other
  misc_feature (127)..(127): Xaa is any aa, unknown, or other
MANANGSSTGAGHSDLVRAISHEQHQAFMASVPRAAPGGVNVHHQQHFHQYPAGLIPAPVALPVHXPGGAVTDVSVLRPRSRCRRRRHHSSHLQTTACTPCRXTGCYQLDYSPXGQRCCAFAAAHIXNKGGFADWGTHSNALMSLAQAH

SEQ ID NO: 27587 - DNA, 725 bp, Zea mays
  misc_feature: Ceres CLONE 1400998-F
  misc_feature: Encodes the peptide sequence at SEQ ID NO. 27588
  misc_feature (278)..(278): n is a, c, t, g, unknown, or other
  misc_feature (279)..(279): n is a, c, t, g, unknown, or other
  misc_feature (289)..(289): n is a, c, t, g, unknown, or other
  misc_feature (291)..(291): n is a, c, t, g, unknown, or other
  misc_feature (296)..(296): n is a, c, t, g, unknown, or other
  misc_feature (297)..(297): n is a, c, t, g, unknown, or other
aagctggagctccccgcggtggcggccgctctagaactagtggatcccccgggcttgcaggaattcgcacgagaccattaacctaaaacattctaatcgaaaaatcaccgccgcggcctctattttctcccccattcccccctcgcatgccccgcttcgccgccgctacctcctcccgcccctaggtgacggtgactcacttgactccctacttccgtcgcccaaatttctattctcactatctccgccgcgagatctccggctgcccgcgccatggnntcgcgctccngnctcgnngctgcgcgggtatccgcaccatgccccgtgcgcacgcgtggtgcctcccgccccgcctccctcgagcgcggcacccgtgacgctgcaccgcccaagtcgggggtggcgtccacgtcaaaaatggggggggtccggtgggtttcccaagccccccccccggggggggggaatgggtccacgcccctgggtggggaccccctccaaaatttagggttaaaggtggccttttaaagaattgaaacccaaaggggggttgggcccaaaggggttttaaaaaggggttttttttagaaaaaaaaatgggggccccccaaaaaaaacttaaaggttttttgggggcggaaaaaaaaaaaaaaaacccccctttttttttatccaccaaaaaaaatgtttggggggcgcccccccccccccccaaaagaggaaat

SEQ ID NO: 27588 - protein, 84 aa, Zea mays
  misc_feature: Ceres CLONE 1400998-F
  misc_feature (2)..(2): Xaa is any aa, unknown, or other
  misc_feature (6)..(6): Xaa is any aa, unknown, or other
  misc_feature (8)..(8): Xaa is any aa, unknown, or other
MXSRSXLXAARVSAPCPVRTRGASRPASLERGTRDAAPPKSGVASTSKMGGVRWVSQAPPPGGGNGSTPLGGDPLQNLGLKVAF

SEQ ID NO: 27589 - DNA, 628 bp, Zea mays
  misc_feature: Ceres CLONE 1401002-F
  misc_feature (293)..(293): n is a, c, t, g, unknown, or other
  misc_feature (304)..(304): n is a, c, t, g, unknown, or other
  misc_feature (308)..(308): n is a, c, t, g, unknown, or other
  misc_feature (372)..(372): n is a, c, t, g, unknown, or other
aagctggagctccccgcggtggcggccgctctagaactagtggatcccccgggctgcaggaattcgcacgagaccattacctagaacatcctaatcgaaaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctgccgccagggtgtcgtatacgactacntcatcgggggncggngcaacggcgggtgccccgtgcccgcacgctgtcggagcccttcccgtggtgtggttgaacccgncccccgcctacaaaaacaccgaatgggggaatggccccttccggaaccgtttgggaaacctccccgggtccccccccaaagttttttgttgggaaaaggggtgttcaaaccccgccccggggggggggggggggatttttataaaccccggttttataacacgggccaaagaaaaaataaatgggggggccctgggggaaccttgcccccccccgcgggggggaacaccgggggggaaaaaacacggggggctccc

SEQ ID NO: 27590 - DNA, 641 bp, Zea mays
  misc_feature: Ceres CLONE 1401003-F
  misc_feature: SWISSPROT Homolog: EC 4.1.2.13 Fructose-bisphosphate aldolase
  misc_feature (305)..(305): n is a, c, t, g, unknown, or other
  misc_feature (317)..(317): n is a, c, t, g, unknown, or other
aagctggagctccccgcggtggcggccgctctagaactagtggatcccccgggctgcaggaattcgcacgagaccattacctagaacatcctaatcgaaaaattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcaccccctggaaaggtatcccttgctgctgatgagtcaactgccacccattggcaagcggcttttcangaattcatgtcnaagaacgtggaagaaaacccggggggcttctccgggaacttccggttctgttgcccttggggccctccagaaaataaaacgggggggaccccctttcaagaaaaaccctcttacccaaaaaaaaccaaggttggcaaaacctttttttcaaagtcccccaagaggagagagggggcctcccccccgggataaaagggccaaaaagggcccccttttgaggttttgggccccaccaaaaagaaaacccccccccccgggcccaaataaacccccggaaaaggggcgtttcaaaaaaataataaaaaagcgggccccccttttttt

SEQ ID NO: 27591 - DNA, 742 bp, Zea mays
  misc_feature: Ceres CLONE 1401006-F
  misc_feature: Encodes the peptide sequence at SEQ ID NO. 27592
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (36)..(36): n is a, c, t, g, unknown, or other
  misc_feature (635)..(635): n is a, c, t, g, unknown, or other
nnnnnnnnnnnnnnnnnnnnnnnttttgtgttattngttaaagtaggatgggtggaaacatgttggcatctccccgcggtggcggccgctctacaactcgtggatccccccggctgcaggaattcgcacgagaccattacctagaacatcctaatcgaaaaatcttcgccgccgataaacgttccccccacgccccaacctatccacgcgaaaccttctttcccccgggagacgattcgtcagggagaggaaagaggccagaggggccatggacgctgccaagttggtgacgccggacactgtgtctcacattctggcgcacccgtcggcgggctccgacggggcagtgattgatctcgtcgtttaggtcttcgaagtgaagtccgtcgggacgggcggtcggttcagcttcacagcaactgccgcgcaggataagatcaaggcggatgtttcccaccacccttgtgtaggaggccaccctctgggagcatgaagaacctcggcctctgccgcatcaccgactaccccttttcatcgcccctccacgcgcacccgacgacaaacgacctgggcgcccctcccactgcaaccatggggtggcaagtcgtcctggagcacgagtatcgaccggccgncctcccagcccaccgggacaccctccacgtggtgccgcacaccttaacaaaccactcgcatcggacagaaaaaaactcccccactccgattccacaagacccaaggc

SEQ ID NO: 27592 - protein, 32 aa, Zea mays
  misc_feature: Ceres CLONE 1401006-F
MDAAKLVTPDTVSHILAHPSAGSDGAVIDLVV

SEQ ID NO: 27593 - DNA, 729 bp, Zea mays
  misc_feature: Ceres CLONE 1401008-F
  misc_feature: Encodes the peptide sequence at SEQ ID NO. 27594
  misc_feature (519)..(519): n is a, c, t, g, unknown, or other
  misc_feature (520)..(520): n is a, c, t, g, unknown, or other
  misc_feature (528)..(528): n is a, c, t, g, unknown, or other
  misc_feature (531)..(531): n is a, c, t, g, unknown, or other
  misc_feature (532)..(532): n is a, c, t, g, unknown, or other
  misc_feature (552)..(552): n is a, c, t, g, unknown, or other
  misc_feature (578)..(578): n is a, c, t, g, unknown, or other
  misc_feature (579)..(579): n is a, c, t, g, unknown, or other
  misc_feature (581)..(581): n is a, c, t, g, unknown, or other
aagctggagctccccgcggtggcggccgctctagaactagtggatcccccgggctgcaggaattcgcacgagaccattacctagaacatcctaatcgaaaagtttccagctccgatccaacccagcatctgtaccgcgccgcgcgagcacgtccggcgccggtgcggcaggcgaaatccgagagcactcctcccccgctacgccgcaccgcccatggccgcagctagccgcagatagagagaggcgcaggcgagggcgtgcagatccagatccggtgggcgggaaggacttgatcgcccccaccaccatggccggcgcggtgtcggcgctcttcctgctgggcatgaagggccgcgttctcgtctggcgcgacacccgcggcgatgtctccgcgctccaggccgagcgcttcttcaccaagctcctcgacaaggagggcgattcggaagtgcactcgcctgtggtctacgacgacgctggcgtcacttacatggtcatccagcacaaacatgtcttccnntctcacgncgnntcgcagaactggtacgcggncagcatcctctcttccctcacggggnnantagatgtgtttagcactacttcgagagctgggaggagagtcctcaagataaccttccgcgtggggatgagttgtcaagaaataaggggattttggtacccacatacccggaggaaaaatttggatgagtctcaagacgagtatacggg

SEQ ID NO: 27594 - protein, 140 aa, Zea mays
  misc_feature: Ceres CLONE 1401008-F
  misc_feature (71)..(71): Xaa is any aa, unknown, or other
  misc_feature (74)..(74): Xaa is any aa, unknown, or other
  misc_feature (75)..(75): Xaa is any aa, unknown, or other
  misc_feature (82)..(82): Xaa is any aa, unknown, or other
  misc_feature (91)..(91): Xaa is any aa, unknown, or other
  misc_feature (92)..(92): Xaa is any aa, unknown, or other
MAGAVSALFLLGMKGRVLVWRDTRGDVSALQAERFFTKLLDKEGDSEVHSPVVYDDAGVTYMVIQHKHVFXSHXXSQNWYAXSILSSLTGXXDVFSTTSRAGRRVLKITFRVGMSCQEIRGFWYPHTRRKNLDESQDEYT

SEQ ID NO: 27595 - DNA, 648 bp, Zea mays
  misc_feature: Ceres CLONE 1401012-F
  misc_feature: Encodes the peptide sequence at SEQ ID NO. 27596
  misc_feature (237)..(237): n is a, c, t, g, unknown, or other
  misc_feature (238)..(238): n is a, c, t, g, unknown, or other
  misc_feature (258)..(258): n is a, c, t, g, unknown, or other
tggagctccccgcggtggcggccgctctagaactagtggatcccccgggctgcaggaattcgcacgagaccattacctagaacatcctaatcgaaaaacctttctcctctccttcattcctccccgtcccgcgtcgcgtcccacgccgccgcacctccgcggcagcgctactcctcgccgtgacgtcggggaggcctcgctcgggggagggctgcctgcctgcctggctgggtgagnntcggccgtagaggaggaggngggcggaggagcttgatctggggcacctgcccccccttccctgcgccgtcgggatgtacatgccgccgccgccgcccaccggcggcgccggcgagcagcctaggctttaccaggtctggcggggaagcaacgaattcttcttgcagggaagattcatatttgggcctgatgtgagatctgtgtttctcactatgatcctcatcatcgcaccagtgggtgtcttctgtctgtttgttgcagggcatctcataaatgatttccccgatagctggggaatctcagtgatggtaaggagtggttgtcttcactatttatggatttgacgttggttctttgtacctctggtagagatcctggtataataccccggaattctcatcctcctgaacc

SEQ ID NO: 27596 - protein, 89 aa, Zea mays
  misc_feature: Ceres CLONE 1401012-F
MYMPPPPPTGGAGEQPRLYQVWRGSNEFFLQGRFIFGPDVRSVFLTMILIIAPVGVFCLFVAGHLINDFPDSWGISVMVRSGCLHYLWI

SEQ ID NO: 27597 - DNA, 707 bp, Zea mays
  misc_feature: Ceres CLONE 1401013-F
  misc_feature: Translation starting site: 254
  misc_feature (389)..(389): n is a, c, t, g, unknown, or other
  misc_feature (434)..(434): n is a, c, t, g, unknown, or other
  misc_feature (435)..(435): n is a, c, t, g, unknown, or other
  misc_feature (566)..(566): n is a, c, t, g, unknown, or other
aaagctggagctccccgcggtggcggccgctctagaactagtggatcccccgggctgcaggaattcgcacgagaccattacctagaacatcctaatcgaaaagttcctttcttccccactacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctgggcatgaaggtcctcgtcctcgaccccccaaaccgttgggatgggtgagcgtggtgtacagccagtcggatctgctgncgggaaggaggtcttcctcgtcgagaccatggacaacgcctccgnnctccagggagtccatggcgcaccctcaaggccgtctaacttcctccgaccctccgctaacaacgtccaaaaagctccgcaggcacctcgccatgccgcgccttcgccgagtaccacctattcttctcaggnataaattgaagggtcccgcagattcaaatacttgcttgactcgattgaaaaaagaaggttgtgcaacaaagttcaggaagttctatgggtgattttttgggcccttgaccccatacattttcactcttcaacatacaaaat

SEQ ID NO: 27598 - DNA, 748 bp, Zea mays
  misc_feature: Ceres CLONE 1401017-F
  misc_feature (369)..(369): n is a, c, t, g, unknown, or other
  misc_feature (386)..(386): n is a, c, t, g, unknown, or other
  misc_feature (395)..(395): n is a, c, t, g, unknown, or other
  misc_feature (439)..(439): n is a, c, t, g, unknown, or other
aaagctggagctccccgcggtggcggccgctctagaactagtggatcccccgggctgcaggaattcgcacgagaccattacctagaacatcctaatcaaaaatccaattagggataatatttttacaaagcccgttgttcgggtactgccgatccaataaaactcctgccattgtcctatctctttctcctccattccccactgcatgcgcgctctgtcactgtcagtctcactctcgctcgctaccttggcgacgactggttgaccgccgctgccgctctagagcaggtgcccactgcccaggtcttcttctggtccttcgccggcgacaagcacaacccaggtgatttcagtactctgctttcaccnatatgtctgacggtcangaaactgancagacattgagattttgaagatcaagaaagtgatcaaggcatgnaatctgctagaggcaatggcaccagcatgatctctctggattatgccaccacgtgaccaattttcccgggtgaacaaaatgttggggaatgaattggaactgcttcaaaattaagaagtaaagcaaccggaattggttttaccaccctcccctagttcaacaaagggtgaattgttttaacaagttcccccaaagggtttgtttcctaacttgaaaaatttttttttgaaagtggaaggaaaaaacaccccctttttgttttgccctttaagcaaaaagggccccctgactttgtaaaaaaaatcccac

SEQ ID NO: 27599 - DNA, 750 bp, Zea mays
  misc_feature: Ceres CLONE 1401019-F
  misc_feature (386)..(386): n is a, c, t, g, unknown, or other
  misc_feature (526)..(526): n is a, c, t, g, unknown, or other
  misc_feature (593)..(593): n is a, c, t, g, unknown, or other
  misc_feature (611)..(611): n is a, c, t, g, unknown, or other
aagctggagctccccgcggtggcggccgctctagaactagtggatcccccgggctgcaggaattcgcacgagaccattacctagaacatcctaatcgaaaaattacggctgaagggagtcgctcgccgccgcgttcgaggcgttccctcgtcgcgctcgcgccgtcgaccttcaccgctcgctgtcaggtctgcccgccacgacctcgccggccacactcgcagctcgccctcgctcctacgcctcgccggcgaggccttctgccttttcgcgccctctatctgctgcgatctttggagcatcgttctcttctctcacttgagatccagacccctaaaccctagagctcgccgcttccgctcgctcgctccgcgctggcggcgacnatggaggacgaggagatggagaagaaggtgcagcagtacttggcagcgcaagggtttccgcctcactgagcttgcgctcccaggaggagtgcaaccgcctctccacctccgccaatctccgacgttgcgctttgcacggntctgaccatgatccagcgagaatactacgatgggatatagcagattaagaactgggggcatacaggntctccttgatcaatattnagcccgaatttaccttccgggccccttttaacccggttttcatcccaaaactttccggggaatctaagggggcaaaaagacattttgcccggaaagcccggggcatttttcccaaaaattttggggaaaaaaatgtggg

SEQ ID NO: 27600 - DNA, 702 bp, Zea mays
  misc_feature: Ceres CLONE 1401020-F
  misc_feature: Encodes the peptide sequence at SEQ ID NO. 27601
  misc_feature (482)..(482): n is a, c, t, g, unknown, or other
  misc_feature (529)..(529): n is a, c, t, g, unknown, or other
  misc_feature (574)..(574): n is a, c, t, g, unknown, or other
aagctggagctccccgcggtggcggccgctctagaactagtggatcccccgggctgcaggaattcgcacgagaccattacctagaacatcctaattgaaaaatttctcgctgcttctttctcttcaagaaaacgtcaaaaaaacgtcagcaccaggctcctccctctaataaatagcggcgggcctctgtcagctcacagctcagtcctcttcaaccccgtttcgccgcccctagcccaaatccccctacatctcagcctcatccttctccgctagccatggccgccgcgggtcccgggctctactccgagatcgggaagaaggccagagatctcctatataaggactaccacacggaccagaagttcacgctcaccacctacgccgccaacggagctgccattactgctgcaagcacgaggaaagatgaagctatctttaatgaaatccagagccagctgaagcacacaatgtgaactgtnggatgtgaaagcaacttcagaatcaaatgtgataactacaatcacangttcatgagctgggcaccaccaggcttgaaggaaatttttatgcngttcctttcccgtaccagaaaatctgcaaaggctgaacctccagtattgcccacccaattgctggtgttttccttgcaaagtgttggccctaaatgcaaaaaccctgttgttaaaccctttctggggg

SEQ ID NO: 27601 - protein, 65 aa, Zea mays
  misc_feature: Ceres CLONE 1401020-F
MAAAGPGLYSEIGKKARDLLYKDYHTDQKFTLTTYAANGAAITAASTRKDEAIFNEIQSQLKHTM

SEQ ID NO: 27602 - DNA, 703 bp, Zea mays
  misc_feature: Ceres CLONE 1401021-F
  misc_feature (335)..(335): n is a, c, t, g, unknown, or other
  misc_feature (367)..(367): n is a, c, t, g, unknown, or other
  misc_feature (368)..(368): n is a, c, t, g, unknown, or other
  misc_feature (419)..(419): n is a, c, t, g, unknown, or other
  misc_feature (420)..(420): n is a, c, t, g, unknown, or other
  misc_feature (429)..(429): n is a, c, t, g, unknown, or other
  misc_feature (450)..(450): n is a, c, t, g, unknown, or other
  misc_feature (471)..(471): n is a, c, t, g, unknown, or other
  misc_feature (472)..(472): n is a, c, t, g, unknown, or other
  misc_feature (495)..(495): n is a, c, t, g, unknown, or other
  misc_feature (523)..(523): n is a, c, t, g, unknown, or other
  misc_feature (541)..(541): n is a, c, t, g, unknown, or other
  misc_feature (563)..(563): n is a, c, t, g, unknown, or other
  misc_feature (642)..(642): n is a, c, t, g, unknown, or other
  misc_feature (651)..(651): n is a, c, t, g, unknown, or other
  misc_feature (663)..(663): n is a, c, t, g, unknown, or other
  misc_feature (671)..(671): n is a, c, t, g, unknown, or other
aagctggagctccccgcggtggcggccgctctagaactagtggatcccccgggcttgcaggaattcgcacgagaccatttacctagaacatcctaatcgaaaagtgtcgtcttcctctccgccgcttctcctgtccaccctcgactgcttgcgcgtgacctgagccgccgccgcctacttccgctcatccccgcgcccgcctcaaccacgccgcccccgaccacgtataatcctgcctccccttcgcgcggtttcgaggctcgtttcctttgggatcgttcgtctgccccgaccgcgtgggcgcttcttcttcgggatctcgctggaccgagcgncccagggctagggattcaggcccatggcgtgnncgcgcgtcctccaccagatttgcaggcatcgaccagcaaaagcaatctacnnatgactagntgcttcctcccctttgggtgntcctcgaagtgacatcacttnncagtgccaggattagacattttnacagagagaaccagtcaagttacattgntagcttgcaccggcgggntccgagacttagaatccaccangcggaacttctcttgcttaggagattttacggaaagtgaccccagagcgtgtcatacaaattattgaaagcccaccttncatacattnctatcctgcagnacttttcngaggatgtaaagctccttttgaaaggttgata

SEQ ID NO: 27603 - DNA, 799 bp, Zea mays
  misc_feature: Ceres CLONE 1401022-F
  misc_feature: Encodes the peptide sequence at SEQ ID NO. 27604
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (32)..(32): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
nnnnnnnnnnnnnnnnnnnaaaccaaaatttntatggtgtagannnntccaaagctggagctccccgcggtggcggccgctctagaactagtggatcccccgggctgcaggaattcgcacgagaccattacctagaacatcctaatcgaaaaagtcgggacgcagggagaggcagcacaggagcagccagctccatacatcctctttcccctcctcgcttcggttcctcggcggattcctcctccctcggacgtgcccgtccccgttttcggcgcgcgagctcgcccgagatggcaagcgcgagatcgggcgtcgctgcgaatgacgagtgcatgctcaaggacggcgagctgcagccgaggaggctgcatcgctgcctaagtttcaagatggaagacaagttgaaggagatcgtcgagggacaaacgcgggcgatcgcgcaacccagggtacagaggattttcaggacccaccctcccccgagcaacgactgcccgatagcgcgactctatggacgatccacttttggtcacctggcggaatgacggccccagaaaaaagcagggaaccttcctaaaatccctagggcgccccccatccctccgccccagggagaagaaagcaagaatggcttttattgccaaggcttaagaaccaagaaatttcaagaagtgggggctccaaggggaagtttccaaggtggaaacctggcaaggcctaattggacggcaaggcggaaactcccaccttgggatggaggaacccaaggggaccgtggcttggccctaggggcaatcat

SEQ ID NO: 27604 - protein, 84 aa, Zea mays
  misc_feature: Ceres CLONE 1401022-F
MASARSGVAANDECMLKDGELQPRRLHRCLSFKMEDKLKEIVEGQTRAIAQPRVQRIFRTHPPPSNDCPIARLYGRSTFGHLAE

SEQ ID NO: 27605 - DNA, 674 bp, Zea mays
  misc_feature: Ceres CLONE 1401024-F
gctctagaactagtggatcccccgggctgcaggaattcgcacgagaccattacctagaacatcctaatcgaaaagctagggtttactgcttgtcttcctttctcggagtcggcaccttcgcggcttcgcctgatcgcctacgccgcttcgtcctgattctgattctctggtgctcccaagaagaaagtcaggaatgaaggaccgccacctctcgctgaccagacccagcgggtccgcctcgaggccgcgcttcaaagagctccagtccgttgcgcccgccgccgcgtccgccgccgccgtcaccgtcgcgggacaccatttcccgtaaatcaggaggacaacatcctcaaggggcaatgggacgtcggatcaggacgggggaggtggttgccaccctcctgcgggtgggggaagcggaccaaaaggctggcctacgcccgcccttcttcggcgaaaaaaaaggccggaggttggggatatcataacctgcccgcggggctacaactccgcccccacccgcgcggggggcccgccaccatttcgccccacactgcggccccggccgttttccccctgactttcttctgatcgtcatttacaacaagagggactgtgcgagacgccaccctacgcccgcgcccccacccccccaatcacaccccgacagcctagcg

SEQ ID NO: 27606 - DNA, 721 bp, Zea mays
  misc_feature: Ceres CLONE 1401025-F
  misc_feature (332)..(332): n is a, c, t, g, unknown, or other
  misc_feature (463)..(463): n is a, c, t, g, unknown, or other
  misc_feature (464)..(464): n is a, c, t, g, unknown, or other
  misc_feature (468)..(468): n is a, c, t, g, unknown, or other
  misc_feature (483)..(483): n is a, c, t, g, unknown, or other
  misc_feature (629)..(629): n is a, c, t, g, unknown, or other
  misc_feature (675)..(675): n is a, c, t, g, unknown, or other
  misc_feature (676)..(676): n is a, c, t, g, unknown, or other
aaagctggagctccccgcggtggcggccgctctagaactagtggatcccccgggctgcaggaattcgcacgagaccattacctagaacatcctaatcaaaaagaaaggttttgccgcccgtgggggtttggatcgagggctctaagccgtgtctccgcaataccgggctggcctggcggcgattgctagggttttctggtcggatttcggcggaagagctgaggcgttgcttcgagtgcgggagctgtctgcaatccgccgcttggccttggcccgagtttggtgtttccgcagcaatgcctctccgattttagctcgccctggggttctgnaagggcgaaggggctggttgggcggtttgagcttgcaaggcgttggctggttcggtccaatgtccggggctagcgcgaggggggcggctgttcgccggcgtccagcgggcggcggagactcctgaacccgnntcancgggggggcagaccncgcctcgggtgtccgctggcctcgcggcaggaagccctcacgagggccccggggagagggattgtggcccgcgggcagcgggccgccgagggaaggaaaaagaaaccccgccagccgtgcttcacattggcaagccctcgctcagnggcgcccccgcagggaatggcgtccggcaggaagctgctggctgcnncctcgggggcttgtcttcctttgaacgcgtccctggctccctccg

SEQ ID NO: 27607 - DNA, 760 bp, Zea mays
  misc_feature: Ceres CLONE 1401026-F
  misc_feature: Encodes the peptide sequence at SEQ ID NO. 27608
  misc_feature (312)..(312): n is a, c, t, g, unknown, or other
  misc_feature (319)..(319): n is a, c, t, g, unknown, or other
  misc_feature (322)..(322): n is a, c, t, g, unknown, or other
  misc_feature (326)..(326): n is a, c, t, g, unknown, or other
  misc_feature (330)..(330): n is a, c, t, g, unknown, or other
  misc_feature (371)..(371): n is a, c, t, g, unknown, or other
  misc_feature (398)..(398): n is a, c, t, g, unknown, or other
  misc_feature (409)..(409): n is a, c, t, g, unknown, or other
  misc_feature (469)..(469): n is a, c, t, g, unknown, or other
  misc_feature (567)..(567): n is a, c, t, g, unknown, or other
caaagctgggagccaccgcgggggcggccgcttccagaactaagtggatcccccgggcttgcaggaattcgcacgagaaccattaacctaagaacatcctaatcgaaaaccaacccaggcaacacagcaatcagcagaaaaacttctccttggccttccatccatatgatccatccctccaggctccagctaactccaaactaccctctggttcgactcgcgttcgcatcgcaagcagcagcgtaccatcgaggcaatggcggtgatgggcgaagtagtgtcgaccaccggcgcggcgctccggagcccggncacgcancanccgncggncgcgggcgcggcaaaaggcaccgacgctgagaagctccagntcatcgaggacatgaccctccacgtgnacgccgtgcangagcgcgtgcttgggggaaatccttcgcccggaacgcggacaacgagtacctctcccagnaggtgcgggccttggcgggggttaggggaccgcgcccacttccggcgcaaaggggccaatggggaacctaacaagaacctggaagccgtacatcgggnaatttgcccaaagggggacgtcgcccatttttggggggggggaaccggggtttcccgaattccccaacaattcccggaaagtcggggggggggagggaaaattttggcccccaaccgggggggagagttctaccgcgggccaggtggggggaaagcctccaaatgcccgtatgaaacccggacagggccgggg

SEQ ID NO: 27608 - protein, 168 aa, Zea mays
  misc_feature: Ceres CLONE 1401026-F
  misc_feature (19)..(19): Xaa is any aa, unknown, or other
  misc_feature (21)..(21): Xaa is any aa, unknown, or other
  misc_feature (22)..(22): Xaa is any aa, unknown, or other
  misc_feature (24)..(24): Xaa is any aa, unknown, or other
  misc_feature (25)..(25): Xaa is any aa, unknown, or other
  misc_feature (39)..(39): Xaa is any aa, unknown, or other
  misc_feature (48)..(48): Xaa is any aa, unknown, or other
  misc_feature (51)..(51): Xaa is any aa, unknown, or other
  misc_feature (71)..(71): Xaa is any aa, unknown, or other
  misc_feature (104)..(104): Xaa is any aa, unknown, or other
MAVMGEVVSTTGAALRSPXTXXPXXAGAAKGTDAEKLQXIEDMTLHVXAVXERVLGGNPSPGTRTTSTSPXRCGPWRGLGDRAHFRRKGANGEPNKNLEAVHRXICPKGDVAHFWGGGTGVSRIPQQFPESRGGGGKILAPNRGGEFYRGPGGGKASKCPYETRTGPG

SEQ ID NO: 27609 - DNA, 682 bp, Zea mays
  misc_feature: Ceres CLONE 1401027-F
  misc_feature: Encodes the peptide sequence at SEQ ID NO. 27610
  misc_feature (431)..(431): n is a, c, t, g, unknown, or other
aaagctggagctccccgcggtggcggccgctctagaactagtggatcccccgggctgcaggaattcgcacgagaccattacctagaacatcctaatcgaaaaatctctcttcctccttccacaagcgccgccgcagccccttctcgatctttgaggcaaagctacgactccaccaccgctggcatggcgttcgagaagatcaaggtctccaacccaatcgtcgagatggacggtgatgagatgaccagagtattctggcagtctatcaaggacaagcttatctttccatttctggacctggacatcaagtactatgacttggggatactgcaccgtgacgcaactgatgacaaggtcacagtggaggctgcagaggctactctcaagtacaatgtggccattaagtgtgcgaccattactccagatgaaanctagggttaaggagttcaatttgaagcacatgtggaagagcccaaatggcacaattaggaacattataaatgggtactggtgttcagagaaccaattatatgcaaaaacgtttccaaggcttggttccagggatggacgaagcccatctggcattggaagtcatgcccttcggtgatcagtaccgagttaactgatgcaggttctggaaggggccctgggaaagctggaagctagtttttgagggaaaagg

SEQ ID NO: 27610 - protein, 82 aa, Zea mays
  misc_feature: Ceres CLONE 1401027-F
  misc_feature: SWISSPROT Homolog: EC 1.1.1.42 Isocitrate dehydrogenase (NADP(+))
MAFEKIKVSNPIVEMDGDEMTRVFWQSIKDKLIFPFLDLDIKYYDLGILHRDATDDKVTVEAAEATLKYNVAIKCATITPDE

SEQ ID NO: 27611 - DNA, 751 bp, Zea mays
  misc_feature: Ceres CLONE 1401028-F
  misc_feature: Encodes the peptide sequence at SEQ ID NO. 27612
  misc_feature (90)..(90): n is a, c, t, g, unknown, or other
  misc_feature (291)..(291): n is a, c, t, g, unknown, or other
  misc_feature (419)..(419): n is a, c, t, g, unknown, or other
  misc_feature (473)..(473): n is a, c, t, g, unknown, or other
  misc_feature (474)..(474): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (659)..(659): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (676)..(676): n is a, c, t, g, unknown, or other
  misc_feature (677)..(677): n is a, c, t, g, unknown, or other
  misc_feature (680)..(680): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (702)..(702): n is a, c, t, g, unknown, or other
  misc_feature (703)..(703): n is a, c, t, g, unknown, or other
  misc_feature (708)..(708): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (720)..(720): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (735)..(735): n is a, c, t, g, unknown, or other
  misc_feature (736)..(736): n is a, c, t, g, unknown, or other
  misc_feature (739)..(739): n is a, c, t, g, unknown, or other
  misc_feature (740)..(740): n is a, c, t, g, unknown, or other
  misc_feature (751)..(751): n is a, c, t, g, unknown, or other
ggagctccccgcggtggcggccgctctagaactagtggatcccccgggctgcaggaattcgcacgagaccattacctagaacatcctaantcgaaaaaaaaaaacgcacgggggagcttgggagacttcacgacaaatcgacgatcgccgcttctcttggccattgtagagggagagagagagcgcgagcgacctaggtcagtcggtttcggttttgggcgtcagcttcagctatccgcgaccgcgacgatgggtctgcgcgtggccgccaccgcgccagctccggccggngtgcgcgtgctcggcaggggcgccgcgcgcgtgacgccgcgaccgtgggcggctgtcggcggcaggagacgcttccccgtgcggatgtccgtcgcgaccaccgaggccaccaccaccatcgccgtggnggcctcggaggacccaggggctggagggtaggaactccaagacggtggtggcgnncttcctcggggggggcggccggaaccagcttcttcccgcttaccagacggaggggccaagcccggggggccaatgggcgggggggaacgggttctccgagggggcggggaggaaactggataaaacggggggataaaaaagggcttattggtcgcnnnnnnnnnnnctnnnnnnnnnntnnnncncccnnnnnnnnngagannaanannnnnnnnnnggggggggggnnggggnaggggnnnnggngggggnnnnnnnngnnggnnggggggggggn

SEQ ID NO: 27612 - protein, 66 aa, Zea mays
  misc_feature: Ceres CLONE 1401028-F
  misc_feature (57)..(57): Xaa is any aa, unknown, or other
MGLRVAATAPAPAGVRVLGRGAARVTPRPWAAVGGRRRFPVRMSVATTEATTTIAVXASEDPGAGG

SEQ ID NO: 27613 - DNA, 728 bp, Zea mays
  misc_feature: Ceres CLONE 1401029-F
  misc_feature: Translation starting site: 179
  misc_feature (626)..(626): n is a, c, t, g, unknown, or other
  misc_feature (627)..(627): n is a, c, t, g, unknown, or other
  misc_feature (647)..(647): n is a, c, t, g, unknown, or other
ctggagctccccgcggtggcggccgctctagaactagtggatcccccgggctgcaggaattcgcacgagaccattacctagaacatcctaatcgaaaactgctcctctaccccttcctctcccggcgaccagctggcctctcctttgttgaggcgagagacccccacccgatccggcgatggacgccgcgtccaggccgcctccgccccacggagcaggggtccgcgtccgcgccccgctggtggagtctgtctcctgctactgcagattagatacaggccttaaaactgttgttgaggccaggaagtttgttcctggcgcgaaaatgtgcatgcaacctgaagtcaaacaaaacaagcgcaagtcaaggggctcaaaaaaggaaaggtgcaggactcaagcaccacttttacctggccttcctgatgatcttgctattgcctgccttatacgagttcctcgacttgacagccaaactcaggatggtttgcaaaagatggaaccgtcttttgtctggggaatacttttactccttgcgtagaaaaatgagtgcagaaaaaaaggggtgatgcctttaaaagggacggtgagggaagatatcctggtatgccttgatcactcccccnnttatggagtcactccacagntcacaagagatcaaagcatggggctttggggggccccttccggagggtgcattccggacttgttggcgggaaaaccccttt

SEQ ID NO: 27614 - DNA, 769 bp, Zea mays
  misc_feature: Ceres CLONE 1401030-F
  misc_feature: Encodes the peptide sequence at SEQ ID NO. 27615
  misc_feature (1)..(1): n is a, c, t, g, unknown, or other
  misc_feature (16)..(16): n is a, c, t, g, unknown, or other
  misc_feature (17)..(17): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (660)..(660): n is a, c, t, g, unknown, or other
naaaaaaaaaaaaaannggggaaaagggaagaggggggcagacctcccctnnnnacaaagtggagctccccgcggtggcggccgctctagaatagtggatcccccgggctgcaggaattcgcacgagaccattacctagaacatcctaatcaaaaatcccatcccctcaggcctcggtcgtcagtccctcacacactcactatacactgctctgctgcagcaagaaggaagaagctagcgcctccctagctctcgttgtcagcaatggacaacaccgccgcgtccagccacctcgagtcctccttcgcgggctcccggtgtcccttcggccacgcgcaccaccaccccgtacggccgtggccgatggtcacccccgcgcgccggggggggccgcaaacgcggcgtcatgtcctgcctccccagccggccctacgaactgaaggcccttgcgggtcacccccctccaggggagccctcggtgtcccggggaagaatgacaccggcggctaaatgagggacatggatcaaccccggccaaaaacgaaacagggggatccgggggcgcccgggcgcccaaaacccccacgcccagccccgtgacaagctgggcccacgggaccccctctccggggagcgcccccctatcaaaaaaaaccctcnacattggtccccccggttgggggaaaacccgttgtgcccaaacgggggtccggatctgggtctatcgggccccaggggagggagcggcgcgcgaggcaacccggtgccc

SEQ ID NO: 27615 - protein, 35 aa, Zea mays
  misc_feature: Ceres CLONE 1401030-F
MSCLPSRPYELKALAGHPPPGEPSVSRGRMTPAAK

SEQ ID NO: 27616 - DNA, 710 bp, Zea mays
  misc_feature: Ceres CLONE 1401031-F
  misc_feature: Encodes the peptide sequence at SEQ ID NO. 27617
  misc_feature (318)..(318): n is a, c, t, g, unknown, or other
aaagctggagctccccgcggtggcggccgctctagaactagtggatcccccgggctgcaggaattcgcacgagaccattacctagaacatcctaatcgaaaaattttgccaatgcgacggtgaaatcccgcacctacctccttcctctctcaccgaggaccctcgcaccaagaactgagcgggaagagaggtagagaggcaagcgcacgagagtttctgctcctagtctcgtctcgccccgcctccgtctcctttccctctctggttctctctctgcgattctcgtcgcattggttccgttccctcacgaaaggcggnagctttctgtcttccctgatctatctagataatggcgaccacgacgtcagcgaccacccgcgcagcagcagccgccaccaccgccaagcccgcggggtcgtcgtcggccctctgccagagggtgctcggcggcggcaggcgccgctccggggtgtggcgtgcaaccccgccggcgtgaaggccaagcgcatgccggggtaaaggggccagggtccccgccccgaggagttaagaaaacccccgaccgtcccggagggaaaggagtaccttggttgggtgggccctgtgtccacccagccccgggggaagggggaaaaacttgtttgcgaaaaggaattgggcccccgggtataaagaaactccccccccggaccattgaaaaagggtgtgcc

SEQ ID NO: 27617 - protein, 48 aa, Zea mays
  misc_feature: Ceres CLONE 1401031-F
MATTTSATTRAAAAATTAKPAGSSSALCQRVLGGGRRRSGVWRATPPA

SEQ ID NO: 27618 - DNA, 697 bp, Zea mays
  misc_feature: Ceres CLONE 1401034-F
  misc_feature: Encodes the peptide sequence at SEQ ID NO. 27619
  misc_feature (340)..(340): n is a, c, t, g, unknown, or other
  misc_feature (372)..(372): n is a, c, t, g, unknown, or other
  misc_feature (435)..(435): n is a, c, t, g, unknown, or other
  misc_feature (524)..(524): n is a, c, t, g, unknown, or other
tccccgcggtggcggccgctctagaactagtggatcccccgggctgcaggaattcgcacgagaccattacctagaacatcctaatcgaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgnccctccacgggtccgggtgcacgctcatgttnccgcgggccgtggctcgcccgcgcggacttcctgctgacgtgcgaccccggcggccgtccagncactgcctggcgtccaaccacgggggctaacgacaggggccgagacttttgcggagatgttcgacctcctgggcgacggggctgctggnttgcggacgcccgcgttcgtgggccgcgcccagcggcacggtcgccgccaccgtctttcggcaaccccgggggtcccggtcctttcgtcctgtgccccatgggggcggccgtacggcgcgcctgtccgtggccgtttcctggactgggccccgcgggtaatcggaacgggaaa

SEQ ID NO: 27619 - protein, 87 aa, Zea mays
  misc_feature: Ceres CLONE 1401034-F
  misc_feature (65)..(65): Xaa is any aa, unknown, or other
  misc_feature (76)..(76): Xaa is any aa, unknown, or other
MGALRSLAISYPEFLVAGLCFVSLSALRHAMRERRQRAPLSWPVVGMLPFVLANLGRLYDAITDXPPRVRVHAHVXAGRGSPARTSC

SEQ ID NO: 27620 - DNA, 660 bp, Zea mays
  misc_feature: Ceres CLONE 1401035-F
  misc_feature: Encodes the peptide sequence at SEQ ID NO. 27621
  misc_feature (499)..(499): n is a, c, t, g, unknown, or other
  misc_feature (610)..(610): n is a, c, t, g, unknown, or other
  misc_feature (660)..(660): n is a, c, t, g, unknown, or other
ggagctccccgcggtggcggccgctctagaactagtggatcccccgggctgcaggaattcgcacgagaccattacctagaacatcctaaaaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacaccttcccgggctcgcccgcgcagcgcttcgtgtcggaggacggcgtcatcaactcgncgcccgcgggtgctgggcggcggcagctgcatcaacgccggcttctacacgcgggccagcgacgactacgtgcgggggcggtcggtgggaacctgggcgccgccggggcgncgtaacggtgggtgggaggaacgtgggggcgtccagccgagtggggggcn

SEQ ID NO: 27621 - protein, 156 aa, Zea mays
  misc_feature: Ceres CLONE 1401035-F
  misc_feature: SWISSPROT Homolog: EC 4.1.2.10 Mandelonitrile lyase
  misc_feature (120)..(120): Xaa is any aa, unknown, or other
MSGRSRHFTMSTLLATSFFFVLLCSSLQVRGVNYTFVKDAALAPSVSYYDYIIVGGGTAGCPLAATLSERFRVLLLERGASPYDDDRIGDMARFADTLSDTFPGSPAQRFVSEDGVINSXPAGAGRRQLHQRRLLHAGQRRLRAGAVGGNLGAAGA

SEQ ID NO: 27622 - DNA, 655 bp, Zea mays
  misc_feature: Ceres CLONE 1401036-F
  misc_feature: Translation starting site: 183
  misc_feature (464)..(464): n is a, c, t, g, unknown, or other
  misc_feature (474)..(474): n is a, c, t, g, unknown, or other
  misc_feature (484)..(484): n is a, c, t, g, unknown, or other
gctctagaactagtggatcccccgggctgcaggaattcgcacgagaccattcctagaacatcctaatcgaaaaccacctccaaagtccaaaagcgaagcctacgcccgccccaacggtgaaaacgtcggaaccctagatccctctcacggtcgcgcctgtgctccaaaaccttagatccgacatgcatcagcccagagcccgctacccacccgggtatggctccagcgggggaggcggtggcgggggaggcggtagtggagtaggaagaggaggcagcggcggcggaggaaaccacaactactacggccggaacacacatccacagcatcaacaccactaccagcagcagcagcagcactcgcataggaactcctcgcaccagcagcagtggctgcggcgagaccagggccccgccgttgcggggccagtgtctggaaacgctgtgcctaagacggcgcctcgncttgacgtgnttgactcgangttctcaagattggaaggctcaactaaatataccagctccagacacacgctacaggaacagaggatgtcactgcaacaaagggcatgagttttgaggattatttcttgaaacgtgaggtgcttatgggaatatatggaaaagggaatttgaaatgccatctcctattcaag

SEQ ID NO: 27623 - DNA, 635 bp, Zea mays
  misc_feature: Ceres CLONE 1401037-F
  misc_feature: Encodes the peptide sequence at SEQ ID NO. 27624
  misc_feature (456)..(456): n is a, c, t, g, unknown, or other
  misc_feature (635)..(635): n is a, c, t, g, unknown, or other
aagctggagctccccgcggtggcggccgctctagtctagtggatcccccgggctgcaggaattcgcacgagaccattacctagaacatcctaatcgaaaaacgaaatcaacccaaaccctagcatcccctttgctcgagggagacgaagatggcgccgaagaggaagacgagtggggcgacggcgtgggtagaaatcgccagctgacgagttcgcaaagccggcggacgacacgaagggatcgccagccgagttcgccaaaccggtttaccttgtggcggcgcgcgacgacgacccggcggcctactccgttctggagatcgacgccgctgccggtggcgacgagccgccgcgcatccgcaccgttgccggtctgacgggcttcatctccgagcctggcatgtccttcgtcgcggcgcattcgaagcacggctcctggattgtcgggcgtcgcggnggggttaagagcgggcaccatcatcttcgacccgaggactttgagactttcccgcgcccgcgggtcagggacccaaggcggaaacccgtcctggtctcccacgggaggggaaaaattcgctttctcccgcccccccccctgttgggggggcccccaatcgaatgcgaaaccctggggtn

SEQ ID NO: 27624 - protein, 78 aa, Zea mays
  misc_feature: Ceres CLONE 1401037-F
MSFVAAHSKHGSWIVGRRGGVKSGHHHLRPEDFETFPRPRVRDPRRKPVLVSHGRGKIRFLPPPPLLGGPPIECETLG

SEQ ID NO: 27625 - DNA, 751 bp, Zea mays
  misc_feature: Ceres CLONE 1401042-F
  misc_feature: Encodes the peptide sequence at SEQ ID NO. 27626
  misc_feature (502)..(502): n is a, c, t, g, unknown, or other
  misc_feature (514)..(514): n is a, c, t, g, unknown, or other
  misc_feature (535)..(535): n is a, c, t, g, unknown, or other
  misc_feature (700)..(700): n is a, c, t, g, unknown, or other
  misc_feature (713)..(713): n is a, c, t, g, unknown, or other
  misc_feature (749)..(749): n is a, c, t, g, unknown, or other
tggagctccccgcggtggcggccgctctagaactagtggatcccccgggctgcaggaattcgcacgagaccattacctagaacatcctaatcgaaaaattccaagctctcttcattggttcatagctagctagttcgcctcccaaaaacacctgccctcgtgcgtggcaggagcacgggcacgatgatcagcacagcgcacagccggcagcagcaccatgccttcgagaagagccctggcaacagccacatgaagagcatcgacaggaagctgcagcaggccatgagccaggcggccagcaagtacatgcagaggatctaccctctaggcatgcagaggagcagctccagcctcacattgtcgtcgctctcgctggcgcagaactccaacgactcctccatcagcagctccaactccagctgggagcccaaggtgccgctgctctacgggggcaccttcagcccatggggcgacgtcatggtgtctcgggagatgaggcggnaggacgatgacnaggtcagtgaccatgaccgcnaaggaggcgaggaggacttggactggagtgagcccgggaaccttgctaagtgaatttgaatcaccaaggaaaggggcgagggcttaccgccagttcccgggaggggggggggggggtccctgtggaaaaaaaaaaacgggtttggttcaagttcgtggcggtggnagggaatggtganccccaccaagagtggggggaaaaatggaaggggggngg

SEQ ID NO: 27626 - protein, 134 aa, Zea mays
  misc_feature: Ceres CLONE 1401042-F
  misc_feature (107)..(107): Xaa is any aa, unknown, or other
  misc_feature (111)..(111): Xaa is any aa, unknown, or other
  misc_feature (118)..(118): Xaa is any aa, unknown, or other
MISTAHSRQQHHAFEKSPGNSHMKSIDRKLQQAMSQAASKYMQRIYPLGMQRSSSSLTLSSLSLAQNSNDSSISSSNSSWEPKVPLLYGGTFSPWGDVMVSREMRRXDDDXVSDHDRXGGEEDLDWSEPGNLAK

SEQ ID NO: 27627 - DNA, 738 bp, Zea mays
  misc_feature: Ceres CLONE 1401043-F
  misc_feature (286)..(286): n is a, c, t, g, unknown, or other
  misc_feature (340)..(340): n is a, c, t, g, unknown, or other
  misc_feature (350)..(350): n is a, c, t, g, unknown, or other
  misc_feature (385)..(385): n is a, c, t, g, unknown, or other
  misc_feature (413)..(413): n is a, c, t, g, unknown, or other
  misc_feature (438)..(438): n is a, c, t, g, unknown, or other
gctggagctccccgcggtggcggccgctctagaactagtggatcccccgggctgcaggaattcgcacgagaccattacctagaacatcctaatcgaaaaacaccttccctcggtcccttccatctcctagccgccgccgccgccgccgctgcccaaaaccctacctaccctcttcttcccctcactctcctttcatctccattctaatggcggcccaacccgtccggcgaagctgctagtgcttgtatctactatcttcatcaggtacttcgcgatcctactgaangtattccccgccgccgctgccatggccacccctcaccctttcgaactcgttggncgcgacgacnacgacgacccgacgcagctgattgcggcgcggcgnctgctgctcaaaaagccgagagaaaaantccgccgtggcgcctggtgggaggntgcccagctgggggaccaccaagtcccgacaagccggtcctcctcaaaagggtccgaatgccgcgggggggctacccatccgggaagttttggccgggaaaaagggccggttcaaagggccccggaatagcccaaaccggcttttggggggaaaggaaatctccccgggggttgggggggagaaatagggagaggcggacaccgggggtaataaaaaaaggaaaaaaaaccccccccccccggggggaaaaaaaaggggggaaaaaaaattttttttttttccctctccaaaccccccca

SEQ ID NO: 27628 - DNA, 667 bp, Zea mays
  misc_feature: Ceres CLONE 1401046-F
  misc_feature (124)..(124): n is a, c, t, g, unknown, or other
  misc_feature (248)..(248): n is a, c, t, g, unknown, or other
  misc_feature (275)..(275): n is a, c, t, g, unknown, or other
  misc_feature (300)..(300): n is a, c, t, g, unknown, or other
  misc_feature (309)..(309): n is a, c, t, g, unknown, or other
  misc_feature (327)..(327): n is a, c, t, g, unknown, or other
  misc_feature (328)..(328): n is a, c, t, g, unknown, or other
  misc_feature (330)..(330): n is a, c, t, g, unknown, or other
  misc_feature (349)..(349): n is a, c, t, g, unknown, or other
  misc_feature (378)..(378): n is a, c, t, g, unknown, or other
  misc_feature (409)..(409): n is a, c, t, g, unknown, or other
ggagctccccgcggtggcggccgctctagaactagtggatcccccgggctgcaggaattcgcacgagaccattacctagaacatcctaatcaaaaaactcgcacggacgagcgaggcagccccngcaggtcgcagccacaacccaagcgcagcgatctacctccgctccggctcagctcccgccctgcctccgccttccattccgccgcgcggcgctgccgagtggcgacgtcgtcccccgccggagnttctgggttctgggttggatctctcgnagtcggagcgagcgaagatgggcgncgccaacgntgaaaccacccagctggnngnagcactgctggcgaagaangcgaggcgtaccgccctaggtgccccggnttgccggtggggacgctcacggggagcgggnaggggggccttccctccaagggaactcttcctaattggggttgaaaacaaaaccgggacccgggcgaatcaggtctgtggtcccccttttgggatttccgggaaaagggaactgcgaaattggtaaaaaaaaaaaaaaaaaatgggatttttagggggggggtcggggggcctcaaaaatagggggggggggcccccccccccaccagaggagggggaaagcgggcgtaacacacccgggaaccgaaccggctttttg

SEQ ID NO: 27629 - DNA, 684 bp, Zea mays
  misc_feature: Ceres CLONE 1401049-F
  misc_feature (382)..(382): n is a, c, t, g, unknown, or other
  misc_feature (442)..(442): n is a, c, t, g, unknown, or other
  misc_feature (443)..(443): n is a, c, t, g, unknown, or other
  misc_feature (637)..(637): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
tccccgcggtggcggccgctctagaactagtggatcccccgggctgcaggaattcgcacgagaccattacctagaacatcctaatccaaaaacaccaacccgttctgcctccgcttcgatcatggggtggtcgcgctttcgtcgccgccatcaacggtgtcgctatctcctccctatccggcgtccgcgatgctcgccacccctcctcccccacgcgtcggacgctcgccatgctcgcctccctcccctccggtccgcctcgctccccttccgcccttccgtcgcgtgcgcttggaaaaaggtccagcagccccaaactccccagcggggccatctcgcccacctctccctgcacgccggatccccgccgtcccaccatcgncctgtgttgggtccgacccagtccgctcatgcctcgacgcgcagttctcgcacacgtccnngcggcggcgtccgccctcgcgccggtctcgcacaccgtccccgcagcggatccaatcacgcctcctcaccctccgctgcctcctcccatcccctctcccatcgaatccgcgattccgcgtccacagggggatacccgtgagctcgcccccgcctccatggctccatcctccgctcgcgattccccgtgcccggntggaagggnnntcacggatcctcacacgggtcctgctgcactacccg

SEQ ID NO: 27630 - DNA, 696 bp, Zea mays
  misc_feature: Ceres CLONE 1401050-F
  misc_feature: Encodes the peptide sequence at SEQ ID NO. 27631
  misc_feature (349)..(349): n is a, c, t, g, unknown, or other
  misc_feature (350)..(350): n is a, c, t, g, unknown, or other
  misc_feature (466)..(466): n is a, c, t, g, unknown, or other
  misc_feature (657)..(657): n is a, c, t, g, unknown, or other
  misc_feature (696)..(696): n is a, c, t, g, unknown, or other
gctctagaactagtggatcccccgggctgcaggaattcgcacgagaccattacctagaacatcctaatcgaaaagctggtgcttctacggggcctggcgatttgaattcgagtggtgcgtgtatagagcgtgagagagagaaaagagagtggctcttgcgctctgcagtccagttcttgaatccagagctgcgattcgtgctcgcctgacgccgatgggccggagcctgagcccgctgctacggcaggagctggacaacctggacaaggacgctgacagccgccgcgccgccatgaaggcgctcaagtcgtacgccagacacctggactccaagtccatcccgcactcnnctcgccgaggtctccgacaccaccgcgggccggcgcccggcgcccggcagcggcatgcccacccggggcgggcgagttcaccatccgccctctaacgaggtggcttggcggccggnttgcacggcccgcaacatcggttgcccgcaggatcgggcaacatcatggcccaccattcatgtgcacgctctccccccccaggggggggctcccttcccgctccacaagctgtggttccaagggggggggcccggccttcgcgggggaagggaatccaccctccgcgcccgaagggggggaaaaaggccgnaattattgcccctccttctggaggccgctccgcaggggn

SEQ ID NO: 27631 - protein, 76 aa, Zea mays
  misc_feature: Ceres CLONE 1401050-F
  misc_feature (46)..(46): Xaa is any aa, unknown, or other
MGRSLSPLLRQELDNLDKDADSRRAAMKALKSYARHLDSKSIPHSXRRGLRHHRGPAPGARQRHAHPGRASSPSAL

SEQ ID NO: 27632 - DNA, 703 bp, Zea mays
  misc_feature: Ceres CLONE 1401051-F
  misc_feature: Translation starting site: 201
  misc_feature (336)..(336): n is a, c, t, g, unknown, or other
  misc_feature (337)..(337): n is a, c, t, g, unknown, or other
  misc_feature (350)..(350): n is a, c, t, g, unknown, or other
  misc_feature (351)..(351): n is a, c, t, g, unknown, or other
  misc_feature (374)..(374): n is a, c, t, g, unknown, or other
  misc_feature (375)..(375): n is a, c, t, g, unknown, or other
  misc_feature (393)..(393): n is a, c, t, g, unknown, or other
tccccgcggtggcggccgctctagaactagtggatcccccgggctgcaggaattcgcacgagaccattacctagaacatcctaatcgaaaagcggcttccgcatcctccgcttcgtgtcgtctgccctgctgcccaagcctccggaggttctaccggagccggctcactctcgcgacaccgccgcggcctccggctatatatggacggcgaggaggcgccccttggcgcgctcaacctggctgagtacgcccccgccggcgcccgcaccgtcgactggctacaggcgtatccgcaagatcggcgagggcacctacggtgaggtatttgagctgtgnnatatattactggnngaagagcagcacttagaaaatannactggatgatggcaaagnagggtttccacgccaaatcttgcgtgagataaactattaaaaaagctggatcatgagaacatcatcagattggaggagattgagtaatccccctggttctgccaagggaaaaaggggaatcaaatggtccattctaatgggggaaaatcccactgggggggttgaaaactggccccgggttttgaaaaaagtattgcccaaaaggcgcccctccccggccaagggttaatatggggcactctctaaaagattttcgacttgccccctgcccaaaaagtttctttctcggatattacagagggcctattct

SEQ ID NO: 27633 - DNA, 712 bp, Zea mays
  misc_feature: Ceres CLONE 1401053-F
  misc_feature: Encodes the peptide sequence at SEQ ID NO. 27634
  misc_feature (261)..(261): n is a, c, t, g, unknown, or other
tcagaactagtggatcccccgggctgcaggaattcgcacgagaccattacctagaacatcctaatcgaaaaacagcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcnggcggatcgggcgctacctcaagaaggggcggtacgcgcagcgcgtgggcaccggcgcccccgtctatctcgccgccgtgcttgagtactcccgccgccgaggtgcctggagcttgcccgggaaacgcgggggagggaaaacaagaaaaacggcgcatcgtcccggggaaaatttggctcccggggggattccgaaaccgaacgttgagagctcgacaaggttgggcgtgttggggggacaccatccggcgcagggggggggtgccccccccaaaatacaaccccgggttccccggggccaaaaaaggcggccagaaaaacgcgcccccgccccgcccccgaaatgtcagacaaggcccccaaaaaagccccccgggcccccccaaacaggggcgaccccccccaaaaaacgtaaaaaaaatgaaccttaccatcccccccggagtaaatc

SEQ ID NO: 27634 - protein, 189 aa, Zea mays
  misc_feature: Ceres CLONE 1401053-F
  misc_feature (40)..(40): Xaa is any aa, unknown, or other
MDASGAGSKAKKGAAGRKAGGPRKKSVSRSVKAGLQFPVXRIGRYLKKGRYAQRVGTGAPVYLAAVLEYSRRRGAWSLPGKRGGGKTRKTAHRPGENLAPGGIPKPNVESSTRLGVLGGHHPAQGGGAPPKIQPRVPRGQKRRPEKRAPAPPPKCQTRPPKKPPGPPQTGATPPKKRKKNEPYHPPRSK

SEQ ID NO: 27635 - DNA, 623 bp, Zea mays
  misc_feature: Ceres CLONE 1401058-F
  misc_feature (405)..(405): n is a, c, t, g, unknown, or other
aaagctggagctccccgcggtggcggccgctctagaactagtggatcccccgggctgcaggaattcgcacgagaccattacctagaacattctaatcgaaaagaagggaaaagcattccaacgctgcatctgcactgcacggtacttcctcctcctcatcctcctctatctctaagaatttaaaagagaagaagggggaagtcctcgactgctcgttccataaaccctaacctcgttggattcgcggcaaaaatcctcccaattcggaaccctccgatgttccagctacctgcgggagctgagccgtgctcggtttggcgaaattttgcacccctcttgtgctaggaccacccggttcaagctgttcctcggaaggatcaggtcttcaccggtgctctccggcgncggatccaggttggttcggcgagaggtcgggctcttggtgggggccagccagcttcgagctcaatttgccgcctgaaatggaatcgcgactgccggggccggtgccggggcctcaactaatccgcgtcgaggccaccccgcgatccctggccattggggggggccagccttttccgggaaatcccggggggggttttcccctcccggcggggcaaaaa

SEQ ID NO: 27636 - DNA, 768 bp, Zea mays
  misc_feature: Ceres CLONE 1401060-F
  misc_feature: Translation starting site: 171
  misc_feature (450)..(450): n is a, c, t, g, unknown, or other
  misc_feature (451)..(451): n is a, c, t, g, unknown, or other
  misc_feature (499)..(499): n is a, c, t, g, unknown, or other
  misc_feature (502)..(502): n is a, c, t, g, unknown, or other
  misc_feature (503)..(503): n is a, c, t, g, unknown, or other
  misc_feature (545)..(545): n is a, c, t, g, unknown, or other
  misc_feature (601)..(601): n is a, c, t, g, unknown, or other
  misc_feature (619)..(619): n is a, c, t, g, unknown, or other
aaagctggagctccccgcggtggcggccgctctagaactagtggatcccccgggctgcaggaattcgcacgagaccattacctagaacatcctaatcgaaaaacaacggtgtcctgcacttgcacccttatgccgtcgccgcggcggcagcggcattgatctcggcgtacatggtgtggttctgggcgctgacgcgacggctgtccgggccgcggatgtggcccctcgtcggcagcctgcccagcgtcgtcctgaaccgggcgcgggttcacgactggatcgtcgacaacctgcgctccaagggggaagcggccacgtaccagacgtgcatcttgccgctgccgttcttggcgcggcgccaggggctggtgaccgtcacgtgcaacccgcggaacctggagcacatcctggcgcgcgcgtttcgacaactaccccaagggccccatgtgnncaggcggcgttccacgatctcctaggccagggcatcttcaactccgancgnncgagacgtggctgctccagcgcaagacggcgggcgctcgagntcaccacgaggaccttgcggccaggcgaatggcgcgctgggccaaccgcatcatcnagtaccgggcctgtggangtatcctcgcagaacactgcgagggccgcggcgagcgtcgacctcccaggacctgctcttgcgcctcaccttcgacaacatctgcggcctcacccttcgggaaggacccgagacattgggccccccggggtttgcagggagaacccctt

SEQ ID NO: 27637 - DNA, 745 bp, Zea mays
  misc_feature: Ceres CLONE 1401063-F
  misc_feature: Encodes the peptide sequence at SEQ ID NO. 27638
  misc_feature (339)..(339): n is a, c, t, g, unknown, or other
  misc_feature (543)..(543): n is a, c, t, g, unknown, or other
  misc_feature (590)..(590): n is a, c, t, g, unknown, or other
  misc_feature (591)..(591): n is a, c, t, g, unknown, or other
  misc_feature (650)..(650): n is a, c, t, g, unknown, or other
tggagctccccgcggtggcggccgctctagaactagtggatcccccgggctgcaggaattcgcacgagaccattacctagaacatcctaatcgaaaaatccgaactccgaaaagccccccagcggcctcccctccgccccgcagccatggccgccaccggcgtggtcgccgagccgaagaccaagtacgatcgccagctcaggatatggggtgatcaaggccaggctgcactggagaaggctagcatatgcttgcttaactgtggtcctaccggaaccgaagcattgaagaatctcgtgcttggaggcataggaagtgtgactgttgttgatggctccnaagttgaatcatctgacctggggaacaattttctgttggatgaaggatgtttggggcaaccaagagctaaatctatatgttctttcctacaagagcttaatgacgctgttaaggccaagttttgttgaggagtctccagcgcatttgatagatactaatccttcattcttttcccagtttactgttgttattgctaccagcttnccagagagttttttactgaagctagattatatctgcaggaagaaatnnttcgttttggttgctgcacgttcttgggcctaaaaccgggttgggtcagggttagcgtnaagggagcattgtggtatagaatcaaaacagacaacttcttggatgatttgcgacttccaacccatgacgggaactaagcagttggcaatcattg

SEQ ID NO: 27638 - protein, 106 aa, Zea mays
  misc_feature: Ceres CLONE 1401063-F
  misc_feature (65)..(65): Xaa is any aa, unknown, or other
MAATGVVAEPKTKYDRQLRIWGDQGQAALEKASICLLNCGPTGTEALKNLVLGGIGSVTVVDGSXVESSDLGNNFLLDEGCLGQPRAKSICSFLQELNDAVKAKFC

SEQ ID NO: 27639 - DNA, 680 bp, Zea mays
  misc_feature: Ceres CLONE 1401066-F
  misc_feature: Encodes the peptide sequence at SEQ ID NO. 27640
ctccccgcggtggcggccgctctagaactagtggatcccccgggctgcaggaattcgcacgagaccattacctagaacatcctaatcgaaaaatccgactaaaaagggtcggggccagggccttcgcttgtttactactcctgattaccacattctatcttgtgtcttcacgtgcacacgaccctgcccccattgtctgctacgaccaagcacgagcggatcatcaccgcgtcgtcacaagcgactgtatagccgaggctcagcctgtcgctgagcagcctgactcaacctactctggactcggacctatgaaggcgttcaatgtgattgatgagttcaacggatggagaaaacagcctgatctgcctgaaggccgtggcagttatccaagctatggctgctgttattcccgccagcggagctaacaccatgatggagcttgagattgagctcaaaaagccttctgataccctcaagtcatgggacaaaacatcaatctccttgactgttgggggcaatctggtcatcagatacgtgacgagaacgtctgtttttggagacgaagatttcaattcagccaagtccccttccccttgaaggggctgaaaaatttggaaaaacctcttttcaaggctcgaagaactttccgaaaggttacggcgagattttctgatttggtg

SEQ ID NO: 27640 - protein, 88 aa, Zea mays
  misc_feature: Ceres CLONE 1401066-F
MSSTDGENSLICLKAVAVIQAMAAVIPASGANTMMELEIELKKPSDTLKSWDKTSISLTVGGNLVIRYVTRTSVFGDEDFNSAKSPSP

SEQ ID NO: 27641 - DNA, 735 bp, Zea mays
  misc_feature: Ceres CLONE 1401067-F
  misc_feature (449)..(449): n is a, c, t, g, unknown, or other
  misc_feature (483)..(483): n is a, c, t, g, unknown, or other
  misc_feature (575)..(575): n is a, c, t, g, unknown, or other
  misc_feature (596)..(596): n is a, c, t, g, unknown, or other
  misc_feature (615)..(615): n is a, c, t, g, unknown, or other
  misc_feature (619)..(619): n is a, c, t, g, unknown, or other
  misc_feature (630)..(630): n is a, c, t, g, unknown, or other
  misc_feature (675)..(675): n is a, c, t, g, unknown, or other
  misc_feature (679)..(679): n is a, c, t, g, unknown, or other
  misc_feature (718)..(718): n is a, c, t, g, unknown, or other
aagctggagctccccgcggtggcggccgctctagaactagtggatcccccgggctgcaggaattcgcacgagaccattacctagaacatcctaatcgaaaaaacgcctccaccacgaggcacgcaacaattagaacacatcttgccgccgccgaggacgacggcgatgatgtggcgttcgcgagctcgtgcgctgctcctactccgctcgaccattacccgggcaccgccaccacctccactatcctatcccactcgaaccctaacccgagtcccacctccccgcttcctgtcctcctccccggatcccatccccgattcctcctccgccgccgccgcggatcccttccctgaagccttctcctccccgaccaaggcttctcaagatgccgctgaggccggagaggaccacctgagctcgatgcgcgaggaagcttttacatccccacntctttgcctcccccgaaagaaaccccccttttgnagagttttttttttgttttttaagaaaaaaaaagggctttctccctcccccccccggggggggaaggtgttaaaaccccctcccctctttgngtggtaccccccccccacccnaaaaagaaaaaaagtgaanaagnaaaaaaagaanagaagaagaaagcggcgccccgccgcggcgccccccaacaaaaanaaanacaaacatttttcttttgggcgggggcggagcggggggntgtggtggtgtggtggg

SEQ ID NO: 27642 - DNA, 643 bp, Zea mays
  misc_feature: Ceres CLONE 1401069-F
  misc_feature: Encodes the peptide sequence at SEQ ID NO. 27643
  misc_feature (374)..(374): n is a, c, t, g, unknown, or other
  misc_feature (417)..(417): n is a, c, t, g, unknown, or other
ggagctccccgcggtggcggccgctctagaactagtggatcccccgggctgcaggaattcgcacgagaccattacctagaacatcctaatcgaaaaaaccacgatgctctgctcgaccaccgccgatatctatggtcggattaggttcgctgccctcttcgcctcagctgtttcccgaggtctccctgcggcgacggtcaccgtagtggactccggcctcccccacggcgaccgacaaaagggtgagagagtgcaagaacctacggtacaccggcctcacgaacagctccatcaacaatctctttgatctcatcacggaccaaggtacgggagacctacgcttcaccgcctttgccctctcctccagctagaanattgttcctgattccatcaataaccaaggtatgaacagttaanagctattgcaatatactactgcaacattcattgttttgtgccactttgcttatgtcagtaatttcgacagcgctctgcttatttagttgacactagttgatatgattgtgcttgccgtccataagtgagttctaaagactatcgatttcattgacgatatttaatcttatggactatttttatttggactattgctgcttttgtgattgcttatacctcattactg

SEQ ID NO: 27643 - protein, 67 aa, Zea mays
  misc_feature: Ceres CLONE 1401069-F
MLCSTTADIYGRIRFAALFASAVSRGLPAATVTVVDSGLPHGDRQKGERVQEPTVHRPHEQLHQQSL

SEQ ID NO: 27644 - DNA, 713 bp, Zea mays
  misc_feature: Ceres CLONE 1401071-F
  misc_feature: Encodes the peptide sequence at SEQ ID NO. 27645
  misc_feature (630)..(630): n is a, c, t, g, unknown, or other
  misc_feature (649)..(649): n is a, c, t, g, unknown, or other
aaagctggagctccccgcggtggcggccgctctagaactagtggatcccccgggctgcaggaattcgcacgagaccattacctagaacatcctaatcgaaaactgctcctctaccccttcctctcccggcgaccagctggcctctcctttgttgaggcgagagacccccacccgatccggcgatggacgccgcgtccaggccgcctccgccccacggagcaggggtccgcgtccgcgccccgctggtggagtctgtctcctgctactgcagattagatacaggccttaaaactgttgttgaggccaggaagtttgttcctggcgcgaaaatgtgcatgcaacctgaagtcaaacaaaacaagcgcaagtcaaggggctcaaaaaaggaaaggtgcaggactcaagcaccacttttacctgggcttcctgatgatcttgctattgcctgccttatacgagttcctcgacttgaacagcccaaactcaggatggtttgcaaaagatggaaccgtcttttgtctgggaattacttttactccttgcgtagaaaattggagtgcagaagaatgggtgtatgtctttaaaaggaccgtgaagggagatatcctggtatgcctttgatcactcacnagctatggaagcactcccnacagtcacagagatcagacattgggcttgggtggcccttctgagggtgcatcttgacttgttgg

SEQ ID NO: 27645 - protein, 133 aa, Zea mays
  misc_feature: Ceres CLONE 1401071-F
  misc_feature (76)..(123): Pfam Name: F-box Pfam Description: F-box domain
MDAASRPPPPHGAGVRVRAPLVESVSCYCRLDTGLKTVVEARKFVPGAKMCMQPEVKQNKRKSRGSKKERCRTQAPLLPGLPDDLAIACLIRVPRLEQPKLRMVCKRWNRLLSGNYFYSLRRKLECRRMGVCL

SEQ ID NO: 27646 - DNA, 675 bp, Zea mays
  misc_feature: Ceres CLONE 1401072-F
  misc_feature: SWISSPROT Homolog: EC 3.2.1.23 Beta-galactosidase
  misc_feature (434)..(434): n is a, c, t, g, unknown, or other
tctgaactagtggatcccccgggctgcaggaattcgcacgagaccattacctagaacatcaatcgaaaatcaaaattactatgtgtatcatggtggcacaaattttggtcgcactactggggggccattcattacaactagctacgactatgatgcaccaattgatgaatatggacttcggagatttccgaagtgggcacatctgagggaacttcacaaatctataagattgtgtgagcacaccctgctttatggaaatacaacgtttctttctctgggtcctaaacaagaggctgatatttacagtgatcagtctggaggctgtgttgcattcctggcaaatattgattcagccaatgacaaagttgtcactttccgtaacaggcaatatgatcttcctgcttggtcagttagtattcttcctgactgcaggnaatgtggtgttcaacactgcaaaggtgcaatctcaaacttcaatggtgaccatggttcccagaaagtttgcaagcatcaaaccctgagccgatgaagcatttttcagggagagaacctggggatttggggtaaaaaatgacttttggcccgggaatggtaatttgtgggaccatatttaatacggacaagggactccaccggactacctatgttacacaaacaagtttttaggggggggga

SEQ ID NO: 27647 - DNA, 651 bp, Zea mays
  misc_feature: Ceres CLONE 1401074-F
  misc_feature: Encodes the peptide sequence at SEQ ID NO. 27648
  misc_feature (147)..(147): n is a, c, t, g, unknown, or other
  misc_feature (245)..(245): n is a, c, t, g, unknown, or other
  misc_feature (246)..(246): n is a, c, t, g, unknown, or other
  misc_feature (260)..(260): n is a, c, t, g, unknown, or other
  misc_feature (339)..(339): n is a, c, t, g, unknown, or other
  misc_feature (340)..(340): n is a, c, t, g, unknown, or other
gctcagaactagtggatcccccgggctgcaggaattcgcacgagaccattacctaaacatcctaatcgaaaaaccaacccttgtagtctcagtcaatctgtagattgagactacgatgagcctgtcaccgctcgaacttcctcctcnccgccggccgcggctgcggctgctgctacggaggtgcccctcgccccgggcttccgcttcaccccaccgacgaggagctcgtctcctactacctccgnncgcgcgtcctcggncgccgcctccgcgtcgacgccatcgccgagatcgacctctaccgcctcgagccctgggacctcccctccctctcccggnnatcgagccgggacgcccagtggtacttcttccccgtttcaacgaaaggtccccggcgctggggcccggggacccttccggtcccccaaaaaaggacaaaccggggtttcgccggggggtatatggaaaaaccccgggaaaggaccccgcggggcccccccccgggcaagggcccttgcaaaaaaaaaaaaaatctcctttccaccccgggaggggggccctaaagggggagaggaccccacttggttttgccacagaacccccccccctccgtgcacaagtgacctccgagcttggggggcctccctgaat

SEQ ID NO: 27648 - protein, 33 aa, Zea mays
  misc_feature: Ceres CLONE 1401074-F
MEKPRERTPRGPPPGKGPCKKKKNLLSTPGGGP

SEQ ID NO: 27649 - DNA, 606 bp, Zea mays
  misc_feature: Ceres CLONE 1401076-F
  misc_feature: Encodes the peptide sequence at SEQ ID NO. 27650
  misc_feature (403)..(403): n is a, c, t, g, unknown, or other
cgcggtggcggccgctctagaactagtggatcccccgggctgcaggaattcgcacgagaccattacctagaacatcctaatcgaaaaagtgtgagagctcgattcgttgccgtccacttgtctcacggcctgtcgccatctccttcctggttttttcatccgaccatccccggctcctccgcgccgtcggcgacgactccatcgagtcactcggccgcagcaaccggcgaccatgtaccgagtcgcctccgggctcggcgccctcaagaggcatggggcaaatgctcaaatgatgaatgctgcaattaggtgtgccagcacaagtgttgcacagaggtcttccggtggcttgtggacctggttgactggtgcgcgttcaaatgaaatacctcctccagatttncacacttccgggagtgactattccctcctccgctgcctgacccatgtggaggctggcaaaaacagagtcacacactttccccaatggtgttaaaatagcctcttgagaattctgcggaatcatcctggttcgggtgggaatttaatggttgaattgggggggttccggaaaattgaaagcccccccgagaaaaaaaacggggg

SEQ ID NO: 27650 - protein, 87 aa, Zea mays
  misc_feature: Ceres CLONE 1401076-F
  misc_feature (57)..(57): Xaa is any aa, unknown, or other
MYRVASGLGALKRHGANAQMMNAAIRCASTSVAQRSSGGLWTWLTGARSNEIPPPDXHTSGSDYSLLRCLTHVEAGKNRVTHFPQWC

SEQ ID NO: 27651 - DNA, 693 bp, Zea mays
  misc_feature: Ceres CLONE 1401077-F
  misc_feature: Encodes the peptide sequence at SEQ ID NO. 27652
  misc_feature (516)..(516): n is a, c, t, g, unknown, or other
  misc_feature (517)..(517): n is a, c, t, g, unknown, or other
tggagctccccgcggtggcggccgctctagaactagtggatcccccgggctgcaggaattcgcacgagaccattacctagaacatcctaatcgaaaaagtctatcttctcggctcgcacacctcagacacagccaggcagcggagcgctcccccttcccctcgattctttcgcttccttctagaaccttccgctccctccgctgcaacagtaacactgagcttcctcctcctcccaccccgaagatgacgaccatggagaacgtgatcgtgctcgtgaaccgcatccagcgtgcctgcaccgtcctcggcgaccacggcggcggggacgccgccgcctccctccctaccctctgggaagcgctcccgacggtcgccgtcgtcggcggtcagaggtcgggaaaatcatcggtgctcgagagcatcgtggggcgagacttcctgcctcgaggatcagggatcgtgacgcgtaggccactcgtcctgcagctgcacagaacagaggccggggtgcaganntatggccgagtccttcacatgcctaagcgccgctcactgatttctctattgggggcggaagaaaatcagatgaaactgacaggttgactggaaagacaagcaaatatctcccgttccaatcatctcagcaatacccccccaatgtgccactttaaatttgattggactgcggccaa

SEQ ID NO: 27652 - protein, 119 aa, Zea mays
  misc_feature: Ceres CLONE 1401077-F
  misc_feature: SWISSPROT Homolog: EC 3.6.5.5 Dynamin GTPase
  misc_feature (91)..(91): Xaa is any aa, unknown, or other
MTTMENVIVLVNRIQRACTVLGDHGGGDAAASLPTLWEALPTVAVVGGQRSGKSSVLESIVGRDFLPRGSGIVTRRPLVLQLHRTEAGVQXYGRVLHMPKRRSLISLLGAEENQMKLTG

SEQ ID NO: 27653 - DNA, 746 bp, Zea mays
  misc_feature: Ceres CLONE 1401078-F
  misc_feature: Encodes the peptide sequence at SEQ ID NO. 27654
  misc_feature (238)..(238): n is a, c, t, g, unknown, or other
  misc_feature (244)..(244): n is a, c, t, g, unknown, or other
  misc_feature (313)..(313): n is a, c, t, g, unknown, or other
  misc_feature (343)..(343): n is a, c, t, g, unknown, or other
  misc_feature (392)..(392): n is a, c, t, g, unknown, or other
  misc_feature (393)..(393): n is a, c, t, g, unknown, or other
  misc_feature (420)..(420): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
tggagctccccgcggtggcggcccgctctaagaaactaagtggatcccccgggctgcaggaattcgcacgagaccattacctaagaacatcctaatcaaaaaaaacacacacgaacaccgcaccgcaacgtagccggctaggggaagagctctttccttcagctgtgccgtgcacaacgcacggcacgctggtttggtttgcatcgcccccgccaagaaagacgctgccgtgagcggnctgagncggcggaaagcagcagcaggcgggcgacatgccgagcggcagcgcgttctccgggtcggtgaacctcangcacgtcaagctggggtaccagtacctggntgaaccacttcctgacgctgctgctggggccggggatggcccgcacggnnctggagctggcccccctcggcccgggngaattgctctcgctggggggctcgctggagctggaactggtccacatcctctggtcggggttcctggccttcttctcggaaacggggacggtgaggccggccccaggccggggacctggtggaattaccctgttacaagcccccccgcaggtggcggggggcctttcccccctataggagaccccgcccctccatcaggaaaaagcataaataccggtggtgtatctgaaatgcgcgtgctggtcaacgtactgatgcaagaacatgtgtagcgtggcgcctgagtccggggnnnnnnnnnnnnnnnnnnnnngggnnnnnnnnnn

SEQ ID NO: 27654 - protein, 139 aa, Zea mays
  misc_feature: Ceres CLONE 1401078-F
  misc_feature (14)..(14): Xaa is any aa, unknown, or other
  misc_feature (24)..(24): Xaa is any aa, unknown, or other
  misc_feature (41)..(41): Xaa is any aa, unknown, or other
  misc_feature (50)..(50): Xaa is any aa, unknown, or other
MPSGSAFSGSVNLXHVKLGYQYLXEPLPDAAAGAGDGPHGXGAGPPRPGXIALAGGLAGAGTGPHPLVGVPGLLLGNGDGEAGPRPGTWWNYPVTSPPAGGGGPFPPIGDPAPPSGKSINTGGVSEMRVLVNVLMQEHV

SEQ ID NO: 27655 - DNA, 820 bp, Zea mays
  misc_feature: Ceres CLONE 1401079-F
  misc_feature: Encodes the peptide sequence at SEQ ID NO. 27656
  misc_feature (1)..(1): n is a, c, t, g, unknown, or other
  misc_feature (9)..(9): n is a, c, t, g, unknown, or other
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
ncccccccnttnttnnnntttttctctcttccactcttcgttccaacccaacactggggctccccgcggtggcggccggtctagaactagtggatcccccgggctgcaggaattcgcacgagaccattacctagaacatcctaatcgaaaaaacacctggctccgactccggccctagtgccctacttcccggtatcctaaaccctagccgacatgcgccgcccgcagcgccgcgtcgcggcgaagcagactcgcctgcgggaggtcgacgagatacgcctcctcaacgaatgtatcgacgccggcaagcccctcccgcgcaccaaacttctgcccccgtcgaaatcagctggaccggttccgaccgccggggagcacccggagtacggcgcgtgcacactgttcgacgagctgccgctgtcgcacaagaccaaggacgggctgcggcaaggcggcgatcaccgagaatgagtgagatccagccgcggtcgctctgcccaacgccgctggcggggaccagcgcaaatccttcgggagcgggacaaaaacccggcctccgtataaagaaccctttgacctagggcacaccccgtttcatctgcggaagtctgcttcagagtccgaggatggcctcaccataatgtcatgggacgagagccaagcgtttaaatccgcccccccaacaaatcggaccgcacacccggacaaagactattctccccatctcgtcacctcacccacccctccaatttctcctccccccatccacactcgcacgtgcaaaccgcggccgctgctaccacatgaccaccgcgcaccg

SEQ ID NO: 27656 - protein, 85 aa, Zea mays
  misc_feature: Ceres CLONE 1401079-F
MRRPQRRVAAKQTRLREVDEIRLLNECIDAGKPLPRTKLLPPSKSAGPVPTAGEHPEYGACTLFDELPLSHKTKDGLRQGGDHRE

SEQ ID NO: 27657 - DNA, 701 bp, Zea mays
  misc_feature: Ceres CLONE 1401084-F
  misc_feature: Encodes the peptide sequence at SEQ ID NO. 27658
  misc_feature (428)..(428): n is a, c, t, g, unknown, or other
  misc_feature (537)..(537): n is a, c, t, g, unknown, or other
  misc_feature (603)..(603): n is a, c, t, g, unknown, or other
tggagctccccgcggtggcggccgctctagaactagtggatcccccgggctgcaggaattcgcacgagaccattacctagaacatcctaatcgaaaaagtgatgatctcctcatcaacatctatctccatcacaagaagaaggtgtggacaggaagacgacacaagattcaggcgacactcccaccattgctgctgacggcgtccaaattgtcttctttctcccccctaccttggctggctggctctctagatcgaatcacgggtcaggcgctcccctgaccaaggccatgagccactacaccatgcatgcagccatcaactacgccgcgctgccacccacgtcgccgctgcaactccccctcccgtacctccctccgcctcctcctccgccgttacgtaccgccctttttttggtgcccgccggccnccaccgggcggcggcgtccttctgacgcgggatttccagaggaggatcaggccccagcgtccttctcatcattctggaatcttggccgtcattctccttcgtctccggnctgtggcaccttcctcgtccgggttcctggctccgcccgggcgcccgcggaatcccggggacgcgntacggggggtgaagcgaaacgctaccgcccttccaggggtcagctcccgcagctggtccaccttccccgacggcgggggtcgaacagtccttcatcga

SEQ ID NO: 27658 - protein, 54 aa, Zea mays
  misc_feature: Ceres CLONE 1401084-F
  misc_feature (47)..(47): Xaa is any aa, unknown, or other
MSHYTMHAAINYAALPPTSPLQLPLPYLPPPPPPPLRTALFLVPAGXHRAAASF

SEQ ID NO: 27659 - DNA, 684 bp, Zea mays
  misc_feature: Ceres CLONE 1401085-F
  misc_feature: Translation starting site: 296
  misc_feature (592)..(592): n is a, c, t, g, unknown, or other
aaagctggagctccccgcggtggcggccgctctagaactagtggatcccccgggctgcaggaattcgcacgagaccattacctagaacatcctaatcgaaaaaaaaccgaaaaggaggacaaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgatctccggcgaggtgccggacgagccggtcgtgtcgaagaagtcggggctactcttcgagcggcggctcatcgagcgctacattgaggaccatggcaagtgtcccgccaccaaggaggacctcaccatggatgatatcgtgccggtcaagaccaacacgatcgtgaagcccaggcctttgcaggctgcaagcattccaggactcccttgggatttttcagaacgagtgggatgctctcatgctttctaattttgctttggagcagcagcttcacacagcaagacnagaacttagtcatgcactctaccagcatggacgctggctgccgtgttatagccagattaaagaaggaaagagatgacgctagagcacttttg

SEQ ID NO: 27660 - DNA, 657 bp, Zea mays
  misc_feature: Ceres CLONE 1401088-F
  misc_feature: Encodes the peptide sequence at SEQ ID NO. 27661
  misc_feature (530)..(530): n is a, c, t, g, unknown, or other
  misc_feature (578)..(578): n is a, c, t, g, unknown, or other
  misc_feature (588)..(588): n is a, c, t, g, unknown, or other
  misc_feature (644)..(644): n is a, c, t, g, unknown, or other
gctctagaactagtggatcccccgggctgcaggaattcgcacgagaccattacctagaacatcctaatcaaaaacacgcgaaggcacctagcagccgccactcgccgaactgaggaacacgccgggcgacgggatacagcagcagcgcgcccctctatgcccgacgcgacggcgccctgcagctgcagataaacctgttccaatggccaaacaaaaagagggtgtggacaaaagaactgctaggaagatgatccgatctacggaaggctgtgcaaagagcattactttcgagaggaacaacaaatcagacgctgtgcagcttcacgatctgccgaatgacatcctaggtagcatactatcacggttgacattcagagaatcctcacagatgggccttgtttctcatacctggcggcggctggtggagaagctgttgccggaaactggtcttcaccagtgccaccatgttcccaacccggaaataggagcatcaaacatacaaggaccaactttgccatgagagtcaacangtttcttgcgtcagctacacactcatcctactctttaaataagttgtntaattaaaanttccgggcctggcgcagggaagcacacctcgccatgtcaaacaagatggattcgcnttcctgctcccgg

SEQ ID NO: 27661 - protein, 105 aa, Zea mays
  misc_feature: Ceres CLONE 1401088-F
  misc_feature (38)..(85): Pfam Name: F-box Pfam Description: F-box domain
MAKQKEGVDKRTARKMIRSTEGCAKSITFERNNKSDAVQLHDLPNDILGSILSRLTFRESSQMGLVSHTWRRLVEKLLPETGLHQCHHVPNPEIGASNIQGPTLP

SEQ ID NO: 27662 - DNA, 762 bp, Zea mays
  misc_feature: Ceres CLONE 1401089-F
  misc_feature (365)..(365): n is a, c, t, g, unknown, or other
tggagctccccgcggtggcggccgctctagaactagtggatcccccgggctgcaggaattcgcacgagaccattacctagaacatcctaatcgaaaaattcccctcgcgttcactcgcgtagagtcggtcggcgaattcccctgccgagaacagtacattcgggcacctctcgccccctcgctctacgacgactagtgggccgccggcgctggtgccgccttacgccaggcgccgagggcttcttgatctcttcagcggtgatgagcactcctagctgggacaacgatctacagccacacatatcatgactatgattgatgacctctctacccgactgctacagattgacgaaccgaacaatganatattcatctgcgccttaagctcatcaaaaaaccttctacaattgcccgggaatgggggggaaaaaaaacaaggaaaaactgttccatttcccagggaaaccacctttttgaaaaggaggggttttctgaaaagcaaaaaaggggggttttttttcttttggggggggcaaaaaacttgtcctttttttctttcccaccgggaaaattggtgggggggggaacccccgccaaaaaaaggggtggtaatcctttttggggagggcccccccccgggcaaaaaaatgttgggccccggtccccccccccttaaaggagggggggcggggggggggcaaaaccggggttttttggggggttttttttaacccccacacaggggggggggagagagagaaa

SEQ ID NO: 27663 - DNA, 833 bp, Zea mays
  misc_feature: Ceres CLONE 1401091-F
  misc_feature: Encodes the peptide sequence at SEQ ID NO. 27664
  misc_feature (17)..(17): n is a, c, t, g, unknown, or other
  misc_feature (18)..(18): n is a, c, t, g, unknown, or other
  misc_feature (43)..(43): n is a, c, t, g, unknown, or other
  misc_feature (45)..(45): n is a, c, t, g, unknown, or other
  misc_feature (371)..(371): n is a, c, t, g, unknown, or other
  misc_feature (409)..(409): n is a, c, t, g, unknown, or other
  misc_feature (410)..(410): n is a, c, t, g, unknown, or other
  misc_feature (833)..(833): n is a, c, t, g, unknown, or other
tttccccccccctcccnncccccacttaatattaagaccacancncccaaaactggagctccccgcggtggcggccgctctagaactagtggatcccccgggctgcaggaattcgcacgagaccattacctagaacatcctaatcgaaaaaccattccgccgttcccaccacgccactcgccagttcgtcactccctcctgtctccccccttgccgagacggcgcggacgccccgtcgcccaccccgatggcttccactctcctccacgccgccaccgcctcgctccagagctcctcccagcccgcacgcgcgggcgccgccaccgcctttcaccccctcgcgtccaccccatccatacgcctcgcgcgcntcctcgttctcgtcaatcgcccggcctcgaggtttcannctccgggcggtttcggccggaaacccgggtttcgggggggggagggaagccacccccgggggcccgcccgcgtcgtcgcacggccctaagcaggggagccaaaaactggaggggctttccagaaggtgggggccggatggaccaaggaactaaccagcaaacggggagagaataaagggccccgaaggaggcctcaagaaaaacctttggaaaaggtacctggtgctggacacactttcacagggctggaaggccctggggggaatgggaggtccctgggacaaagggcagcgcgctaaaggaatggttaacccaagaagagtacaacaagaacaggctcccccgccggcaaacattcgccggacggaatctcggaaacccctcggtcctcctacaccctatacctcccaaaactaaataacn

SEQ ID NO: 27664 - protein, 83 aa, Zea mays
  misc_feature: Ceres CLONE 1401091-F
  misc_feature (42)..(42): Xaa is any aa, unknown, or other
  misc_feature (54)..(54): Xaa is any aa, unknown, or other
  misc_feature (55)..(55): Xaa is any aa, unknown, or other
MASTLLHAATASLQSSSQPARAGAATAFHPLASTPSIRLARXLVLVNRPASRFXXPGGFGRKPGFRGGEGSHPRGPARVVARP

SEQ ID NO: 27665 - DNA, 737 bp, Zea mays
  misc_feature: Ceres CLONE 1401096-F
  misc_feature: Encodes the peptide sequence at SEQ ID NO. 27666
  misc_feature (337)..(337): n is a, c, t, g, unknown, or other
  misc_feature (503)..(503): n is a, c, t, g, unknown, or other
tccccgcggtggcggccgctctagaactagtggatcccccgggctgcaggaattcgcacgagaccattacctagaacatcctaatcgaaaagaaacccactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggcaacagccggccccgccgccgcaggngctccgctctacctctccctctccgcccggtggccgcgcactctgctcggattgctggtgagatgcccaaagcctttgtgatcttagatgatgttgtgcaacacacccttactaatttgcacagtattcacaaaagcttactattttggcaggccaaggctgaggnaacaaattctcagaaagtgtactttatgatatttgagagaggtccaagggcccttgttgatgaacatatcaaacactcactagactcgggagcaatggacgccctgtccatacattttgcattctggcatctgatatggtgtcaacaaactcgctgccctgacagtatgcacactgcttggcgcttttctgcagagtttcatctgaagtgataatggcgggaagattactgaaa

SEQ ID NO: 27666 - protein, 194 aa, Zea mays
  misc_feature: Ceres CLONE 1401096-F
  misc_feature (70)..(70): Xaa is any aa, unknown, or other
  misc_feature (125)..(125): Xaa is any aa, unknown, or other
MATSPPQNPSSGEPSDASSLAAAALEAPVRVWRSLVARFPPLPDSSSFLAGVSDLQLRYFGNSRPRRRRXSALPLPLRPVAAHSARIAGEMPKAFVILDDVVQHTLTNLHSIHKSLLFWQAKAEXTNSQKVYFMIFERGPRALVDEHIKHSLDSGAMDALSIHFAFWHLIWCQQTRCPDSMHTAWRFSAEFHLK

SEQ ID NO: 27667 - DNA, 755 bp, Zea mays
  misc_feature: Ceres CLONE 1401097-F
  misc_feature (205)..(205): n is a, c, t, g, unknown, or other
  misc_feature (206)..(206): n is a, c, t, g, unknown, or other
  misc_feature (216)..(216): n is a, c, t, g, unknown, or other
  misc_feature (403)..(403): n is a, c, t, g, unknown, or other
  misc_feature (730)..(730): n is a, c, t, g, unknown, or other
  misc_feature (731)..(731): n is a, c, t, g, unknown, or other
tggagctccccgcggtggcggccgctctagaactagtggatcccccgggctgcaggaattcgcacgagaccattacctagaacatcctaatcgaaaacgagccagtggtactggccgcgacggagcggtcagaagctgcggcggccggcgcggtttcggtttcggtttcctggctggcccgaggagtttgactcctctcctgatnntgtgaagtgnagaaataagatacacagtggaagatgagatcagttgttcggtcacttcgccagcttcgccgtttcactcagcaccatgcagaggggcactcacaagcaaccagattgttcgggcagcagaacgctttaatcatgtgcggttcgacatctggttcactgagcacgttacgttgtaatggtgaaattancagattttgcagccctggcgtcgaggtgatgaggtccatgttctctactgtaggggctgatcccgatcaaagatattgggaagaggtggtcccatgggtggaatatgaaaggagaatagcatcgggagagctagtagacggggataggttttcagggttgatacatttcaacattacaaaggttctatggaggagttgattgaaaatgaaaaagactgtcacctgaataaatataatctcctgaaaattcaagcccgagtccaatgggttatggcccccctcaatactccgcgctctacgaggggcccctatagggcttaccccccnnagggggggggggtggcaaaaggaa

SEQ ID NO: 27668 - DNA, 715 bp, Zea mays
  misc_feature: Ceres CLONE 1401099-F
  misc_feature (271)..(271): n is a, c, t, g, unknown, or other
  misc_feature (344)..(344): n is a, c, t, g, unknown, or other
  misc_feature (357)..(357): n is a, c, t, g, unknown, or other
  misc_feature (386)..(386): n is a, c, t, g, unknown, or other
  misc_feature (468)..(468): n is a, c, t, g, unknown, or other
  misc_feature (634)..(634): n is a, c, t, g, unknown, or other
ggagctccccgcggtggcggccgctctagaactagtggatcccccgggctgcaggaattcgcacgagaccattacctagaacatcctaatcgaaaaagccgccacctcaccccccccatcggccgcctgcgtcccaccacccgctcctgctgccgggcctgccgcccgttgctctcgccactgaagccctcgccgccgcctccgcctccgcccgcttgcttgccctcctgccggctgcctcccggatgagaagcggcgcaacctgggcagncggaagcgtggtcggcctggagccttcgccggggtttctggccgagaaggatcctggagattaagcgcatggntttccttggaggnccgggtacagggcccggccgggggcagcntgaggacacagccttaagagaaggacccaaaaaaagcaaagtttttcaaagaggttgaaaaaatttggaatgtttttgtgcntgggaagaaaaagtcctgggtttggcaaggttccgatcgaatgcaactttttctctttcgctatcatgggctgcttgcattttctaacaatcctatacacaacattcctgtgaatgaacaatcagttgcagtcaagctctcggtttggcaatggggtggatatggnaataaagaggagttttgatccccgaaatgtatcctcctgctaacatcaaatgggaagatgtatataaaagtacccaaaatc

SEQ ID NO: 27669 - DNA, 684 bp, Zea mays
  misc_feature: Ceres CLONE 1401100-F
  misc_feature: Encodes the peptide sequence at SEQ ID NO. 27670
  misc_feature (308)..(308): n is a, c, t, g, unknown, or other
  misc_feature (355)..(355): n is a, c, t, g, unknown, or other
  misc_feature (364)..(364): n is a, c, t, g, unknown, or other
  misc_feature (385)..(385): n is a, c, t, g, unknown, or other
  misc_feature (412)..(412): n is a, c, t, g, unknown, or other
  misc_feature (440)..(440): n is a, c, t, g, unknown, or other
tccccgcggtggcggccgctctagaactagtggatcccccgggctgcaggaattcgcacgagaccattacctagaacatcctaatcaaaagaaaacacaccatctccacctcgccgccgccgctcggatttccctctacctcaccctgtccgccgtcaaggagcagcaaggccaaggccgccgcggcgtcggcggccgtggtcgtggacgacatagccgagctgcaggggatgctagagcgcctgcggctggagaaggagaaggcggaggagatggttagggagcgggatgaggtcatccggaagaanggagaggagatcgagaccagagacaaggagcaggagcgtctccaggncgagctcangaaagcgcaacgcgccaaggnaagtcagcctaccgtgagcttcccccntcgtcagtcgttgctggagaaagagcangaaccagacgacaggggaaagaaaagaaagggaagggccggccacaaaaggaaaaaaccgggcccccgggaaagttgctttgcctcagggaccagtgggcccgaggtaaaaaaagaaaaccttggggccgattttaggggggggggcccaaaccctggggcccaaagtgaaagtccctggggcccaagaaaaaccccccttggagaatccacaccccggagaaagggggcccctgggggggggg

SEQ ID NO: 27670 - protein, 151 aa, Zea mays
  misc_feature: Ceres CLONE 1401100-F
  misc_feature (26)..(26): Xaa is any aa, unknown, or other
  misc_feature (42)..(42): Xaa is any aa, unknown, or other
  misc_feature (45)..(45): Xaa is any aa, unknown, or other
  misc_feature (52)..(52): Xaa is any aa, unknown, or other
  misc_feature (61)..(61): Xaa is any aa, unknown, or other
  misc_feature (70)..(70): Xaa is any aa, unknown, or other
MLERLRLEKEKAEEMVRERDEVIRKXGEEIETRDKEQERLQXELXKAQRAKXSQPTVSFPXRQSLLEKEXEPDDRGKKRKGRAGHKRKKPGPRESCFASGTSGPEVKKENLGADFRGGGPNPGAQSESPWGPRKTPLGESTPRRKGAPGGG

SEQ ID NO: 27671 - DNA, 673 bp, Zea mays
  misc_feature: Ceres CLONE 1401101-F
  misc_feature: Encodes the peptide sequence at SEQ ID NO. 27672
  misc_feature (378)..(378): n is a, c, t, g, unknown, or other
  misc_feature (393)..(393): n is a, c, t, g, unknown, or other
  misc_feature (394)..(394): n is a, c, t, g, unknown, or other
  misc_feature (413)..(413): n is a, c, t, g, unknown, or other
  misc_feature (414)..(414): n is a, c, t, g, unknown, or other
  misc_feature (535)..(535): n is a, c, t, g, unknown, or other
tccccgcggtggcggccgctctagaactagtggatcccccgggctgcaggaattcgcacgagaccattacctagaacatcctaatcgaaaaatgtgtttgtgactttgtgctcgtcctcatacccccaccccccagctcccgtctcctcgtgctctccactgctgcatgcgcctcttgtcctgtccccctccccaccttgttcctcccatcccgcgccgtctctgcacgaagcagagcgccggtccaccgacaaggacagctacaactacgacgcgcaggcagagccatcgctcatctggggctgccctcggttactcctcccctccgccgctgcccctgccttgtccacagctgttgttaattccttcatgagttgncgtcggcgccagcgnngcgaaggagaaagaagcgnngcttcagcttcccccggcgccggccgccgcctgaagatccttcttctcctgtagtcctgtcgtcgggcgggcgaggtcaagcatcatggggctcttaggtatgatgggcgactcttttggntgctcggcgactgggaagcgacttgtgtctgctgcaagagatgagaacatccaggaggccaaggctctcttagactcatcccgccctgtcgggactcccgggttggggaaaaccggaattcccctctcaatactcgga

SEQ ID NO: 27672 - protein, 58 aa, Zea mays
  misc_feature: Ceres CLONE 1401101-F
MGLLGMMGDSFGCSATGKRLVSAARDENIQEAKALLDSSRPVGTPGLGKTGIPLSILG

SEQ ID NO: 27673 - DNA, 705 bp, Zea mays
  misc_feature: Ceres CLONE 1401104-F
  misc_feature: Encodes the peptide sequence at SEQ ID NO. 27674
  misc_feature (356)..(356): n is a, c, t, g, unknown, or other
  misc_feature (381)..(381): n is a, c, t, g, unknown, or other
  misc_feature (396)..(396): n is a, c, t, g, unknown, or other
  misc_feature (463)..(463): n is a, c, t, g, unknown, or other
ggagctccccgcggtggcggccgctctagaactagtggatcccccgggctgcaggaattcgcacgagaccattacctagaacatcctaatcgaaaaaagtctggccaggtctctcccatatcgggttctcccttcctcttcctgtttccgcgcgcgagatcgccgccccgggtgggctctagatcccgatggcctcgcgccgccgcaccctgctcaaggtcatcatcctcggcgacagcggggttgggaagacgtctttgatgaaccaatatgtgaacaagaagttcagcaaccagtacaaggctacgattgggggcggatttcctcaccaagggaggggtgcagttcgaggacanggctcttcactctgcaaatatgggnacactgctgggtcangaaaggggtttcagaggtcttggcgttgcattctaccggggaggcaaaaattgtttgtgtcctaaancctaatgatggttaattcctatggaaaatcgttttgataatccttcacaactgggcggtggaagagttttctaaattcaggggagggcccatcagatcctgacattttcccctttttggttctggtggggtaccaaaagtggatggtaaaaaggtgggaacagccccggggggggggcggaaaaaaaaggcaaaggcatgggtgggccctcttaagggaacatcccgtaactttggaacgtc

SEQ ID NO: 27674 - protein, 90 aa, Zea mays
  misc_feature: Ceres CLONE 1401104-F
  misc_feature (56)..(56): Xaa is any aa, unknown, or other
  misc_feature (65)..(65): Xaa is any aa, unknown, or other
  misc_feature (70)..(70): Xaa is any aa, unknown, or other
MASRRRTLLKVIILGDSGVGKTSLMNQYVNKKFSNQYKATIGGGFPHQGRGAVRGXGSSLCKYGXTAGSXKGFQRSWRCILPGRQKLFVS

SEQ ID NO: 27675 - DNA, 664 bp, Zea mays
  misc_feature: Ceres CLONE 1401105-F
  misc_feature: Encodes the peptide sequence at SEQ ID NO. 27676
  misc_feature (347)..(347): n is a, c, t, g, unknown, or other
  misc_feature (375)..(375): n is a, c, t, g, unknown, or other
  misc_feature (376)..(376): n is a, c, t, g, unknown, or other
  misc_feature (448)..(448): n is a, c, t, g, unknown, or other
  misc_feature (467)..(467): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (491)..(491): n is a, c, t, g, unknown, or other
  misc_feature (492)..(492): n is a, c, t, g, unknown, or other
  misc_feature (617)..(617): n is a, c, t, g, unknown, or other
  misc_feature (664)..(664): n is a, c, t, g, unknown, or other
ccccgcggtggcggccgctctagaactagtggatcccccgggctgcaggaattcgcacgagaccattacctagaacatcctaatcgaaaaatctcctttctctctctacacatactcagacgagcagaagcagctagggacaccataggcaaactacttcagcaagaaattaaactatctcctacgcaagatcagaagaaactgtgtatggagcaagaagaggttggcctcgccctgggcctctccctcggctccggccaccaccaccaggagctcaagccccaacatccgtcgcatccgtggtgcgggcgttgttggagccttctctgtcgctcagcggcccgggnaccaaaggatgatggccgaccgcccggnnggggaggaggttcgctgccgtggaagagggagctgcagaccgatggaggggaacgacgacgaggccaccggnaagggtattgctactcccnggggggggcgcccccnnnnnnggnntacgggccgccgacgaccgagggggggcacagaagccgggaagaagctggggctggcccaaggagcagcccggcgcctgctggaaggaccacttcaagggagcaccacaccccctcaaccctaanaagaagggtggttttgggccaaacaactggaacctgagcccaagggn

SEQ ID NO: 27676 - protein, 148 aa, Zea mays
  misc_feature: Ceres CLONE 1401105-F
  misc_feature (47)..(47): Xaa is any aa, unknown, or other
  misc_feature (57)..(57): Xaa is any aa, unknown, or other
  misc_feature (81)..(81): Xaa is any aa, unknown, or other
  misc_feature (87)..(87): Xaa is any aa, unknown, or other
  misc_feature (93)..(93): Xaa is any aa, unknown, or other
  misc_feature (94)..(94): Xaa is any aa, unknown, or other
  misc_feature (95)..(95): Xaa is any aa, unknown, or other
  misc_feature (137)..(137): Xaa is any aa, unknown, or other
MEQEEVGLALGLSLGSGHHHQELKPQHPSHPWCGRCWSLLCRSAARXPKDDGRPPGXGGGSLPWKRELQTDGGERRRGHRXGYCYSXGGAPPXXXYGPPTTEGGHRSREEAGAGPRSSPAPAGRTTSREHHTPSTLXRRVVLGQTTGT

SEQ ID NO: 27677 - DNA, 631 bp, Zea mays
  misc_feature: Ceres CLONE 1401108-F
ccccgcggtggcggccgctctagaactagtggatcccccgggctgcaggaattcgcacgagaccattacctagaacatcctaatcgaaaactacatgccaaatctggaggcaagagaaccgggagagggcgtgttgggttgctcgtcgtgatcccggacggcaatacctgcccttgcctacttgccactgcttgcgtacactgatgtccttgttcaatcccctctagaaagtagaaacattgcttaattggcttggctattgctgttagctccacacaaaagagagaaccggcggcgagctaggagctagccatggacgacaccggcgcggtctcaccggtggagcgtgctaagcgggggccggcggctgtgctgcttcctggtgttgggggccccaaggggcttgaaagggcccctgggggggcgccccccgcccctgaaaccctggcctttaaggcccaagagcccttgagggccccccccgaccccccccccccctcgggggaacccctttttaaaggaaacactccccccccccggggggaccccttggaaaagacccctccccaccgggggagacgggcaacaaccgtattcctctcctcctcgcgatcgcgcttttttctttatg

SEQ ID NO: 27678 - DNA, 672 bp, Zea mays
  misc_feature: Ceres CLONE 1401112-F
  misc_feature: Encodes the peptide sequence at SEQ ID NO. 27679
  misc_feature (223)..(223): n is a, c, t, g, unknown, or other
  misc_feature (224)..(224): n is a, c, t, g, unknown, or other
  misc_feature (231)..(231): n is a, c, t, g, unknown, or other
  misc_feature (263)..(263): n is a, c, t, g, unknown, or other
  misc_feature (447)..(447): n is a, c, t, g, unknown, or other
ggagctccccgcggtggcggccgctctagaatagtggatcccccgggctgcaggaattcgcacgagaccattacctagaacatcctaatcgaaaactccctccctcctccattggactgcttgctccctgttgaccattgggtattctgaaccatcgagccatggctgccaagctgactcgcctccacagtcttcgcgaacgccttggtgccaccttctcctnnccatccnatgaactgatagcactcttttcccagttatgntcacccagggcaaggaaatgcttcagcgccatcagctgctttggggagtttgatggccctgtttgatagtgacaaaggaaaagtatgcaccctttgagacacatccttcgtgctggctcagaaaagcattgtgctccccccccaggggtttgcacttgctatcaggcaaaaggccttggggggntgggaaataaatttccggggaaaagaaaaaaaacttgcttgggaaaaaaacaaaaaagttttttaaagaactttggattaaaggaaaaaattgggggggtgtgaaactccaaagcgaacctttgggttgggagtggtgatttttagccccttaagggcccctttccccgcttcccgggggggaaaaaccccagaaagagggggggatttctttacccaaaccttg

SEQ ID NO: 27679 - protein, 55 aa, Zea mays
  misc_feature: Ceres CLONE 1401112-F
  misc_feature: SWISSPROT Homolog: EC 2.4.1.13 Sucrose synthase
  misc_feature (21)..(21): Xaa is any aa, unknown, or other
  misc_feature (24)..(24): Xaa is any aa, unknown, or other
  misc_feature (34)..(34): Xaa is any aa, unknown, or other
MAAKLTRLHSLRERLGATFSXPSXELIALFSQLXSPRARKCFSAISCFGEFDGPV

SEQ ID NO: 27680 - DNA, 602 bp, Zea mays
  misc_feature: Ceres CLONE 1401113-F
  misc_feature (74)..(74): n is a, c, t, g, unknown, or other
  misc_feature (116)..(116): n is a, c, t, g, unknown, or other
  misc_feature (200)..(200): n is a, c, t, g, unknown, or other
  misc_feature (201)..(201): n is a, c, t, g, unknown, or other
  misc_feature (223)..(223): n is a, c, t, g, unknown, or other
  misc_feature (227)..(227): n is a, c, t, g, unknown, or other
  misc_feature (229)..(229): n is a, c, t, g, unknown, or other
  misc_feature (486)..(486): n is a, c, t, g, unknown, or other
  misc_feature (528)..(528): n is a, c, t, g, unknown, or other
  misc_feature (553)..(553): n is a, c, t, g, unknown, or other
  misc_feature (557)..(557): n is a, c, t, g, unknown, or other
cgctctagaactagtggatcccccgggctgcaggaattcgcacgagaccattacctagaacatcctaatcgaanaagctagccaagctataccactagaaccagagcacaactcanagcaatgccgccgcctcctcctcctccgccccactcccacgcttcccatcccgcgccgcatggacgcgagcagcactagcgcgnnggcacacagcacggcgagcggncggngncgcgacatgaaccggggcgggtccggtggtgatggacgcgggcgcctcgaagctggcctgctccggggcggatctagcaggctgctcaggacgggcgggggcaatggggggggggggagacaaccaagggggggcgggcgcaaggtccaacaacccagaaggggaaagggcccgcttttccccgggaaaagtgggctcccccccagggggggggggggggcgcttccgggggggtctcggaaaacccgcgcacgggnggggaaaaaagtccccttttccgggggccggggagcgaggcnagggttgtggggcgcttcctccccngttntgttttgtaggggggggggttatggggggtgagtatgaaggcccg

SEQ ID NO: 27681 - DNA, 667 bp, Zea mays
  misc_feature: Ceres CLONE 1401116-F
  misc_feature (191)..(191): n is a, c, t, g, unknown, or other
  misc_feature (667)..(667): n is a, c, t, g, unknown, or other
aagctggagctcaccgcggtggcggccgctctagaactagtggatcccccgggctgcaggaattcgcacgagaccattacctagaacatcctaatcgaaaaaccacacacagaccatggtgatggaagagacgatagacgacagtgagatgagtttgtccgacatggtgctgggcttccctgaagatttcnagagggaccagcggccgcccggaaaccgacgacgaacaccacgaggaaagagggctcccggcggcggccaaccccggccaaaaaacaaggcccttctgggcaaaacccaaccctttgcaagctgccccaaaggcacttggccccagggccacccccccaccccaaaaaacaaggaatccccccgcccggaacccccgggagggaaggccccccaaaaaaaaattgggcccgccccggggtcttttttccttttttctctggaagggggggggccccccccccccccccgaaatttccccccccctttttttttctccccgagccattcccccccacacgttttgtggcaaaccccccctttaaaaaaaaaggacggcttctttaaaaaaacccaaaagggcccccctcccccccccaaaatccccctcccgcgggggaaaacacaatttcttgtggggggggggggcgcccccaan

SEQ ID NO: 27682 - DNA, 688 bp, Zea mays
  misc_feature: Ceres CLONE 1401118-F
  misc_feature: Translation starting site: 128
  misc_feature: SWISSPROT Homolog: EC 3.2.1.4 Cellulase
  misc_feature (251)..(251): n is a, c, t, g, unknown, or other
  misc_feature (282)..(282): n is a, c, t, g, unknown, or other
  misc_feature (290)..(290): n is a, c, t, g, unknown, or other
  misc_feature (343)..(343): n is a, c, t, g, unknown, or other
aaagctggagctccccgcggtggcggccgctctagaactagtggatcccccgggctgcaggaattcgcacgagaccattacctaaaacatcctaatcgaaaaatcacaagcaatcgatagagctagcatggcggtgaaggtgtgggtgttccccgtggctctgatgatgtgcgctggtgtacggcttggagctgacgacgacgggggcagcccgcttattagccgctgtcgtctgagctcgccaactaccngcgggccctggaaaagccatcctcctcttcnaggggcancggtcgggggcgctggcggcaaccagagagtcaggtgggcgcggggactcggngctcaccgacggccaacccgaaacgtggacttgacgggtggctactacgacgccgaagacaacgtcaaggtcggtttcccgatgggttcagcgtcccctcctgagctggaccccctcaatacccccacgaaggggcgggcggggttcaattcccccacctccggcccccctccaggggggggcccatttctttctcggggccaaaacagggcaaacacccttttaaaatagggtgggggacggaaacccccaccaccaaggtgtggaagcggccaaaggacttgaacccgccggggaacgttgaaaaaaatcccccggagtcccccggatccgagccccgggggg

SEQ ID NO: 27683 - DNA, 676 bp, Zea mays
  misc_feature: Ceres CLONE 1401119-F
  misc_feature (595)..(595): n is a, c, t, g, unknown, or other
aaagctggagctcaccgcggtggcggccgctctagaactagtggatcccccgggctgcaggaattcgcacgagaccattacctagaacatcctaatcgaaaaaaggcttcgttctgctctccggctctcccgcatccaccccgtctcatccccaatccgaccacctcatccctcgcctccatggccctacccctcgcgtcaccggcgggggcatgagccggtgactgctcacgcggcctcgtctgtctgcgcacgcgcgcggggtccggcgagtgagcattgccggcggtccgcgaatcggcccgtggggggacaattgggggttccgggggcggggggtccccccccggggggggcccccggccggggggtctctgggggggttttaaaaaaacccaactttttaaaaagcccccccgggggggggggggccaaaaacatcgccttttattaaaaaaaaaaaaaaacactcccccccccccccccgcgggggagggggaaaaaaaaaaaaaccccccgcgggggggggaaaaaaaaacccccccccccccccccccccccaaaaaacaagaggagggaagggggggggggggtntatttattaataatttaaaaaaaaaaaaaaaaagtggggggggggggggggcggggtccccccccctccaaaaaaaaaaga

SEQ ID NO: 27684 - DNA, 694 bp, Zea mays
  misc_feature: Ceres CLONE 1401120-F
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (625)..(625): n is a, c, t, g, unknown, or other
aaagctggagctccccgcggtggcggccgctctagaactagtggatcccccgggctgcaggaattcgcacgagaccattacctagaacatcctaatcgaaaaaacaaaaaccaacgctccccctgcccccctctttcctccccagacccgcgctcccctccgtggcgtgcaacgcgttcctcggctcctgcaggcggcgacctcggaaaggcgggggcgtctcgtcgcgaggcatttgaggccaggattttttggtgctctcattgttagctgactggtgagggtctggatctagcaatggcggaaacacccacggtagtggtcgccacgtgcttggggacttgacaaatgttatttgcaggcgagcagccacatcagatctggagaggaggacaggtggggataaagaaccaaccgatttgaaaaaaactggggactcttgggaaaaaggaggccccctgcggtcctatggaagacaacaacaaccaccccccttcttgtggtgggcggaaaaaaaaaacaacattctcttcccccccccccccccccctctccgttgccggaggggggcgcgccgcgccccccgccaacggaacaaagaaaagcaacacgcgctatcnnntcnaagaaccgtactttttcttctttcgtctctctaaagagaaacgaaagaagcgaggccggtgccgcggcg

SEQ ID NO: 27685 - DNA, 624 bp, Zea mays
  misc_feature: Ceres CLONE 1401121-F
  misc_feature: Encodes the peptide sequence at SEQ ID NO. 27686
tggcggccgctctagaactagtggatcccccgggctgcaggaattcgcacgagaccattacctagaacatcctaaaaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgccctcttcgcgcccccgatcgcccgattccttcaggaccaaagtacagatgctccagtgtttaccagcagagtttctcgtacgtaccggcaaaatcattgacagttccagatcaccgaggtgatgtgtgtcctttgaaaatgaatgagtatggcccctgccctgatggaagctatataagcagtttgaagagcctggtacctctagggatgaggatcttgaaaggatttcgccccatgggaaaaacgggtggttttattttgggccccctccaatggctacagatacccataagatggccacaagccgagactacggatgggggtaccaagggcacccttcacat

SEQ ID NO: 27686 - protein, 87 aa, Zea mays
  misc_feature: Ceres CLONE 1401121-F
MRRWWSPALAAVEPRSVQLLLLGVALVAASFYAGTLFGSSASPALVLPSSRPRSPDSFRTKVQMLQCLPAEFLVRTGKIIDSSRSPR

SEQ ID NO: 27687 - DNA, 689 bp, Zea mays
  misc_feature: Ceres CLONE 1401122-F
  misc_feature: Encodes the peptide sequence at SEQ ID NO. 27688
  misc_feature (176)..(176): n is a, c, t, g, unknown, or other
  misc_feature (359)..(359): n is a, c, t, g, unknown, or other
  misc_feature (457)..(457): n is a, c, t, g, unknown, or other
aaagctggagctccccgcggtggaggccgctctagaactagtggatcccccgggctgcaggaattcgcacgagaccattacctagaacatcctaatcgaaaaacagccagacggtctcgagctggatctctaccgttcgtccgttccagcagacagcagtgcgcgctctctctctncctcgtggcgacgactgggcgaccgctgccgctgcccttgtgccccggtctccgtcggtccgttcgccaggtctcctgcgggctctttgtcgtcgacaagctccgccaggttgctgtgtgaagtccaaggttgtcacatggattcagcacaagatttccaacccaggacatcctctataaagntgtggccaccaagtgaaagcacacggatcatgcttgttgacaggatgacaaaacatctgtccacagagttcattttctctcgcaaatatcgccttttnggaaagcgagaggctcatgagaatgcaaaaacgattgaagaactttgctttgcttgtgctgatgaccattccagagaggacccgatggtgatgggaagtctgctgtccactatatgcaagggaaccagcaggatgatgttgggaagttctgaaaaaagccccaagactactgcagaactgggaggcacctgtagctaacccacctctggggcctgctgaaactgaacaaaaa

SEQ ID NO: 27688 - protein, 113 aa, Zea mays
  misc_feature: Ceres CLONE 1401122-F
  misc_feature (16)..(16): Xaa is any aa, unknown, or other
  misc_feature (48)..(48): Xaa is any aa, unknown, or other
MDSAQDFQPRTSSIKXWPPSESTRIMLVDRMTKHLSTEFIFSRKYRLXGKREAHENAKTIEELCFACADDHSREDPMVMGSLLSTICKGTSRMMLGSSEKSPKTTAELGGTCS

SEQ ID NO: 27689 - DNA, 699 bp, Zea mays
  misc_feature: Ceres CLONE 1401123-F
  misc_feature: Encodes the peptide sequence at SEQ ID NO. 27690
  misc_feature (193)..(193): n is a, c, t, g, unknown, or other
  misc_feature (322)..(322): n is a, c, t, g, unknown, or other
  misc_feature (363)..(363): n is a, c, t, g, unknown, or other
  misc_feature (401)..(401): n is a, c, t, g, unknown, or other
  misc_feature (408)..(408): n is a, c, t, g, unknown, or other
aaagctggagctccccgcggtggcggccgctctagaactagtggatcccccgggctgcaggaattcgcacgagaccattacctagaacatcctaatcgaaaaagggccggacgacggggacagacagcggtgtcgcgggggcacttgcttccaacgccgtccgcacctgctgccctgtcgtccgccctccttnccttctcctcccctcaactgtttcctcaacctcccgacccaaccacggccgtgcccgccaaggcgccaaccgcacagtatcgctgtctcttggacattgcagcagcagctggggtgctgacgtgctgtnggtggttctgttgtccatggcgcgaaagcatcagcatgttngcatatttaccacagcgtgcttgccgtggatgactggnactgcgntaaacccactggttcgggctgcataccttgcaaggctggagattgggaagtcacgctgggggtgctttggctggccagggggatcaggagctcgtttatccaaacaagatgaggttcagtttggccggaaaagcaagaaaactattgtgcggcggtggctttgaagaaacgactggggctgttgcccaaatttggacataaagttctatcccgggaaagttttcaactgaaaaaaagaattatcctaccctggtgggagaaatcaagccagacataatctggatgaaaaag

SEQ ID NO: 27690 - protein, 77 aa, Zea mays
  misc_feature: Ceres CLONE 1401123-F
  misc_feature: SWISSPROT Homolog: EC 2.4.1.241 Digalactosyldiacylglycerol synthase
  misc_feature (9)..(9): Xaa is any aa, unknown, or other
  misc_feature (24)..(24): Xaa is any aa, unknown, or other
MARKHQHVXIFTTACLPWMTGTAXNPLVRAAYLARLEIGKSRWGCFGWPGGSGARLSKQDEVQFGRKSKKTIVRRWL

SEQ ID NO: 27691 - DNA, 670 bp, Zea mays
  misc_feature: Ceres CLONE 1401124-F
  misc_feature: Encodes the peptide sequence at SEQ ID NO. 27692
  misc_feature (336)..(336): n is a, c, t, g, unknown, or other
  misc_feature (383)..(383): n is a, c, t, g, unknown, or other
  misc_feature (427)..(427): n is a, c, t, g, unknown, or other
  misc_feature (599)..(599): n is a, c, t, g, unknown, or other
  misc_feature (670)..(670): n is a, c, t, g, unknown, or other
tcaccgcggtggcggccgctctagaactagtggatcccccgggctgcaggaattcgcacgagaccattacctagaacatcctaatcgaaaaaagcgatctcccgtccccgtagtccgcaggagagagatttttttctcggttgcaatgaagagttatccgtgggcgggggcccgccctcttgccgtcgtgcagctcctcctcttcctcgcccacctcgtcgaccgcggcggtgcttgccggtggaggcagcaagaggcagctcggtgtaccccggcggctgtcgtctacccgcatcactcccgccagatctcctgcaaaacccagggggtgttccntgtatcagcacttccgtcagcgacgacgaggctaaccacctgatctnccctcgcgagagcgaagctcaagaaggtcagcggtcgccgattnatatgtctggcagagacgccctccgtggagggccgcaccagctccggacctttccctcagaaaggggcaggaatcctaattgttgaggggtaatagaggacaaaattggctgcatggacattccttccaaaagaaaaatggtgaaagatatcccagtcctaggatatagcantgggggagaagtatgaaccacccctatgattacttccctgacaaggtaaacccttggcccgggggggcctn

SEQ ID NO: 27692 - protein, 77 aa, Zea mays
  misc_feature: Ceres CLONE 1401124-F
  misc_feature (64)..(64): Xaa is any aa, unknown, or other
MKSYPWAGARPLAVVQLLLFLAHLVDRGGACRWRQQEAARCTPAAVVYPHHSRQISCKTQGVFXVSALPSATTRLTT

SEQ ID NO: 27693 - DNA, 822 bp, Zea mays
  misc_feature: Ceres CLONE 1401125-F
  misc_feature: Encodes the peptide sequence at SEQ ID NO. 27694
  misc_feature (1)..(1): n is a, c, t, g, unknown, or other
  misc_feature (20)..(20): n is a, c, t, g, unknown, or other
  misc_feature (21)..(21): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (46)..(46): n is a, c, t, g, unknown, or other
  misc_feature (47)..(47): n is a, c, t, g, unknown, or other
ntcccccccccacccccccnnacccccccccccnnngtgtgtcccnntcaaagctggagctccaccgcggtggcggccgctctagactagtggatcccccgggctgcaggaattcgcacgagaccattacctagaacatcctaatcgaaaaaaaacgccccacagcgcaagcgagcagatcctcctccctttctgcttcctggaatcctctctgcctccccgcgccgatctcgagcacctggggaagaccgcgagacgtgcgcctgatttttctcatcgcagcagccctcaagttccccaccctcttttttcttgcagctttcaattattctggttatttagctacatctttattttactttcattttaccttttaatctgtttagttccccattgcatcttctgcggttgcggtaagaattgctgtttcttgctccttggttccttggtcttttgcttcctacccatgaacgcaggaaaccctactccatttccatcaaaaaaaaacccacacggggggcaggcgccgccgcaccccctctttcagggaggccgggaacttcggccccttaaattggcggtccgcctgaacaaccagggatcccccaaacccccgtcgggccaaaggggctacggggaaataaggttccatccccggaacagggccccgccaaagggatattgggacatggggggcaactaaccctggttcacgggaagccccagggaggggaccaagaggagaaacccccgggtggggcaagccgtccccacctcccaaggaggaggccggaacccggaaggtgttggcctccccccaaa

SEQ ID NO: 27694 - protein, 78 aa, Zea mays
  misc_feature: Ceres CLONE 1401125-F
MNAGNPTPFPSKKNPHGGQAPPHPLFQGGRELRPLKLAVRLNNQGSPKPPSGQRGYGEIRFHPRNRAPPKGYWDMGGN

SEQ ID NO: 27695 - DNA, 657 bp, Zea mays
  misc_feature: Ceres CLONE 1401127-F
  misc_feature (203)..(203): n is a, c, t, g, unknown, or other
  misc_feature (339)..(339): n is a, c, t, g, unknown, or other
  misc_feature (342)..(342): n is a, c, t, g, unknown, or other
  misc_feature (436)..(436): n is a, c, t, g, unknown, or other
tcaccgcggtggcggccgctctagaactagtggatcccccgggctgcaggaattcgcacgagaccattacctagaacatcctaatcgaaaagccgccaccgtcaccgtggcccgccgccatataagtaaaccctcgcctcgtcctcctcccaggctcgccaccctccgcctccgacacatggcccacccgcacctcgtgctcncctccccgaagtccctcctccccgccgccgcaactccatcgcgccgcgccgtcgccatccgcgcggcgctctccaccactttgtctccggccaaggcggcagctggagcagagggcggtgcgatcgatccgcgcgncgncagatcgtggacagccgcgggaccccacccggtcgaggtcacctccgtcgccccgggaacggacgcctccccgggttcgcgggggcccagcggngcggtcccaggggaatctaacgaggcgctgggagctccgcgacggtgacaagggccgtataccggggggaaaagggcgtactcccaagctggggcgaaaattcaacgaaggttatcgggccttaactcaaagggcggccgatgggggggaaccaaaagggaaggttgaatggcacccatgctaaaaaaattggagggaaactcagaaaataagtcgggaag

SEQ ID NO: 27696 - DNA, 788 bp, Zea mays
  misc_feature: Ceres CLONE 1401129-F
  misc_feature: Encodes the peptide sequence at SEQ ID NO. 27697
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (788)..(788): n is a, c, t, g, unknown, or other
ggccccccccccnnnnnnnnnnncaaacgccggnnnnntcccattttttcaaagctggactccccgcggtggcggccgctctagaactagtggatcccccgggctgcaggaattcgcacgagaccattacctagaacatcctaatcgaaaatttttactcttcatgcttttccccttcgtgcaagcaaagctaaacaatacccgtcttgccttcaaatcgaactcctcccccgatcgatcccaatcgaacccaccaagccgataccctaaccctcgcccttctcgatgtcggccgccaccaccggcccagccccttcagtagccactccgatggcgccccctccgtcctacccggcctcctccacggcctcttcctccatctccgcgtccgccgaggaggaggaggacctctatggccgcctcaaatcgctccaacgccacatggaagttcgtcgaaatccagggaggagtacgttaaagacgagcagaagaacctgaagcgcgaactccttcgtgcgcaggaggaggttaagcggatccagtctgtaccgctcgtcattggcccagttatggagatgggcgacggcaacaaacggcattcgggggcttctaccactgggaaacaactaccaacgtggccggatcctccagcacccatcaacccgcggagttgggtccaagcccgaacaagggtcccgttcgggggagggcaatccaaccaccccccaaacggttcttaagttcccaacccatcccattttnnnnnnnggggaagggcgcgaacttcn

SEQ ID NO: 27697 - protein, 70 aa, Zea mays
  misc_feature: Ceres CLONE 1401129-F
MSAATTGPAPSVATPMAPPPSYPASSTASSSISASAEEEEDLYGRLKSLQRHMEVRRNPGRSTLKTSRRT

SEQ ID NO: 27698 - DNA, 651 bp, Zea mays
  misc_feature: Ceres CLONE 1401133-F
  misc_feature (651)..(651): n is a, c, t, g, unknown, or other
tggagctccccgcggtggcggccgctctagaactagtggatcccccgggctgcaggaattcgcacgagaccattacctagaacatcctaatcaaaaagatctacctgtctgttcttcgatcgagtctgagagatttgggaggaggagggaaacaaagcgaaagagcccatcttttttgtctttttggttcggtttcgtggttgcttcttttggaccccgcggaggagcccaccgtttctacaaaaacccaatctttgctgccttctcagcggtcgagatcgataggtttccagatctgaggctccgtgttctggctgtgagatcggaggcgcaacaatccgagcacgcagctagtagggaaagtatccgagaaaagttgcagattttgctgggggcaacggagcgagaacaagttactgcagaaggaaagggcaaaggtgctggaggcgccggagatgaggtatgctatcagctctgatggattatttgaatccttgctcgagcccggcatcagcgaatgggcgatcaccgacaagaatctgatgcctgcggcccgccatgacggcttcgtgcggcacttctccctcctactacggcaccccatgggggatggaacgatacgctcattcccgcgacaagcaaagtagtgcn

SEQ ID NO: 27699 - DNA, 721 bp, Zea mays
  misc_feature: Ceres CLONE 1401134-F
  misc_feature (1)..(1): n is a, c, t, g, unknown, or other
  misc_feature (2)..(2): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
nnaaaannnnnnnnnnnnnaaagagaaataaaannnnttaaaaanacgaagactcccaaactggagctccccgcggtggcggccgctctagaatagtggatcccccgggctgcaggaattcgcacgagaccattacctagaacatcctaatcgaaaaacacaggcctcccggcctcccgtgcgctattctctatcagcttacccagcacacagtacacactctaatctccacacgacccaatagatatacggggctgaaggatgaagcttagagcaaaagggatcggcctcctgcttctccttgtcttgcttgctctttgctccaccattgaagtcggcgaggcaagaagaggcaagcattggaggtcgtcgaggagctcaccgggctcatcccagctcaagaaagacaagggaaagaagagcagctccccgccggcagtacggcgccaaccggccaggtccgaagccaccggtcagctcgacaccaagcctctggtgctgccaagggaaatcatcagaatccttaccaaccaagcccaagtccaagcccgaatgcccctgacatccctcctatgccaagccctgcaaatggcagcaggcattccactcccgagccgcggactccaagggtggggggaaaggggcaacaacagccatcacagcccccgccgggcgacctcgcgcagggtgcaaaaattccaatggggggttgattttgcca

SEQ ID NO: 27700 - DNA, 682 bp, Zea mays
  misc_feature: Ceres CLONE 1401137-F
  misc_feature: Encodes the peptide sequence at SEQ ID NO. 27701
  misc_feature (306)..(306): n is a, c, t, g, unknown, or other
  misc_feature (365)..(365): n is a, c, t, g, unknown, or other
  misc_feature (431)..(431): n is a, c, t, g, unknown, or other
  misc_feature (446)..(446): n is a, c, t, g, unknown, or other
  misc_feature (567)..(567): n is a, c, t, g, unknown, or other
gctctagaactagtggatcccccgggctgcaggaattcgcacgagaccattacctagaacatcctaatcgaaaaccagctttgctttgtagttgtagcgctagcagcttaattggtctctgagctgaggtgcactactagctagctagtcgtgcaggaagaggaaggaatataatggctgagcgggaggtcgtcgaaggcgggacgacgacgggaggcgggttgtggcggaggtatgcgccgcacgtccagatggtgctggcgcagctgtgctacacgctcatgtacttcatcaccgaggccgccnttcaccaggggctcaacccctacgtctacatcacctaccgcctctttcctcgtcgccgntcctcatctgggccttcgatactacccctggaagaaagggggctgagggccctaaatgcggctcantgcctggtccgtggnaaaatatttcgtgctctcccctttcctcgggggtggagcttaacctctggaacatggtacttcgccggagccttgaagtaaccgttccccccaacgttcgttcaacttttcccgtggttgnacaccgttcgccccctccgaagggacgttccggtcatcgccatcatcctttgagggaatggagaaaaaccggggaacggtggagagcccctaccgcgggggtccgcccagggtcc

SEQ ID NO: 27701 - protein, 117 aa, Zea mays
  misc_feature: Ceres CLONE 1401137-F
  misc_feature (45)..(45): Xaa is any aa, unknown, or other
  misc_feature (86)..(86): Xaa is any aa, unknown, or other
MAEREVVEGGTTTGGGLWRRYAPHVQMVLAQLCYTLMYFITEAAXHQGLNPYVYITYRLFPRRRSSSGPSILPLEERGLRALNAAXCLVRGKIFRALPFPRGWSLTSGTWYFAGALK

SEQ ID NO: 27702 - DNA, 689 bp, Zea mays
  misc_feature: Ceres CLONE 1401139-F
  misc_feature: Encodes the peptide sequence at SEQ ID NO. 27703
  misc_feature (640)..(640): n is a, c, t, g, unknown, or other
aagctggagctccccgcggtggcggccgctctagaactagtggatcccccgggctgcaggaattcgcacgagaccattacctagaacatcctaatcgaaaaagccagcaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggcggaatctcccgggacgcctctccgtccgcgcctccgcgacggtggtagcggcaccgcggcgggagacggatcccaagaagcgggtggtgatcacggggatggggctggtctccgttttcgggaacgatgtagacgcttactacgaccgcctgctagtcggggagagcgggatcgggcccatcgacggcttcgacgcttctaagttccccacccgctttgccgggcagatccggggcttctcctccgagggatacatcgacggaaagaacgacgccgccttgatgattgcctccgatactgcatcctcagtggaaaaaggctctcgaggcctccggtatcgcccacggctcnaagcccttggaaaagattgaaagaccccgggcggtgtgcttggggcacg

SEQ ID NO: 27703 - protein, 143 aa, Zea mays
  misc_feature: Ceres CLONE 1401139-F
  misc_feature: SWISSPROT Homolog: EC 2.3.1.41 Beta-ketoacyl-acyl-carrier-protein synthase I
  misc_feature (138)..(138): Xaa is any aa, unknown, or other
MQSLLLPTAAVAPVAPPCGRRNLPGRLSVRASATVVAAPRRETDPKKRVVITGMGLVSVFGNDVDAYYDRLLVGESGIGPIDGFDASKFPTRFAGQIRGFSSEGYIDGKNDAALMIASDTASSVEKGSRGLRYRPRLXALGKD

SEQ ID NO: 27704 - DNA, 654 bp, Zea mays
  misc_feature: Ceres CLONE 1401141-F
  misc_feature: Encodes the peptide sequence at SEQ ID NO. 27705
tccccgcggtggcggccgctctagaactagtggatcccccgggctgcaggaattcgcacgagaccattacctagaacatcctaatctaaaagcggtcactgctccgaagtccgaaccttcatacacatcgtctcgtttccgatttccccaaattcaggccacaggcgctacaggacccaggcaccactcggtcggcggccaccgcgtcgccccgcctgctcgattggggtcgcgtgtgcgataggaagtattgtgttgtgtttgcaacgtgatagcttgtactgggaacaaaggtcaagatgggcgccttggacctacaccttgactttgcttctgctcaacatggacaagccaagttaaaggaatatggcaagagctctttggtgtctggtggaaactacaatacagacaagatcaatggttcaaaccctgatgactattaaaaattttaaaaaagggatatggccctatgggtggtccaatttataaaaaggagatgccgcataaaaagccccttggttgaaatagaatttttgggttggccaaccctgcccacaaggaaacttaaaaattccctttaaagttggaaaaaaaggaaaagggtttgaacttcccccccccgtgagagggcgcccgggtgtgttatgtctattg

SEQ ID NO: 27705 - protein, 47 aa, Zea mays
  misc_feature: Ceres CLONE 1401141-F
MGALDLHLDFASAQHGQAKLKEYGKSSLVSGGNYNTDKINGSNPDDY

SEQ ID NO: 27706 - DNA, 674 bp, Zea mays
  misc_feature: Ceres CLONE 1401143-F
  misc_feature: Encodes the peptide sequence at SEQ ID NO. 27707
  misc_feature (372)..(372): n is a, c, t, g, unknown, or other
  misc_feature (420)..(420): n is a, c, t, g, unknown, or other
  misc_feature (483)..(483): n is a, c, t, g, unknown, or other
  misc_feature (485)..(485): n is a, c, t, g, unknown, or other
  misc_feature (489)..(489): n is a, c, t, g, unknown, or other
  misc_feature (512)..(512): n is a, c, t, g, unknown, or other
aaagctggagctccccgcggtggcggccgctctagaactagtggatcccccgggctgcaggaattcgcacgagaccattacctagaacatcctaatcgaaaaacctcctatggccaccgtcgactgccccctgccctctcccgcggacctcgacgacaacggattcccggctctaccctcatcccccgctgcctgtagcagcggcttcgcggaggacttctaccgcagcggcaccgactggtcctccttacgcgcccctccgccgctggggccgcccagaagcacccggtgtgaaggagagaggaggcggctcggccgtgcagagcagcctcttcccagcgtgggggatcgagaagccgcggcgggacgggncgtgggctgattcatcgcttgtgcagaggagcctcttcccagcatggnggatcgagagaccgcagagggagggtctcggggctggagattcctccccctcctctccctttncngtcntcttgtggcaggaaagcggagcnagaaacaccccgagagagcgggtggccgccaagaagccctcgcgtgcccttctacagaagattctggcacaccattccggtggatgcatttcggtatgacaagtggagggtgctcgcctatttccttaccactttatcatgaccattacgtggataaacaag

SEQ ID NO: 27707 - protein, 90 aa, Zea mays
  misc_feature: Ceres CLONE 1401143-F
  misc_feature (88)..(88): Xaa is any aa, unknown, or other
MATVDCPLPSPADLDDNGFPALPSSPAACSSGFAEDFYRSGTDWSSLRAPPPLGPPRSTRCEGERRRLGRAEQPLPSVGDREAAAGRXVG

SEQ ID NO: 27708 - DNA, 828 bp, Zea mays
  misc_feature: Ceres CLONE 1401144-F
  misc_feature (20)..(20): n is a, c, t, g, unknown, or other
  misc_feature (26)..(26): n is a, c, t, g, unknown, or other
  misc_feature (29)..(29): n is a, c, t, g, unknown, or other
  misc_feature (39)..(39): n is a, c, t, g, unknown, or other
  misc_feature (44)..(44): n is a, c, t, g, unknown, or other
ttttttatcccccccccccntcactnacncataataatnaagantgcgtccgtttcaaaagtggagctcaccgcggtggcggccgctctagaactagtggatcccccgggctgcaggaattcgcacgagaccattacctagaacatcctaatcgaaaacacacaccccacatcacaacagctccctctgcatctccgcctcgtcgacgtcgtctgcctgcacaaccttcttcttcctcatctctctctctcttcttccgctgccaccctcccagcaccgagggaagggaagcccaggaatctccgtcccgctcccggccgccgtccttctcataacctcatcggatctgtattgggctttcagtaaggagcacaacaccgcccttaggaaatgcagaaagatgtgcttgcacgcccaaaacctactttgtggagggaacttgggcaggaaaagcacgcccaaactctttaattcctctgcccaccctccttgaatggacttccgaaggctccaaggaaggaccccggaatcctccctcccctccgtggccttttcccgcaaaagtggggggttcccggacggtgggggcgggctccaaaacgggcccttttctatataaaatccaccattctttcggggagagaaaaccgggtataagaaactctctttaaaaacccctatcttaaaaaccaccctatggggcgcggcacccaacttctctttgtttaaccggggtggcaaaggggaaaaagcgaaatggggacccccccgtgggtgggcgccgacacacagcccaacccaacccattaagcgtggagtcgatcgacc

SEQ ID NO: 27709 - DNA, 646 bp, Zea mays
  misc_feature: Ceres CLONE 1401146-F
  misc_feature: Encodes the peptide sequence at SEQ ID NO. 27710
tccccgcggtggcggccgctctagaactagtggatcccccgggctgcaggaattcgcacgagaccattacctagaacatcctaatcgaaaaaggaccaagaaacatagagagagcggttctacgtccgagtcgtcgcatcaggtcccctcgattcgccggcggcgccaccaaccaagctcatacatctgaattgactagtcaaactcagtgatctctttggggactaatcaaactcaagaactaagtttcatgtctgatctcgacgtccagcttccatctgcttttgatccgtttgcagaggcaaatgctgaggactccagtgctggtgctggatcaaaggactatgtgcacgtgcgtattcagcagcgcaacggaaggaagagtctgacaactgttcagggcttgaagaaagagacagctacaacaagatcctcaggattccaaaaaaagagtctgctgcatgggtactgtaagcccaggatccagagcctaggccaggtcattcaaactgcaaggggatcaggcgtaaaaatgtcgctacttttctagtccaaggccggaatcgtgaaaaaagataggatccagaattcacggtttttagactgcaaatttttgagggccttgagcggcgcctaatcaaatggg

SEQ ID NO: 27710 - protein, 99 aa, Zea mays
  misc_feature: Ceres CLONE 1401146-F
MSDLDVQLPSAFDPFAEANAEDSSAGAGSKDYVHVRIQQRNGRKSLTTVQGLKKETATTRSSGFQKKSLLHGYCKPRIQSLGQVIQTARGSGVKMSLLF

SEQ ID NO: 27711 - DNA, 839 bp, Zea mays
  misc_feature: Ceres CLONE 1401148-F
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (25)..(25): n is a, c, t, g, unknown, or other
  misc_feature (30)..(30): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
tgggtaatccccnnnnnnnnnnncnaaacncaccaaaannnacaccgggcgcctttcaaagctggactccaccgcggtggcggccgctctagaactagtggatcccccgggctgcaggaattcgcacgagaccattacctagaacatcctaatcaaaaaaccggagagatctggtctgccattccctcgctccttcccgtgaaccacaaacctaacgcggagcggcgcgggccggccgccgcgcgaggtgcgcgtagctgccgtcgattgtcgccggatccatccaccatgggcggtggcaacggccagaatccaagatggccccgcgagcgcaacttggagaagaacaagggggccaagggggagccagcctccgagaccaacaagaaagggcatgagcatcccagtgcaaaaggtgtgaatggcaaaacattccatgtggtaccacgaacctgaaagtgaagtgccgggaggcacgcccgaaggccaagcatttcccgcaagaaacggaaccctcctccacacccaccataacacccccacccatacctcatcattctttctcacccccccccttcccccccccctttccccccccccacccgccgtccgcgccgaggcggagccccaacgacgatccccaaatcgaacaagcaatatcacagagggggggtgaactattaatactactctatcggcgtcggccgggggggcggcgcccggcgcgtggtcgcccggccggaggggcacccccggcatcggccgcccctcgcgttctccccaccgcagaaaccctacgaatcaaaaagcacagcccgccccgcacccaccctcctccc

SEQ ID NO: 27712 - DNA, 652 bp, Zea mays
  misc_feature: Ceres CLONE 1401149-F
  misc_feature: Encodes the peptide sequence at SEQ ID NO. 27713
  misc_feature (368)..(368): n is a, c, t, g, unknown, or other
  misc_feature (464)..(464): n is a, c, t, g, unknown, or other
  misc_feature (519)..(519): n is a, c, t, g, unknown, or other
cgcggtggcggccgctctagaactagtggatcccccgggctgcaggaattcgcacgagaccattacctagaacatcctaatcgaaaaataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcgncgcctcgccctacgacgacgaccgcatcggggacatggcccgcttcgcggaacacgctgtcggacacctcccccggctcgccgcgcagcgcttccntggtcggaaaggacgcgtcatcactcgccgccccccgggttggttgggcgggcgncatctgcatcaaacgccgctttctacacgcgggccagcgaagaacaaagtggggggggggttcctgtgggaaaccttgggcgcccgccggggagagggaaacccgagggaagggagagcacttgttcgccttt

SEQ ID NO: 27713 - protein, 173 aa, Zea mays
  misc_feature: Ceres CLONE 1401149-F
  misc_feature: SWISSPROT Homolog: EC 4.1.2.10 Mandelonitrile lyase
  misc_feature (79)..(79): Xaa is any aa, unknown, or other
  misc_feature (111)..(111): Xaa is any aa, unknown, or other
MSGRSRHFTMSTLLATSFFFVLLCSSLQVRGVNYTFVKDAALAPSVSYYDYIIVGGGTAGCPLAATLSERFRVLLLERXASPYDDDRIGDMARFAEHAVGHLPRLAAQRFXGRKGRVITRRPPGWLGGRHLHQTPLSTRGPAKNKVGGGFLWETLGARRGEGNPREGRALVRL

SEQ ID NO: 27714 - DNA, 660 bp, Zea mays
  misc_feature: Ceres CLONE 1401150-F
  misc_feature: Encodes the peptide sequence at SEQ ID NO. 27715
  misc_feature (174)..(174): n is a, c, t, g, unknown, or other
  misc_feature (178)..(178): n is a, c, t, g, unknown, or other
  misc_feature (185)..(185): n is a, c, t, g, unknown, or other
  misc_feature (237)..(237): n is a, c, t, g, unknown, or other
aagctggagctccccgcggtggcggccgctctagaatagtggatcccccgggctgcaggaattcgcacgagaccattacctaaacatcctaatcgaaaaccaacccttgtagtctcagtcaatctgtagattgagactacgatgagcctgtcaccgctcgactcctcctcccgncggncgggggntgcggctgctgctacggaggtgcccctcgccccgggttcccgctccaacccnacgacgaggaagtcgtcttctaatacctcgccggcggggtcttcggccgccgctccggggtaaagccattcgcgaaaattaacctttaacgcctgaagcctgggaactccccctccttttccccaaatccaagcgcgaagcccaaggggattttttttccccctttaaaccaaaaaaccccccgcttttggccccggggccccgggggtccccccaaaaagaaaaacccccgctcccccggggggggttggaaaaacccccgaaaaaagccccggggggggccccccccggaaaaccccccgggaaaaaaaaaaaaatttttttctccccccgggggggggccctagggggggggggaaacaacgggggtttttcaaaaaaaaccccccccccttgtagggagggaccctcccgtgttgtgtg

SEQ ID NO: 27715 - protein, 52 aa, Zea mays
  misc_feature: Ceres CLONE 1401150-F
  misc_feature (13)..(13): Xaa is any aa, unknown, or other
  misc_feature (15)..(15): Xaa is any aa, unknown, or other
MSLSPLDSSSRRXGXAAAATEVPLAPGSRSNPTTRKSSSNTSPAGSSAAAPG

SEQ ID NO: 27716 - DNA, 685 bp, Zea mays
  misc_feature: Ceres CLONE 1401151-F
  misc_feature: Encodes the peptide sequence at SEQ ID NO. 27717
  misc_feature (423)..(423): n is a, c, t, g, unknown, or other
  misc_feature (538)..(538): n is a, c, t, g, unknown, or other
  misc_feature (626)..(626): n is a, c, t, g, unknown, or other
aagctggagctccccgcggtggcggccgctctagaactagtggatcccccgggctgcaggaattcgcacgagaccattacctagaacatcctaatcgaaaaatgatgactgtttgttttctaagctcgttcgccccctctcttctctccgtccaacgacggcgcgattcagatccaggcatacaggccatccttccgccgccgcggactgcgcttaatcttccttctccagcagccgggcgttcccgtcgtcctcgatcctcccctggactggatcgcaacggagatccagccggacctgcggtggtcccttccttttctcgcataatgagctcgccagtggagaggtgattcgtcaggctggtatcaagttcctagtccatggtgcctggatgagcagtagagatgctactggccgtggaanggaggaggttcttctcgtcttcagctacagggtacagccatggcctcgccctcttgctgctcggacgcaaagctgaggagaagcccgtaaaggtctcgccgtggaaccagtaccngctagtcgaccgggagaccgagcaggtgtaccacctgccctcccgcaaagacaggctcctgggaaatgtgctccctttgtctgcttcngatgcacggctaatggcctcgagggtgcgtctcctcaaaagcgacctccagcaatgcgt

SEQ ID NO: 27717 - protein, 93 aa, Zea mays
  misc_feature: Ceres CLONE 1401151-F
  misc_feature (7)..(7): Xaa is any aa, unknown, or other
  misc_feature (45)..(45): Xaa is any aa, unknown, or other
MLLAVEXRRFFSSSATGYSHGLALLLLGRKAEEKPVKVSPWNQYXLVDRETEQVYHLPSRKDRLLGNVLPLSASDARLMASRVRLLKSDLQQC

SEQ ID NO: 27718 - DNA, 751 bp, Zea mays
  misc_feature: Ceres CLONE 1401152-F
  misc_feature: Encodes the peptide sequence at SEQ ID NO. 27719
  misc_feature (317)..(317): n is a, c, t, g, unknown, or other
  misc_feature (348)..(348): n is a, c, t, g, unknown, or other
  misc_feature (349)..(349): n is a, c, t, g, unknown, or other
  misc_feature (377)..(377): n is a, c, t, g, unknown, or other
  misc_feature (422)..(422): n is a, c, t, g, unknown, or other
aagctggagctccccgcggtggcggccgctctagaatagtggatcccccgggctgcaggaattcgcacgagaccattacctagaacatcctaatcgaaaaactaggaaaaacctagacacgaagtccaacccaaatctcaatatcccaaccctccgatccccatttccatccactccgacaccaatcctccgctccgaccaccgccggagaaatggggcggcgccgccggttcgcgcagctggacgatgacgacgacgacgacgaagacgtgcccatcaatttcaagccctcgggtgggcgcctcctcctcggacgncaaaacccagaagcccccagcgccgccgcannagcggccgcggagtctcggatgacgacnaccaggacggggaggagtgggactttggggagggaggaggccccnaaaaggtttccaggcaatggcgacgggcccaaggaggaagacgcccccaagaaaaaggcccaaaaaaaaaaccccccccccccgggggaaaggccaaaaggccccccgaaaccggggggggggagataggggcccccaagaggttaaaatttctaaaagggggaccccccggggggggagaaaaacccgggggggggcccccttttttggggggccccccccaaaaattttggggggggggaaaaaaaaaaaaaaaaaattttttctcctcaaaaaaagagaaaaatttttttgggggggggcgcccccttttttcccaccggagagaa

SEQ ID NO: 27719 - protein, 112 aa, Zea mays
  misc_feature: Ceres CLONE 1401152-F
  misc_feature (46)..(46): Xaa is any aa, unknown, or other
MGRRRRFAQLDDDDDDDEDVPINFKPSGGRLLLGRQNPEAPSAAAXAAAESRMTTTRTGRSGTLGREEAPKRFPGNGDGPKEEDAPKKKAQKKNPPPPGERPKGPPKPGGGR

SEQ ID NO: 27720 - DNA, 582 bp, Zea mays
  misc_feature: Ceres CLONE 1401158-F
  misc_feature: SWISSPROT Homolog: EC 3.2.1.21 Beta-glucosidase
gctctagaactagtggatcccccgggctgcaggaattcgcacgagaccattacctagaacatcctaatcgaaaaacacacttcacaaggagctcagagctctagttctagctagctagcacagggggggaaaatggctccgcttctcgctgctgccatgaaccacgctgcagtccatcctggtcttaggagccacctagtaggacccaacaatgagagtttctcacggcaccacctgcctgtcttcttctccacagaagcgagcaagcgaaggtgtaaccttagctttactacacgatctgcaagagtaggcagccaacatggagtccaaatgttgagcccctcggaatcccacaaagggactggttcccctctgacttcaccttcggggccgccacttcagcgaccaaattgaaggggtttggaatgaaaaagggaaaggggaaaagaacggggatcacttctgggcaaattattccgaaaaggaaacctgggacgggaagcaattctcgaacattggagggggaaattccaacacctattggacaaaaaaggggacgggttaaataggccccagaggaaa

SEQ ID NO: 27721 - DNA, 724 bp, Zea mays
  misc_feature: Ceres CLONE 1401161-F
  misc_feature: Encodes the peptide sequence at SEQ ID NO. 27722
  misc_feature (1)..(1): n is a, c, t, g, unknown, or other
nagagctggagctccccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctggcacacccgagcctccggccccggccacatcaaagccgccgcctccggccccggccacacccaagccggcggcctccggccccggccacacccaagccgcccccagcgggggaaggaaaagggcggtggcccggggggtgaaactcacgggccgccccgcggagggttaacggggaggcgccgggggttgccgaccaaacgggcaacggaggggtccccaatgcacgggggccaggggggggccaaggttcccgttggtcttactcccacgggaacccccgccaaacctccgacaaaaggaacgagcttctttggtggaggttgaggcgccccccttcaagggaaaccctcaggggggggacggacaatctcggggtaaggggccaaacttac

SEQ ID NO: 27722 - protein, 89 aa, Zea mays
  misc_feature: Ceres CLONE 1401161-F
MGAVTSTVAARFAFFPPSPPSYGFEQPAPLPAPGTPEPPAPATSKPPPPAPATPKPAASGPGHTQAAPSGGRKRAVARGVKLTGRPAEG

SEQ ID NO: 27723 - DNA, 684 bp, Zea mays
  misc_feature: Ceres CLONE 1401165-F
  misc_feature (236)..(236): n is a, c, t, g, unknown, or other
  misc_feature (240)..(240): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (253)..(253): n is a, c, t, g, unknown, or other
  misc_feature (254)..(254): n is a, c, t, g, unknown, or other
  misc_feature (609)..(609): n is a, c, t, g, unknown, or other
aagctggagctccccgcggtggcggccgctctagaactagtggatcccccgggctgcaggaattcgcacgagaccattacctagaacatcctaatcaaaaaacggtttgcgtataaataagtagtcagtcgctcatcttgttccttgtgaacatcgcagtgctgtagcctccttcgtcttgagcgagcatggagatgtcagccatggaggaagcctcccaggggggatggaagagnaggnannnnnnncctcnnaaccattccgttcatcatcttaaacgagatattccaaaaagtgggccacgtttcgggttgtccgccaaaatgatcctgtaactccaccaaacggttatctcatgacccaaggcctttgcccaccgtcgacctccaaatttcggggaggcctttctcccaaatttcttggcccatttttaaaggggcccggggttcgccaaaaaccccgccccccggggcggttccccgggtcctccacccccccgggttcctgcggtaaagcccccttcccaaaattggccctcctttggggttaaaaaaaaaactcttttcgctgttaaaaaaaaaaccccccccaaaagtgggcccccccggngggccccaaaaaaatatatcctctcacttcttggggggatatatttcccccgccactcctcgtagggagaacggg

SEQ ID NO: 27724 - DNA, 683 bp, Zea mays
  misc_feature: Ceres CLONE 1401168-F
  misc_feature: Encodes the peptide sequence at SEQ ID NO. 27725
tggagctccccgcggtggcggccgctctagaactagtggatcccccgggctgcaggaattcgcacgagaccattacctagaacatcctaatcgaaaagaaaccaaccagatcacacgaaccaaaccaccgcttcctcccccgaccggagaggagcctcaccgccggcgcccatggcgacacgctacttgatcgtgtcgctgcccgtgcagtcgcccggcgccaccgccagctccctgtggtcgcgcctccaggactccatctcccgccactccttcgacaccccgctctaccgcttcaacgtcccggatctccgcgtcggcaccctcgactcgctcctcgcgctcagtgacgacctcgtcaagtccaatgtcttcgtggagggcgtgtcacacaagatccgggagcagatcgaggacctcgagcgcgccggaggggtcgagacccggaccctcaccgtcgacggcgtccccgtcgacacctacctcactaggttcgtgtgggatgagggcaagtacccccacatgtcccctctcaaggagatcgtccgcagcatacagtcacagggttgcaagatcgaggatgacatgaaggttcgagcatcaaaatatataatggaaggagccagcttagtgcgatcacagggaacaaagggggagctagcggtccgtgatctttccaatcg

SEQ ID NO: 27725 - protein, 170 aa, Zea mays
  misc_feature: Ceres CLONE 1401168-F
  misc_feature (5)..(170): Pfam Name: V-ATPase_C Pfam Description: V-ATPase subunit C
  misc_feature: SWISSPROT Homolog: EC 3.6.3.14 H(+)-transporting two-sector ATPase
MATRYLIVSLPVQSPGATASSLWSRLQDSISRHSFDTPLYRFNVPDLRVGTLDSLLALSDDLVKSNVFVEGVSHKIREQIEDLERAGGVETRTLTVDGVPVDTYLTRFVWDEGKYPHMSPLKEIVRSIQSQGCKIEDDMKVRASKYIMEGASLVRSQGTKGELAVRDLSN

SEQ ID NO: 27726 - DNA, 625 bp, Zea mays
  misc_feature: Ceres CLONE 1401172-F
  misc_feature: Encodes the peptide sequence at SEQ ID NO. 27727
  misc_feature (300)..(300): n is a, c, t, g, unknown, or other
  misc_feature (319)..(319): n is a, c, t, g, unknown, or other
  misc_feature (325)..(325): n is a, c, t, g, unknown, or other
  misc_feature (343)..(343): n is a, c, t, g, unknown, or other
  misc_feature (376)..(376): n is a, c, t, g, unknown, or other
  misc_feature (379)..(379): n is a, c, t, g, unknown, or other
  misc_feature (380)..(380): n is a, c, t, g, unknown, or other
aagctggagctccccgcggtggcggccgctctagaactagtggatcccccgggctgcaggaattcgcacgagaccattacctagaacatcctaatcgaaaaactaggaaaaacctagacacgaagtccaacccaaatctcaatatcccaaccctccgatccccatttccatccactccgacaccaatcctccgctccgaccaccgccggagaaatggggcggcgccgccggttcgcgcagctggacgatgacgacgacgacgacgaagacgtgcccatcaatttcaagccctcgggtggncgcctcctcctcggacgcnaacccnagaagccccagccgccgncgcagcagcggcgcggagtctccgatgacgacnacnnagacgtggaggaagtggaactggaggagggaggagacgaccagaaggatctcgaggcatgcgacgggccgagggaggagagcggccgcaacaaaaagccgaaaacaaaaactcgccggcggcggggaacgcccaaagcgccgcccggaccccgggaagcgaggatggaggagcccgaggagctagagctggaaacggaggatccccggggagaggaaatcccggagggggggcccgaaattggaa

SEQ ID NO: 27727 - protein, 137 aa, Zea mays
  misc_feature: Ceres CLONE 1401172-F
  misc_feature (36)..(36): Xaa is any aa, unknown, or other
  misc_feature (38)..(38): Xaa is any aa, unknown, or other
  misc_feature (44)..(44): Xaa is any aa, unknown, or other
  misc_feature (55)..(55): Xaa is any aa, unknown, or other
  misc_feature (56)..(56): Xaa is any aa, unknown, or other
MGRRRRFAQLDDDDDDDEDVPINFKPSGGRLLLGRXPXKPQPPXQQRRGVSDDDXXDVEEVELEEGGDDQKDLEACDGPREESGRNKKPKTKTRRRRGTPKAPPGPREARMEEPEELELETEDPRGEEIPEGGPEIG

SEQ ID NO: 27728 - DNA, 730 bp, Zea mays
  misc_feature: Ceres CLONE 1401173-F
  misc_feature: Encodes the peptide sequence at SEQ ID NO. 27729
cagagctggagctccccgcggtggcggccgctctagaactagtggatcccccgggctgcaggaattcgcacgagaccattacctagaacatcctaatcaaaaaatcccaaatagttactccactcccctcacccctcccgactcccgtgctctctctctctctctctctcggatccgaattgccagcgcaccagtcgagctcgcgggaactcgccggcaccggcgatggcctccgccctactggccggacagggcggggcgcgccaccacggctggggggagacgcgcgccccactcgcgcccatacctcccaaccctaaccccagccagccccacccgcgcgccgacgggtccaagtccaagccgcgggcggcagcctcctcgccggcggccggatacgtgacgttccgcccgggcgtcctgagcccgcgcgaagcccgcgcgctcagggaccgcctcgcggtggagctcatccaggtgcgcgccttctcatccgcatcgacacctggcagcagcagggcccgacgtcccgcggggctcccccgggaaggtgcggaaacggggcgggaaaacttccacaggttgccaaggaaaagggaacggggggtccaccgccccgccaagggggaggccttggcctccccaaataacagccgggaataaagggccccgggggccctgacccccaaaggggggctccccccccggggggatcccctccgggagaatt

SEQ ID NO: 27729 - protein, 145 aa, Zea mays
  misc_feature: Ceres CLONE 1401173-F
MASALLAGQGGARHHGWGETRAPLAPIPPNPNPSQPHPRADGSKSKPRAAASSPAAGYVTFRPGVLSPREARALRDRLAVELIQVRAFSSASTPGSSRARRPAGLPREGAETGRENFHRLPRKRERGVHRPAKGEALASPNNSRE

SEQ ID NO: 27730 - DNA, 630 bp, Zea mays
  misc_feature: Ceres CLONE 1401174-F
  misc_feature (334)..(334): n is a, c, t, g, unknown, or other
  misc_feature (344)..(344): n is a, c, t, g, unknown, or other
tccccgcggtggcggccgctctagaactagtggatcccccgggctgcaggaattcgcacgagaccattacctagaacatcctaatcgaaaaatcaagttttgtagtgttgttagtgtttctaccgtatgtctgatttgtactttattagtacttaagtctgtctttgagaaatataagatactagtctgttcactgaagaatgtggccttaaacactagtttgatttcagggtggttatgttctttatcgcctcttctggaaaccagaggagaaaactgtgcgctccagcccagaaaagatggatagaagtggcaactcgcctactactccccngttcttcacngtgacaacccaagaggggaatgaggaagctaataaccattaaataagaatctctagatctgctctgcatgatccgattgagctgcccaatctgctgaaaccctgctggccaaggaaaaggggcctggggaaaaaaaggaaaatttggggcgtacgggccccggttgggtcccctattacctttccgggaacttggtggtggggggaacctaaaattttgtccctttagttggttgggtttaggcccccttttttttttatcccccccccaaaagggggggatttgg

SEQ ID NO: 27731 - DNA, 683 bp, Zea mays
  misc_feature: Ceres CLONE 1401175-F
  misc_feature: Encodes the peptide sequence at SEQ ID NO. 27732
  misc_feature (323)..(323): n is a, c, t, g, unknown, or other
  misc_feature (324)..(324): n is a, c, t, g, unknown, or other
  misc_feature (369)..(369): n is a, c, t, g, unknown, or other
  misc_feature (399)..(399): n is a, c, t, g, unknown, or other
tggagctccccgcggtggcggccgctctagaactagtggatcccccgggctgcaggaattcgcacgagaccattacctagaacatcctaatcgaaaaattccaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggctcgctgcagctcccgcctgggttccgcttccaccccaccgatgacgagctggtgatgtactatctcctccgcaagtgcggnnggctgccgctcgccgcgccggtcatcgccgaggtggatctctacnaagtcgacccatggcagctcccagagaaangcgtcggtggggagaaggagtggtacttcttctcgccgcgcgaccgcaagtacccgaatggctccaggcctaacggggcggccgggacaggtactggaaggccaccggcgccgaccagccggtaaggtcgccgcgccccgtggcatcaagaagcgctcgtcttctacgcggggagccgccccaagggcgtcagaacaactggatcatgcacgagtaccgcctcggggacgtcaaacgcttcggccgcgcaagaaagaagacaacaacgcgctcaggctggatga

SEQ ID NO: 27732 - protein, 98 aa, Zea mays
  misc_feature: Ceres CLONE 1401175-F
  misc_feature (9)..(99): Pfam Name: NAM Pfam Description: No apical meristem (NAM) protein
  misc_feature (33)..(33): Xaa is any aa, unknown, or other
  misc_feature (48)..(48): Xaa is any aa, unknown, or other
  misc_feature (58)..(58): Xaa is any aa, unknown, or other
MDCGGSLQLPPGFRFHPTDDELVMYYLLRKCGXLPLAAPVIAEVDLYXVDPWQLPEKXVGGEKEWYFFSPRDRKYPNGSRPNGAAGTGTGRPPAPTSR

SEQ ID NO: 27733 - DNA, 724 bp, Zea mays
  misc_feature: Ceres CLONE 1401176-F
  misc_feature: Encodes the peptide sequence at SEQ ID NO. 27734
  misc_feature (30)..(30): n is a, c, t, g, unknown, or other
  misc_feature (41)..(41): n is a, c, t, g, unknown, or other
  misc_feature (46)..(46): n is a, c, t, g, unknown, or other
  misc_feature (48)..(48): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
gtgttgggggggtttttgtttgtgcacgtnccccacaaacnccacncnccatgttcttaccatnnnnnntaaaaatggagctccccgcggtggcggccgctctagaatagtggatcccccgggctgcaggaattcgcacgagaccattacctagaacatcctaatcgaaaacttcagtaatcagtgctcgctagcccaccacgccctgaacctagcccggacaccagccagaacaggccatgtccatgggctccccggtgcagctcaggcggctgaagcctctgtaccagttcgtggtgaacaacatcctggccatcgtggccgtgccgttcgccaccgcggtcctgctcaaggcgtcgtcgctcgggcccgaggagatcctggcgctccggccggggcacctgttcctgggcgcgttcctgcctgccgcggacaaaggtgttgaaaccggatgcctccgcccgctcactgaggaactggatcaactaagggggggtttcgggaggcggacaaaacccccccccccccacattcgacacccttccggttaaatcttcctatctgatgctcggtagtttgagcaaaggagaaaggactgataagaccaagcgaccataaaacgcccgataagccccccccccccaccgcctacccctttgtcgctcccttcctgtaaatatcccccgcgccggtcccggaaggggggagaggcgaggtagagaaa

SEQ ID NO: 27734 - protein, 103 aa, Zea mays
  misc_feature: Ceres CLONE 1401176-F
MSMGSPVQLRRLKPLYQFVVNNILAIVAVPFATAVLLKASSLGPEEILALRPGHLFLGAFLPAADKGVETGCLRPLTEELDQLRGGFGRRTKPPPPHIRHPSG

SEQ ID NO: 27735 - DNA, 645 bp, Zea mays
  misc_feature: Ceres CLONE 1401177-F
  misc_feature: Encodes the peptide sequence at SEQ ID NO. 27736
  misc_feature (645)..(645): n is a, c, t, g, unknown, or other
gctctagaactagtggatcccccgggctgcaggaattcgcacgagaccattacctagaacatcctaatcgaaaactcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatggtggtggcgtcggtgctccaagaccggtgtcgacggcctcccgccggggcctccgggttggccggtggtggggaacctgttccaggtgatcctgcagcgactgcccttcatgtacgtggtgcccgacctccgggaaaagaacggacccgtcttcaccggtgcggatgagacaccgcaccctcatcgagaccacctcggtacacctcatccacgacgcgcctggtgaagcaggtcccatggtgggggtggcaatataagatcagccccaaccggcgcgcatttaaagtccgccaagctgcgcggccgaattcggtggcctaccggcaccccttggggggaaacatgggggaaaatcacacaacaaaaacggagggggggcaaccctagaaaan

SEQ ID NO: 27736 - protein, 38 aa, Zea mays
  misc_feature: Ceres CLONE 1401177-F
MYVVPDLREKNGPVFTGADETPHPHRDHLGTPHPRRAW

SEQ ID NO: 27737 - DNA, 676 bp, Zea mays
  misc_feature: Ceres CLONE 1401178-F
aagctggagctccccgcggtggcggccgctctagaactagtggatcccccgggctgcaggaattcgcacgagaccattacctagaacatcctaatcgaaaaaaacaggcacaggctccctcctccactgtccagtgtccactcctcgtcccgagaagcagacaaagcgcggcgctgcagatttcggtacggttcccaatgcctcccatgcccgccgtcgtcccgtgctagcacccggcgccgctcctccacctgccgcgtcgcgccgcctggatccggcgggcacgtggctaggagcctcagatccgggcgaaacccagccttccgtgcggacgtcttcactctacctccagactggcggctgccatttccccccctcttcttgctgtttttttttgtggggggtggggggtggaatctgcggtggagtcttgccgtcgctcgctgtaaacgtagagctctctctctctcttggcgagtaatcctggttcttgctccatttccgtgtagtgctggcgtgtgagtggcaagtttacgtgtaaatgtggaacagttctgagcagctgccccggagtcgtcggctccgggactcggacattgcagcagtgcgccggatacaggcacgagcagtggcgagcatcccgcgggccgcccccggctccgccatcggcgatgtc

SEQ ID NO: 27738 - DNA, 571 bp, Zea mays
  misc_feature: Ceres CLONE 1401179-F
  misc_feature (178)..(178): n is a, c, t, g, unknown, or other
  misc_feature (291)..(291): n is a, c, t, g, unknown, or other
caaagctggagctccccgcggtggcggccgctctagaactagtggatcccccgggctgcaggaattcgcacgagaccattacctagaacatcctaatcaaaaagatctacctggtctgttcttcgatcgagtctgagagatttgggaggaggagggaaacaaagcgaaagagcccatnctttttttgtctttttggttcgggtttccgtggttggcttctttttggaccccccgcggagaagcccaccggtttcttacaaaaacccaatctttgctggcttctccacgggnccaaaaatcaatgggtttcccaatttgggggtcccgggttctgggttgggaaaatcggggggggcgcaaagttttccccaaaccccccctttgtggggaaatttccccaaaaaattttattttttttttggggggccagggggggaaaaaatttttttttaaaaaaaaaagggcaaaggggggggggggcccccaaaaaaggggggacccccccccccccggggaatttttaaaaatttttgggggggggggaaaccaccggggggggggccccccccaa

SEQ ID NO: 27739 - DNA, 751 bp, Zea mays
  misc_feature: Ceres CLONE 1401180-F
  misc_feature: SWISSPROT Homolog: EC 2.7.1.90 Diphosphate--fructose-6-phosphate 1-phosphotransferase
  misc_feature (329)..(329): n is a, c, t, g, unknown, or other
  misc_feature (346)..(346): n is a, c, t, g, unknown, or other
  misc_feature (358)..(358): n is a, c, t, g, unknown, or other
  misc_feature (379)..(379): n is a, c, t, g, unknown, or other
  misc_feature (384)..(384): n is a, c, t, g, unknown, or other
  misc_feature (386)..(386): n is a, c, t, g, unknown, or other
  misc_feature (388)..(388): n is a, c, t, g, unknown, or other
  misc_feature (389)..(389): n is a, c, t, g, unknown, or other
  misc_feature (417)..(417): n is a, c, t, g, unknown, or other
  misc_feature (424)..(424): n is a, c, t, g, unknown, or other
  misc_feature (510)..(510): n is a, c, t, g, unknown, or other
caaagctggagctccaccgcggtggcggccgctctagaactagtggatcccccgggctgcaggaattcgcacgagaccattacctagaacatcctaatcgaaaaaatcgaaaccaacagtgaatcagccggcgccgcagcatgcctgtacctctcggctctcgctcttatccccacccacctcgctttctcccctctacaagaaagcgaccaccgctgtgaatcagcagagctgcagtgagagcaagtgagaggatcagaggaggcatccgtgaccaaagatcgagtagccaagaagaagagagatgaacgccgactttcgcgcgcccnaggagctcgcgggaggnctgcagcagcgncgggccctgtaccagccccgnctccngncnnatgctcagggacccgacgtaaagggcgnagtacgntgacgcgaccacaccatcgatcccacctgggccaaagcgtcggggaggcttcccggaaacctttgggcaggcgttcaaaattttcntcgggccggcccccgggcccggggccctttagagagccccccacaatccgggggggcgggggggttctccggggaggagacccccggggaggcaaaaaacccctggggggccccctgggcgctttaaggccccaacccccaaagttggctctagaattccccgggggccccggagggatttttttaaaaaaaagtgggggaaaccaaaagggtttttttgttttaaaaaaaaaaggggggt

SEQ ID NO: 27740 - DNA, 643 bp, Zea mays
  misc_feature: Ceres CLONE 1401182-F
  misc_feature (205)..(205): n is a, c, t, g, unknown, or other
  misc_feature (208)..(208): n is a, c, t, g, unknown, or other
  misc_feature (209)..(209): n is a, c, t, g, unknown, or other
  misc_feature (226)..(226): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
tggagctcaccgcggtggcggccgctctagaactagtggatcccccgggctgcaggaattcgcacgagaccattacctagaacatcctaatcgaaaatcttttcctttcctatccctcgtctcgtctcgtcttcgttcccctttcctcctgcgcaccccgtcttctccctcacgcgtcaaaccccagaaaaaataaacgggcggncgnnctcgttccccttccgtnccgaataagccggccggggtgccaaatccgggcgatcccccctccattccgccgaaaagcgggggcccttggcccaaaccccaagttaagcaattttaagggaaaggggtttggaaactccaaagaagggggcccaaaggagaaaaggcggaaaaaattcaggggggggtcccctctaaagaaaggggggggggaaattttaaacccctttcgaaggagaaaaaaccccccgattatggggggggttcccccccgtttttcccggaacctcccccgcgggggaagaaaaacggggccccccccaagggggggggggggggggggggggaaaaaaaaaaaagaaaaaaaacttcccccccccccaaaaaaaaaaagagagagagggagggggnnnnngagtggggagagggagatccg

SEQ ID NO: 27741 - DNA, 847 bp, Zea mays
  misc_feature: Ceres CLONE 1401183-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
nnnnnnnnnnnnttttnnnnnnaaaaaacctccgagcgcttgccgccccacagctggagctccccgcggtggcggccgctctagaactagtggatcccccgggctgcaggaattcgcacgagaccattacctagaacatcctaatcaaaactccctcctcttgtctattcttcttctccagtgcaaaccggcgcttctcgcgccgtccttccccttctccttgcgcaggttcaggcctgaccgcctgagaaactggaaggtggcggcgacctcgggggttgatcggcgacttgggtcggattagtttccggaagagcactggaggagaaggcctgtttggagcaaatttcgatggcaaccggcgagaccgccgtggatcgtcgcaaggaaccctctcggtccccgcgacatggaatttggcaagggggaggaggaacgtccccaagggggcggaaagcccgtacaccgatcaccgaagtcaccgcgtagaaactgggaccggaagaacgaaacaaccccggcgggttcccctgggagggcccctggcaagcttgccacgggtccgccgccttggccgcccaccattaccaaagaagcacctttctggcccccaaaaaactggcccgtggcaaaatcccgggagaccccacccggcaaaaagtttcttctcacccagaggtttgccccaaagacctcatcccgccaaggaatggaacaccccctccttgcgggggcggtccgcgccgcgttaatcccaaggttccccttccgcctcatgtcccccaaaaaagaaaacccctggcgccacccgtttaacccgccgctaaaggggggaacttgggcgtag

SEQ ID NO: 27742 - DNA, 783 bp, Zea mays
  misc_feature: Ceres CLONE 1401186-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (30)..(30): n is a, c, t, g, unknown, or other
  misc_feature (31)..(31): n is a, c, t, g, unknown, or other
nnnnnnnnnnnnnnnnnnnttttagcagannaattgttatgcacaccaagctggagctccccgcggtggcggccgctctagaactagtggatcccccgggctgcaggaattcgcacgagaccattacctagaacatcctaattgaaaacttccaatttttctcccaaataaaaaccagccgcagcgggaggtggcgcgacgcgaacccacccaccctgcgaacccggccgcaaaattctcctctcggattccgccgccgcgaaccgtcccctcgacgaggctgctgcgatagatttttcttaccattcgaatagttgatgagcgagaatacagagcaagaatcttgatggtgcgtgtggtacaacttggttaaggaaagctgactgcttgaagtgaccatgttggaccatcttgctatcattgcgtgctgaggttaggggacgacgcaccggattttggaggtgatggcatcgacaacctcagcgagaacgatgtcagcgactaggagatcgaattgctgaccagctcgcccgacgaatgtggaaagaacaaggtcaagctaaaagagggacagggagaggcagcaaaaagtttggccctgcagccggttggagctgggagaaggaccaggacaaaagaagatttccgaaccaaggccctcccggaaaaaagatgaactagggggcccaggaaacgggaatccctccaaggaacattggctcaagggttggtgggaaggtgtgggcaaatggcccccgaagggcttccgggggaacggcggat

SEQ ID NO: 27743 - DNA, 684 bp, Zea mays
  misc_feature: Ceres CLONE 1401187-F
  misc_feature (232)..(232): n is a, c, t, g, unknown, or other
  misc_feature (274)..(274): n is a, c, t, g, unknown, or other
  misc_feature (421)..(421): n is a, c, t, g, unknown, or other
  misc_feature (443)..(443): n is a, c, t, g, unknown, or other
aagctggagctccccgcggtggcggccgctctagaactagtggatcccccgggctgcaggaattcgcacgagaccattacctagaacatctaatcgaaaaaacccattgcatttgcaagcccttttacattgcagagcgccagagcctcgctcgctctcggaacagagctaggcagctaacagacgaagaagaagcaagccaagcagaattgagagagaggcgaggacgtgncgacgacggcagccgcgatggcgacgacgacggacctggggntcgagggcgacgagctccgcctgggcctgcccggcgggggagtggaggggaccgcgcctgggcggcgagggaagagctcttcctccgcctccggcaagagggcttcgccgagacatcgacctgaaactgaagctggaccagcggcgncctggaaagccggaggaggaanaagaggaccccggcgttgctgttcccccttgagaaggaagaggagcccggaaaaatgaagggtccccgagccaaaagagggtccccgccgcccccccccgcggggtggttgcccccccccaaaaaccccccgcccccaagcttcggggggggaaaggcccccggcccggtctttcccgaaaaaaatctgggcccgggaaacccaacaaggcgcccgaaaaaaccccccccccccccaaggg

SEQ ID NO: 27744 - DNA, 644 bp, Zea mays
  misc_feature: Ceres CLONE 1401189-F
  misc_feature (212)..(212): n is a, c, t, g, unknown, or other
  misc_feature (262)..(262): n is a, c, t, g, unknown, or other
  misc_feature (285)..(285): n is a, c, t, g, unknown, or other
  misc_feature (380)..(380): n is a, c, t, g, unknown, or other
  misc_feature (381)..(381): n is a, c, t, g, unknown, or other
cagagctggagctccccgcggtggcggccgctctagaactagtggatcccccgggctgcaggaattcgcacgagaccattacctagaacatcctaatcgaaaaagctccaggagcagcaccaatcccccaagccgccatggccgccgacccacgctgctgcttctcgtacctttctcgccatcccctctacttcttcttggcacagacgtangacgcacgcggggcgcgcggctcccgcggggcgtggcgctgccgtggtcnggcactgcatcactagccggggnctcccgaccgcgtatggcggactggcgagggccacggcccgtcattatgttccggtccgggagtcccccgggggggggctcctccccggccccgnnccccaaggaaattcaaccccaaaaggggttttcgtttgggcccataggccccggttccccgttttgttccccggggccaagggaactctttttttccccaaaaggaaaaaatggggcccccccccccgggggtttcccccaaaaagttttccccccccccgggggaaaaaatttctcccccggggggagaaaaaaaaccccccccggtttgttcccctccccccccaaaaaggggggcgccccccccctccccgaaaaaaaat

SEQ ID NO: 27745 - DNA, 789 bp, Zea mays
  misc_feature: Ceres CLONE 1401190-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (22)..(22): n is a, c, t, g, unknown, or other
  misc_feature (44)..(44): n is a, c, t, g, unknown, or other
nnnnnnnnnnnnnggggttttnaaaatagaaaatgttgggtgtntatatgtattttcttctttaaaactgtgactccccgcggtggcggccgctctagaactagtggatcccccgggctgcaggaattcgcacgagaccattacctagaacatcctaatcgaaaagacaccttctccgttcccgacgactcccgtgagcgtggagcggcgactaggcgaggccatggcctccggcatcggctccggccagcagcaacccccagcgccggcggcagatgctgacccgggagccgtcggcgacaagctcgtcttcgaaagcgcggctcagcccgtgagggaaggactacgtccagaacgccggccaggttctcttccacccccagggtcaggggttcccccggtcgttaaagggggatccctcctccaaaaaaaagggcccttaaccccggaggaaatcggacaagggcctccccaaagggttccccgaaccctcaaccccgagaatatgggggtaccctctttcccccggagaaggaggggtcaacagcccaaaatcaataccccgggggggggggggaaaccccttaatgtcgcccggaaaaaactctgggttcccccccacaaaaggtgggggcggggggagccctctttccagaggggggcccacgggtttgtctgggggaaccaataattttttgggggggggggggggctcatcgatctggggggtatgaggggaggaaggaggggggtgttttatataaaaaaaagagggcggcgccccccccg

SEQ ID NO: 27746 - DNA, 644 bp, Zea mays
  misc_feature: Ceres CLONE 1401191-F
ggagctcaccgcggtggcggccgctctagaactagtggatcccccgggctgcaggaattcgcacgagaccattacctagaacatcctaatcgaaaaacacaccccacatcacaacagctccctctgcatctccgcctcgtcgccgtcgtctggctgcacaccttctttctcatctctctctcttcttccgctgccaccctccccagaacgaggaaaggaaagcccacccagaatttccgtcccgttcccgggccggcgtcccttttaataatggaatcggaattgggatttgggttttcccgaaaggggcgaaaaaaccccttaagggaagggcaaaaaattggtttttacaacccaaaaaaaaaattttttggggggatttttgggaaaaaaaaaaccccaaaaactttttttttttttgccccccctttgtggggttttcaaaacccaaaaaaaaaacgttttccccccccccgggtttttaaaaaaaaggggggaaacaagggggggggcacccacccctttttaaaaaaaaaccccggggggggggggaggggggagaatcccccccccccccccccccccttgggggggaatatttttttttttttcggagaaaaaaaaaaaaaccccccctttttgaa

SEQ ID NO: 27747 - DNA, 684 bp, Zea mays
  misc_feature: Ceres CLONE 1401192-F
  misc_feature: Translation starting site: 160
  misc_feature (504)..(504): n is a, c, t, g, unknown, or other
  misc_feature (505)..(505): n is a, c, t, g, unknown, or other
  misc_feature (532)..(532): n is a, c, t, g, unknown, or other
  misc_feature (534)..(534): n is a, c, t, g, unknown, or other
  misc_feature (537)..(537): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (544)..(544): n is a, c, t, g, unknown, or other
  misc_feature (545)..(545): n is a, c, t, g, unknown, or other
tccccgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagaatcaggttcgagagtctcactgacaagagcaagctcgatgcgcagcctgagcttttcatccaccttgtcccagacaaggccacgaacacgctctccatcatcgacagcggcatcggcatggaccaagtccgaccttgcaaacaacctcggaccatccggccaggccggggacccaaggagtttcatggaagcccttgttgcccggnngctgatggtgtcaaggattggcccagntnccncnnnggnncgtttcctacttctgcctaccctcgtcgcccaaaaataaaagtttgtccgtgaacacccaagccacaacgaatgaccgagccaagaaccgtgggtggggaggtcccaaagggggggggcggggttccgttccacctggt

SEQ ID NO: 27748 - DNA, 702 bp, Zea mays
  misc_feature: Ceres CLONE 1401194-F
  misc_feature: Encodes the peptide sequence at SEQ ID NO. 27749
  misc_feature (468)..(468): n is a, c, t, g, unknown, or other
aagagctggagctccccgcggtggcggccgctctagaactagtggatcccccgggctgcaggaattcgcacgagaccattacctagaacatcctaatcaaaactgtccctccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcggccccgagccgtcgcgcggtcgcctccacatctcgtcgtgctttaaggtctttggcctccgccgttcttggacaggggcacaccactgtccaccggtgcccactacgcgaaatacgagtccctcgtgcggctccgtagggtggaagagatccatcaggcggtgagtgggaggggcggcgtccacacaaccggaggggaggggggcaatggcggncgtggcaggcccactctgcacgtggctcgtcgccgcgtgcttatctgcggcatgcgacgctgaagagcacaagcagaggcttttctgcccggcggaaaccggcctgggggcgggtgtatggtcgggcagggccgccgcctccggggcgggggtcccggttttgggggcttgggaaggacaatgcctgttgccttaaagctgaaaaaaagtgctttgaaaaaaaaaaccccaatt

SEQ ID NO: 27749 - protein, 67 aa, Zea mays
  misc_feature: Ceres CLONE 1401194-F
  misc_feature (3)..(3): Xaa is any aa, unknown, or other
MAXVAGPLCTWLVAACLSAACDAEEHKQRLFCPAETGLGAGVWSGRAAASGAGVPVLGAWEGQCLLP

SEQ ID NO: 27750 - DNA, 680 bp, Zea mays
  misc_feature: Ceres CLONE 1401195-F
  misc_feature: Encodes the peptide sequence at SEQ ID NO. 27751
  misc_feature (382)..(382): n is a, c, t, g, unknown, or other
  misc_feature (448)..(448): n is a, c, t, g, unknown, or other
  misc_feature (500)..(500): n is a, c, t, g, unknown, or other
  misc_feature (501)..(501): n is a, c, t, g, unknown, or other
tccccgcggtggcggccgctctagaactagtggatcccccgggctgcaggaattcgcacgagaccattacctagaacatcctaatcgaaaaaagtctggccaggtctctcccatatcgggttctcccttcctcttcctgtttccgcgcgcgagatcgccgccccgggtgggctctagatcccgatggcctcgcgccgccgcaccctgctcaaggtcatcatcctcggcgacagcggggttgggaagacgtctttgatgaaccaatatgtgaacaagaagttcagcaaccagtacaaggctacgattgggggcggatttcctcaccaagggaggtggcagttcgaggacaggctcttcactctgcaaatatgggacactgctnggtcaggaaagggtttcagaagtcttggcgttgcattctaccggggagcaggattgttgtgtcctnagtctatgatgttaattcctatgaaatcgttttgataatcttcacaactggnncgtgaagagtttctaattcaggcggagcccatcagatcctgacatttttccctttttggtctgttgggtaacaaagttgatggagatggggggaacagcccgggtggtgtccgaaaaaaaggaaaaggcttggggcccccctaaggggaaatcccgtatttttgaacgctggtaaggag

SEQ ID NO: 27751 - protein, 99 aa, Zea mays
  misc_feature: Ceres CLONE 1401195-F
  misc_feature (10)..(100): Pfam Name: Ras Pfam Description: Ras family
  misc_feature (67)..(67): Xaa is any aa, unknown, or other
  misc_feature (89)..(89): Xaa is any aa, unknown, or other
MASRRRTLLKVIILGDSGVGKTSLMNQYVNKKFSNQYKATIGGGFPHQGRWQFEDRLFTLQIWDTAXSGKGFRSLGVAFYRGAGLLCPXSMMLIPMKSF

SEQ ID NO: 27752 - DNA, 686 bp, Zea mays
  misc_feature: Ceres CLONE 1401198-F
  misc_feature: Translation starting site: 233
  misc_feature (472)..(472): n is a, c, t, g, unknown, or other
aaagctggagctccccgcggtggcggccgctctagaactagtggatcccccgggctgcaggaattcgcacgagaccattacctagaacatcctaatcgaaaaattccaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggcgcgctgcagctcccgcctggggtccgcttcccacccaccgatgacgagctggtgatgtactatctcctccgcaagtgcgggggcctgccgctcgcccgcgcggtcatcgccgaggtggatctctacaagttcgacccatggcagctcccagaagaggcgtttcggtggggagaaggaatggtacttcttctcgccgcgcgaccgaaagaaccgaatggctccggnctaacccggcgggccgggacaggtaacggaaaggccaccggggccaaacaacccgtaaggtcccccccccccccgggccattaaaagggggttcggtttctcacccgggaaagccccccaagggggtaaaaaccaatgggtttttggaccaaaccccgccccggggaaggtaaaacggtttgggccgcgcgaagaaaaaaaaaaccaaaaagcg

SEQ ID NO: 27753 - DNA, 660 bp, Zea mays
  misc_feature: Ceres CLONE 1401200-F
  misc_feature: Translation starting site: 171
  misc_feature (316)..(316): n is a, c, t, g, unknown, or other
  misc_feature (469)..(469): n is a, c, t, g, unknown, or other
  misc_feature (480)..(480): n is a, c, t, g, unknown, or other
  misc_feature (487)..(487): n is a, c, t, g, unknown, or other
  misc_feature (572)..(572): n is a, c, t, g, unknown, or other
  misc_feature (593)..(593): n is a, c, t, g, unknown, or other
tccccgcggtggcggccgctctagaactagtggatcccccgggctgcaggaattcgcacgagaccattacctagaacatcctaatcgaaaaaactacggtaactcgtctgctcgcatttcctcccaatccatcccgcctccaaacccgaactccaagtcgccccgcatcgatggcgcccaaggccgagaagaagcccgcggcgaagaagccggcggaggaggagcccgcggccgagaaggcgccggccgggaagaagcccaaggcggagaagcgtgtcccagcgggcaagtccgccgcaagggagggcggtgaggnaaaagaggggccggaagaagggcaagaagagcgtggagacttacaagatctacattttcaaggtgctgaagcaagtgcacccggacatcggcatttcctccaaggccatgtccatcatgaactcccttcatcacgacatcttcgagaagctcngctgccgaggncgcaggnctcgcgcggtacaacaagaaagccacatcaccttccgcgagatccagacttccgtgcgctcgtcccttccccggggagctcgccnagcacgcccgtcttcgagggnaacaagcccggtcacaagtcacctcggtctaagctgcgaaacctcccggttgcaggttcccccgtag

SEQ ID NO: 27754 - DNA, 706 bp, Zea mays
  misc_feature: Ceres CLONE 1401203-F
  misc_feature: Encodes the peptide sequence at SEQ ID NO. 27755
  misc_feature (521)..(521): n is a, c, t, g, unknown, or other
  misc_feature (565)..(565): n is a, c, t, g, unknown, or other
  misc_feature (567)..(567): n is a, c, t, g, unknown, or other
  misc_feature (574)..(574): n is a, c, t, g, unknown, or other
  misc_feature (595)..(595): n is a, c, t, g, unknown, or other
  misc_feature (619)..(619): n is a, c, t, g, unknown, or other
  misc_feature (620)..(620): n is a, c, t, g, unknown, or other
  misc_feature (625)..(625): n is a, c, t, g, unknown, or other
  misc_feature (628)..(628): n is a, c, t, g, unknown, or other
  misc_feature (678)..(678): n is a, c, t, g, unknown, or other
aaagctggagctccccgcggtggcggccgctctagaactagtggatcccccgggctgcaggaattcgcacgagaccattacctagaacatcctaatcgaaaaaacccgtctgcgctttctcgtagccttcctcccgtcctgccggcagctgccaccgccagccggtgtaggaacactgggcctctgatccctgtaccatcagctcagcattccccgtcatacaccaattcacaacccaaagaccctgaacgcatttacctcagcgccaccgccgccgccgcgagtgcagaccatgacgccgacctctccctcactcccgatgggaggccccgttccccgccgccgcctccggcgcgccggcgccgtcgcggtctccgacgatcccaaactcaagaagcacagcgcgcgcatcacggagcccaagtcgcagagcgcctcgcaggccgcgctctacggggttgtgctcagcgacgcctacctctgtcagccgtacaacagaatgaacttggggtggtacgacntaagcccttggtcaagctccagaaccgcctcaagaagttcgccngnggagtcncccgaagagccgtgcagggcnattatcggatcgaccacgaacggnntctcnagntgtgcacacaccatgctttcaccaagaaaattttagtttaccaccggagnatgccccagacttaagtcagcatcggga

SEQ ID NO: 27755 - protein, 123 aa, Zea mays
  misc_feature: Ceres CLONE 1401203-F
  misc_feature: SWISSPROT Homolog: EC 4.2.1.9 Dihydroxy-acid dehydratase
  misc_feature (77)..(77): Xaa is any aa, unknown, or other
  misc_feature (92)..(92): Xaa is any aa, unknown, or other
  misc_feature (110)..(110): Xaa is any aa, unknown, or other
  misc_feature (112)..(112): Xaa is any aa, unknown, or other
MTPTSPSLPMGGPVPRRRLRRAGAVAVSDDPKLKKHSARITEPKSQSASQAALYGVVLSDAYLCQPYNRMNLGWYDXSPWSSSRTASRSSPXESPEEPCRAIIGSTTNGXSXCAHTMLSPRKF

SEQ ID NO: 27756 - DNA, 735 bp, Zea mays
  misc_feature: Ceres CLONE 1401205-F
  misc_feature: Encodes the peptide sequence at SEQ ID NO. 27757
  misc_feature (483)..(483): n is a, c, t, g, unknown, or other
  misc_feature (503)..(503): n is a, c, t, g, unknown, or other
  misc_feature (535)..(535): n is a, c, t, g, unknown, or other
  misc_feature (585)..(585): n is a, c, t, g, unknown, or other
  misc_feature (654)..(654): n is a, c, t, g, unknown, or other
aaaagctggagctcaccgcggtggcggccgctttaaaacaagtggaacccccgggctgcaggaattcgcacgagaccattacctagaacatcctaatcgaaaaaagcctctcaattccaactccatcgcaacagcctatcgagtccccgaacagtcctgcgcgcgtccgcaatggcggagacggccggcgcggctccagcacagcagcccgctagagtagctacgacgacgacgaacagcgatgtctccacgtgggcgtggttgcagcaggtccttcgcgctgctgttcccgtccagccttcgccgcgaaggccgcgctgtttgcgctcgtggtggcgctgctgccgcttgctgccgtcggggcaggcgcccaggatctgggagctgccgcacctcctcctgctcggcattcatcatcttcctacggcgtcttcggccagaagaacgccgaacgccgaggtggccaccgctgcctacgccagncccgtcgacgtggaaagcgntcggtggaggcctacgtctccaggatgatganggggcttcgctttgtcttcgacgaaaacaccggcaacgatggcccccacnagggatggcagcgtcaacaagcaggcgtggaagctctcggtaccttccaacaaccggcttttcgggggntcgtcgcggacccttcagcgccagggaccaacagcggcaacgcaccccccaaaccgggggttggggaaagccaaccactcc

SEQ ID NO: 27757 - protein, 119 aa, Zea mays
  misc_feature: Ceres CLONE 1401205-F
  misc_feature (104)..(104): Xaa is any aa, unknown, or other
  misc_feature (111)..(111): Xaa is any aa, unknown, or other
MAETAGAAPAQQPARVATTTTNSDVSTWAWLQQVLRAAVPVQPSPRRPRCLRSWWRCCRLLPSGQAPRIWELPHLLLLGIHHLPTASSARRTPNAEVATAAYAXPVDVESXRWRPTSPG

SEQ ID NO: 27758 - DNA, 692 bp, Zea mays
  misc_feature: Ceres CLONE 1401207-F
  misc_feature: Encodes the peptide sequence at SEQ ID NO. 27759
caaagctggagctccccgcggtggcggccgctctagaactagtggatcccccgggctgcaggaattcgcacgagaccattacctagaacatcctaatcaaaacactcgggttggttagaagaacccaatgcaagtgtgagtgagctgacggtacggcggacgcgctcgcctctcctctcctctcctctcctcttcttccggctctccctctccgcatgccattccaacgcattaccggtatttttagccgccggaggagacgggtagctgcgtagccactagcgagagagagagggaggggagaaaccatagctcctggccgttctgcctgaccatccaccgcggcgccggccgtccgtctcccgtccacatccctcctcctctcctgcaaggttcctgtgcgtaacgcagaggggtcggagtcggagtcggagtcggagaagatgatgggcgggttcctctccagggtcctcctgttggcttttggctatgcctatcctgcctacgaatgctacaagactgttgaactgaacaaaccagagattgcgcagctcatattttggtgtcagtattggattttagctgccctgttgacagttttggagagattcggagatttcacaatatcatggctaccggtctactcggaagcacagctgatggtctttgtatacttgtggtaccctaagaca

SEQ ID NO: 27759 - protein, 83 aa, Zea mays
  misc_feature: Ceres CLONE 1401207-F
MMGGFLSRVLLLAFGYAYPAYECYKTVELNKPEIAQLIFWCQYWILAALLTVLERFGDFTISWLPVYSEAQLMVFVYLWYPKT

SEQ ID NO: 27760 - DNA, 691 bp, Zea mays
  misc_feature: Ceres CLONE 1401209-F
  misc_feature: Encodes the peptide sequence at SEQ ID NO. 27761
  misc_feature (319)..(319): n is a, c, t, g, unknown, or other
aagctggagctccccgcggtggcggccgctctagaactagtggatcccccgggctgcaggaattcgcacgagaccattacctagaacatcctaatcgaaaagtccgccccccgccaccaccgcactcccatccagatgggagtgcgcaagaggagctttcggcattccggtctcgctcgacaaccgggatccccgtgagagtccccacccacaccccgagggcggcgtcgggtcgtcggggacagctgatttcacaagacgagccggcgagccggccggcatttcgtcgtcggatggcgccggcctcctcctcgtccgncggggtcgggtgcctcggcctgctcctgctcctggtcctcgccggggcctccggggggacgggtcgttccaggtaggcgggctctggcaatgacccatggaacggtatatgggcccatggcgaaggttgctcgcccaccctggaatcccgagaacaactctctgggtgggtggggggaggactccccggaggaaccccttccccaactttacggggaaaggggggggtggaaatataagcgacaagcactaagtgggtttccgggacagaaaacgggggggcgcctttttcttaaggggcgggggggtgggtttctccggttttggggggccaaaatggtccccacatcccccggggggggggtggtgggtt

SEQ ID NO: 27761 - protein, 33 aa, Zea mays
  misc_feature: Ceres CLONE 1401209-F
  misc_feature (9)..(9): Xaa is any aa, unknown, or other
MAPASSSSXGVGCLGLLLLLVLAGASGGTGRSR

SEQ ID NO: 27762 - DNA, 692 bp, Zea mays
  misc_feature: Ceres CLONE 1401211-F
  misc_feature: Translation starting site: 225
  misc_feature: Pfam Name: Exo70 Pfam Description: Exo70 exocyst complex subunit
  misc_feature (219)..(219): n is a, c, t, g, unknown, or other
  misc_feature (366)..(366): n is a, c, t, g, unknown, or other
  misc_feature (386)..(386): n is a, c, t, g, unknown, or other
  misc_feature (387)..(387): n is a, c, t, g, unknown, or other
  misc_feature (397)..(397): n is a, c, t, g, unknown, or other
  misc_feature (406)..(406): n is a, c, t, g, unknown, or other
  misc_feature (407)..(407): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (415)..(415): n is a, c, t, g, unknown, or other
  misc_feature (416)..(416): n is a, c, t, g, unknown, or other
  misc_feature (427)..(427): n is a, c, t, g, unknown, or other
  misc_feature (504)..(504): n is a, c, t, g, unknown, or other
aaagctggagctccccgcggtggcggccgctctagaactagtggatcccccgggctgcaggaattcgcacgagaccattacctagaacatcctaatcgaaaaaagtagtcaagtctcaaccacctccccaagccgcgtggagccctcatccagatcggagccagcgcgccgtgtgatgccgttccggccgtgggagtagctgtcttgcccccgacccangagccatggcggaggatggcgaggagaagctgctcgcgacggtgcagcgcatcgttcagacgctggggagcagcgacaccatgacagaggacatcctcaaggtgttctccaactacgacggccgcctctcgctcgacaagttctacngcgcgcgcgccgcgctggcnnggttgttggncggaagaannagnnnnannagaaattgtancagagcgctcgatgccgacgtcgccgcccgcgggggggggggtgccggccaccgggccgaggccacggttgacgtcnatggagcggaccgtgcgcgcgctggaccggcagatctcgcagttcgtggccatggaccggctgatttggcggactccgccgacgcggaacgcgttctggaggcggtcgacaatctcatcggaaccgtggaggaactggaccccgggggaaacaaccgggccctggttcaaccgggccgacaaactgtt

SEQ ID NO: 27763 - DNA, 682 bp, Zea mays
  misc_feature: Ceres CLONE 1401212-F
  misc_feature: Encodes the peptide sequence at SEQ ID NO. 27764
  misc_feature (315)..(315): n is a, c, t, g, unknown, or other
  misc_feature (316)..(316): n is a, c, t, g, unknown, or other
  misc_feature (432)..(432): n is a, c, t, g, unknown, or other
  misc_feature (433)..(433): n is a, c, t, g, unknown, or other
  misc_feature (538)..(538): n is a, c, t, g, unknown, or other
  misc_feature (553)..(553): n is a, c, t, g, unknown, or other
  misc_feature (554)..(554): n is a, c, t, g, unknown, or other
  misc_feature (682)..(682): n is a, c, t, g, unknown, or other
aaagctggagctccccgcggtggcggccgctctagaactagtggatcccccgggctgcaggaattcgcacgagaccattacctagaacatcctaatcgaaaaattggatcctatgctctcctctccctgctcgcagtcagggcacagggactgcctccggagaccggagcaggccgcaagcgtccaggttcgagacgccagcacgctctcgcagtacagcagcattatcagggagcgtgccgtgggagtgggaagttgcctcaggtgcggagcagtcgccggcggcgaccatcggtgtctgagatgaaggagagnnagcgctccagggcggcagtggacgagcgctacgcgcagtggaagtcgctcatccccgttctctacgactggttttgcaaccacaaccctcgttggccatccctctccctgcggtgnngggcacagtttgagaaagctacctacaagaatcgtcaacgcctttacctatctgaacagaccgatgggagtgtgcctaatactctggttatcgcaaactgtgaangtgtgaaaccaaggnntgcagctgctgaacatatctcgcagtttaacgagaagcacgatcacctttggtaagaggtacagactatagttcatcgtggtgaagtaacagaatcagggagctccacagaacagtagatcatgcccn

SEQ ID NO: 27764 - protein, 101 aa, Zea mays
  misc_feature: Ceres CLONE 1401212-F
  misc_feature: SWISSPROT Homolog: EC 2.3.1.48 Histone acetyltransferase
  misc_feature (4)..(4): Xaa is any aa, unknown, or other
  misc_feature (5)..(5): Xaa is any aa, unknown, or other
  misc_feature (43)..(43): Xaa is any aa, unknown, or other
  misc_feature (44)..(44): Xaa is any aa, unknown, or other
  misc_feature (79)..(79): Xaa is any aa, unknown, or other
  misc_feature (84)..(84): Xaa is any aa, unknown, or other
MKEXXRSRAAVDERYAQWKSLIPVLYDWFCNHNPRWPSLSLRXXAQFEKATYKNRQRLYLSEQTDGSVPNTLVIANCEXVKPRXAAAEHISQFNEKHDHLW

SEQ ID NO: 27765 - DNA, 654 bp, Zea mays
  misc_feature: Ceres CLONE 1401218-F
  misc_feature: Encodes the peptide sequence at SEQ ID NO. 27766
  misc_feature (296)..(296): n is a, c, t, g, unknown, or other
  misc_feature (319)..(319): n is a, c, t, g, unknown, or other
  misc_feature (363)..(363): n is a, c, t, g, unknown, or other
  misc_feature (453)..(453): n is a, c, t, g, unknown, or other
  misc_feature (454)..(454): n is a, c, t, g, unknown, or other
  misc_feature (490)..(490): n is a, c, t, g, unknown, or other
tccccgcggtggcggccgctctagaactagtggatcccccgggctgcaggaattcgcacgagaccattacctagaacatcctaatcgaaaagccttgaccgacgtgactacggtacggcccccaaacccggaacggcagcgaaacgacagccatgcttctccagccgatccccaccgccaccctcgccgctcgaccgagatcaagcgaagcttccttcccctttcgttgccaccgccgccgccgcgtgctcctcccagtccgcgccgacttgaccccgatctctctctcggctcgnccccccctcgcggccggccaagnccggccgtttgcaccgccgacgagctccattacgcctccgtcgnacggtgcccgggtggcgactcgcgctctggcggtacaggccaccgcgcaatgctcccgtcaggaatcacccgctgatgctgctgtccggnnagtcggacgaacgccgtcggattcgactctcacccnggggcttcgtttgcccgtcaatgtctaagcccagatttgatacatggatagtgaaaagaaaaaggtgctggtctgagcatgcggaaatatgatgattctactccatctggctcagtcattttttggagatggctcctagggtaattcaacctcttaataggacc

SEQ ID NO: 27766 - protein, 47 aa, Zea mays
  misc_feature: Ceres CLONE 1401218-F
  misc_feature (6)..(6): Xaa is any aa, unknown, or other
  misc_feature (18)..(18): Xaa is any aa, unknown, or other
MLLSGXSDERRRIRLSPXGFVCPSMSKPRFDTWIVKRKRCWSEHAEI

SEQ ID NO: 27767 - DNA, 666 bp, Zea mays
  misc_feature: Ceres CLONE 1401219-F
  misc_feature (185)..(185): n is a, c, t, g, unknown, or other
  misc_feature (218)..(218): n is a, c, t, g, unknown, or other
  misc_feature (223)..(223): n is a, c, t, g, unknown, or other
  misc_feature (238)..(238): n is a, c, t, g, unknown, or other
acaagcttggagctccccgcggtggcggccgctctagaactagtggatcccccgggctgcaggaattcgcacgagaccattacctagaacatcctaatcgaaaaactgcgcctgcggaggatcggaggaaccagtagcggaggcttcgattttcggcgggcgcaataaatttccgcatgcctcgnagggggcgggtctcgctcgtctccggtttgctnctggngagggccctgccggncggccgcccgttgcccctttgggcttggcaagaaggtggctgcaaaagggatgccaggttttttcccagggggcctttaagaggtccaccttggcccccacaaaaagggccccctccccccccccgccccttggaaaaaccaaaggcccccttataagggggaaatttttgttttccccccccccggaaaaaaatttcccccttttgggccccccaaaaggggggggggatttttcttttgggtggggggggggggaacaaaaaaaaaaatcccggcgaatatttccgtccccggggttttttttaaaaggaccggccccaaaaaaaagttctcttataaaagccccccccccccccccgggggggtgtttttttttaaaaaaaaaaaaaaaaaaaaatatttttttttttttaaaaagaaaaaaaaa

SEQ ID NO: 27768 - DNA, 700 bp, Zea mays
  misc_feature: Ceres CLONE 1401220-F
  misc_feature: Encodes the peptide sequence at SEQ ID NO. 27769
  misc_feature (1)..(1): n is a, c, t, g, unknown, or other
  misc_feature (488)..(488): n is a, c, t, g, unknown, or other
  misc_feature (559)..(559): n is a, c, t, g, unknown, or other
  misc_feature (645)..(645): n is a, c, t, g, unknown, or other
  misc_feature (647)..(647): n is a, c, t, g, unknown, or other
  misc_feature (651)..(651): n is a, c, t, g, unknown, or other
  misc_feature (682)..(682): n is a, c, t, g, unknown, or other
  misc_feature (683)..(683): n is a, c, t, g, unknown, or other
naaagctggagctccccgcggtggcggccgctctagaactagtggatcccccgggctgcaggaattcgcacgagaccattacctagaacatcctaatcgaaaagtatcgtctcctctccttcctgacattggcactggcagctgcactcaccggaagccatggaagacttgctctactactccctcaccatagccatctgcatcgcagtcatcgccctcctctccatccttcgttcgttcaccgctaccggaccgccgccggcgctcccgcccggcccgtcgctgctgtcgctgatcaccccgctcctcttcctcggccgaacgaacttcggcatcgagcggatcctctccgccgcgcggtcccgctacggccccgtcttcacgctctacctgctcccgtcccgcccggccatcttcatcgccgaccactccgtggcgcaccgcgtgctggtgcagggcggcgccgccttcgccgacaggccgccggncagcctccccttccgcctcttctccagtgaccagcgcaacatcacatccggcgcctacggcccggtctggngcgcgctccgtcacaacctcacgggcaacgtgttcccaccgtcgctcatgggccggttttgccgccgccggaccgccgaaccgtgngngggnttcctccgccgggggtcccgcgcgacgccgnnagcgggggccgtccgtc

SEQ ID NO: 27769 - protein, 180 aa, Zea mays
  misc_feature: Ceres CLONE 1401220-F
  misc_feature: SWISSPROT Homolog: EC 1.14.14.1 Unspecific monooxygenase
  misc_feature (110)..(110): Xaa is any aa, unknown, or other
  misc_feature (134)..(134): Xaa is any aa, unknown, or other
  misc_feature (162)..(162): Xaa is any aa, unknown, or other
  misc_feature (163)..(163): Xaa is any aa, unknown, or other
  misc_feature (175)..(175): Xaa is any aa, unknown, or other
MEDLLYYSLTIAICIAVIALLSILRSFTATGPPPALPPGPSLLSLITPLLFLGRTNFGIERILSAARSRYGPVFTLYLLPSRPAIFIADHSVAHRVLVQGGAAFADRPPXSLPFRLFSSDQRNITSGAYGPVWXALRHNLTGNVFPPSLMGRFCRRRTAEPXXGFLRRGSRATPXAGAVR

SEQ ID NO: 27770 - DNA, 673 bp, Zea mays
  misc_feature: Ceres CLONE 1401225-F
  misc_feature: Encodes the peptide sequence at SEQ ID NO. 27771
  misc_feature (267)..(267): n is a, c, t, g, unknown, or other
  misc_feature (311)..(311): n is a, c, t, g, unknown, or other
  misc_feature (404)..(404): n is a, c, t, g, unknown, or other
  misc_feature (536)..(536): n is a, c, t, g, unknown, or other
aagctggagctccccgcggtggcggccgctctagaactagtggatcccccgggctgcaggaattcgcacgagaccattacctagaacatcctaatcgaaaaatcttcctgctcaacatcagtagcagctttagctgtagcagcgccaccggccaccgccacgccatggccaccacgttgcacaagccccttggggcgatcaccgttgacgacctcgccgcggcggcgcctgggtcggacgccaccgcgctccacgcagcgctccggngcgcgctcgactcgcacggacccaccgaagtgtggggcgagctnctgccggtccgtgctcctgtccgtctgcccccttcgccgtccaccggatgctctactacggttgctttcggcgggggttccgtcccccacggncgcgggcctggacgccgaaccccaaaggagtctggcttgaccaatggtcggccgtgtcttcaagggggggggggaaagaaatttggatcggggacgcggaacaaggatcccatcaacaggtttcccagaccntcacaaagttctcaacgaaaacccagaagggaactgggaaaaagggttattttgggggaatggggtatcccaattcacggggaaagccctccctgcattcggggagagaaaaaactgcaaattcccggggggggcgg

SEQ ID NO: 27771 - protein, 169 aa, Zea mays
  misc_feature: Ceres CLONE 1401225-F
  misc_feature (35)..(35): Xaa is any aa, unknown, or other
MATTLHKPLGAITVDDLAAAAPGSDATALHAALRXALDSHGPTEVWGELLPVRAPVRLPPSPSTGCSTTVAFGGGSVPHGRGPGRRTPKESGLTNGRPCLQGGGGKKFGSGTRNKDPINRFPRPSQSSQRKPRRELGKRVILGEWGIPIHGESPPCIRGEKKLQIPGGG

SEQ ID NO: 27772 - DNA, 666 bp, Zea mays
  misc_feature: Ceres CLONE 1401227-F
  misc_feature: Encodes the peptide sequence at SEQ ID NO. 27773
  misc_feature (402)..(402): n is a, c, t, g, unknown, or other
  misc_feature (455)..(455): n is a, c, t, g, unknown, or other
  misc_feature (459)..(459): n is a, c, t, g, unknown, or other
  misc_feature (460)..(460): n is a, c, t, g, unknown, or other
caaagctggagctccccgcggtggcggccgctctagaactagtggatcccccgggctgcaggaattcgcacgagaccattacctagaacatcctaatcgaaaaaaaaagctggcagtgtcggtgtcggtgtcgtcgtcggcgtcggtgctggggagcgggcgagcggcgcgtcgcatgattctgtcctcctgacgtggcagctaacgattccgattccctttggttgcagtgcgacgacattgacatggacatggcgcagctggagtggctgtcggggctcttcgacgacgcatccatcccgcacgagccggcgttccccggcgcggcgcccatcatcaagagctccgcgctggcggccggcgcgctgctgccgccggacaagatgggggacgcgctgctgntccgcagctccagccccatctcggtgctggagcacggcagctttcacacgccnacgnncgtgggcgcggctgctccgcgtcgtcggagtcgttctcggcgtctcggtcctcggagtctttctcccgcagcgaagcggcgaagcccttggttgggtcggggccgggtcgcccgcaccccgtgctcgtcatacccgggggcgggcgggagcaagggctcccgccccgtcgggtacacgggggccgggggggggagggggcccccct

SEQ ID NO: 27773 - protein, 140 aa, Zea mays
  misc_feature: Ceres CLONE 1401227-F
  misc_feature (53)..(53): Xaa is any aa, unknown, or other
  misc_feature (72)..(72): Xaa is any aa, unknown, or other
MDMAQLEWLSGLFDDASIPHEPAFPGAAPIIKSSALAAGALLPPDKMGDALLXRSSSPISVLEHGSFHTPTXVGAAAPRRRSRSRRLGPRSLSPAAKRRSPWLGRGRVARTPCSSYPGAGGSKGSRPVGYTGAGGGRGPP

SEQ ID NO: 27774 - DNA, 643 bp, Zea mays
  misc_feature: Ceres CLONE 1401228-F
  misc_feature (95)..(95): n is a, c, t, g, unknown, or other
  misc_feature (209)..(209): n is a, c, t, g, unknown, or other
  misc_feature (212)..(212): n is a, c, t, g, unknown, or other
  misc_feature (246)..(246): n is a, c, t, g, unknown, or other
  misc_feature (259)..(259): n is a, c, t, g, unknown, or other
  misc_feature (271)..(271): n is a, c, t, g, unknown, or other
  misc_feature (620)..(620): n is a, c, t, g, unknown, or other
ggagctccccgcggtggcggccgctctagaactagtggatcccccgggctgcaggaattcgcacgagaccattacctagaacatcctaatcgaanaaatcccttgtcctgtcctcgaaccgtccgccgccgcgttcacatgggcgacccgccgacgctcaagaggccaagctcgagaaggccgacgacgactccacctactgcccccgnccngtctccaatgggcgcgcgcccgtacgcacaccangcgccaccgccgncataagggccgncgcgggtgacaacctgaaggaagaggatgaaatccgggaaggagggggtcatcgccctgaatgggaaccgggaaggggaagtcaaagcgtgaaagtttaagttggtccattaacaatttttcctgggaacccgggaaattaaaaattggggggagggcactccaaggttccccgggtttccaaaaaaaaaaaaccccccccaattttggggggaaaacaaagcccccgggcccccttttttgaagggaaaaaaaagccttcccccgccgccattttaaagggggttttttggggctttccgcggaacccgtaataataaaaaaggttttttttccccggcccgcaaaanttgtggggggagagggccctttt

SEQ ID NO: 27775 - DNA, 664 bp, Zea mays
  misc_feature: Ceres CLONE 1401230-F
  misc_feature: Encodes the peptide sequence at SEQ ID NO. 27776
  misc_feature (539)..(539): n is a, c, t, g, unknown, or other
ggagctccccgcggtggcggccgctctagaactagtggatcccccgggctgcaggaattcgcacgagaccattacctagaacatcctaatcgaaaacaaaacaaaacaaaacggaaatagctcgcggtcgcggtttcttgcgccactccggctcagccgccgcccgccacccgccacagccgccgcagacgagatgggcatcaagggtttgacgaaactgctggcggacaatgcgcccaaggcgatgaaggagcagaagttcgagagctacttcggccgcaaaatcgccgtcgacgccagcatgagcatctaccagttcctgatagtagttggaaggacaggcatggaaactctcacaaatgaagctggtgaagtcactagtcatttggcaaggaatgttcaaccggacaataagattactgggagcgggaatcaggccagttttatggtttttgatggcaagcctcctgatatgaagaaaacagaacttgctaaaagatactcaaaaaagagatgatgcaaccaaagatctgactganggcaggaaaaggtaggaagataaaagatgcggattgaaaaatttgaccaagagggaactgtaaagggtcacaaggcaacccccaacgaaaattgtacccgactttaagaaactttttgtgggggg

SEQ ID NO: 27776 - protein, 107 aa, Zea mays
  misc_feature: Ceres CLONE 1401230-F
  misc_feature (1)..(107): Pfam Name: XPG_N Pfam Description: XPG N-terminal domain
MGIKGLTKLLADNAPKAMKEQKFESYFGRKIAVDASMSIYQFLIVVGRTGMETLTNEAGEVTSHLARNVQPDNKITGSGNQASFMVFDGKPPDMKKTELAKRYSKKR

SEQ ID NO: 27777 - DNA, 739 bp, Zea mays
  misc_feature: Ceres CLONE 1401231-F
  misc_feature: Encodes the peptide sequence at SEQ ID NO. 27778
  misc_feature (365)..(365): n is a, c, t, g, unknown, or other
  misc_feature (420)..(420): n is a, c, t, g, unknown, or other
  misc_feature (421)..(421): n is a, c, t, g, unknown, or other
  misc_feature (436)..(436): n is a, c, t, g, unknown, or other
  misc_feature (446)..(446): n is a, c, t, g, unknown, or other
  misc_feature (447)..(447): n is a, c, t, g, unknown, or other
  misc_feature (473)..(473): n is a, c, t, g, unknown, or other
  misc_feature (499)..(499): n is a, c, t, g, unknown, or other
acaagctggagctccccgcggtggcggccgctctagaactagtggatcccccgggctgcaggaattcgcacgagaccattacctagaacatcctaatcgaaaagccaagctttcctcaaaaactcgaaaaaggaacggagaaggcgtcctcgacgactgcccatggccgccgcccggacctagccagggattgttgtctcctgagtcccgacctaccaaggcggaaagggagagggggcgcttgtggcgtcaggaaataactggaagccgagggctgagggcgagcgcagagtcgggtggttatcgctttctttttcgttttctttttccggaggggagagtattagggatgccggttgctaggncggagccgcaggagccccgggtgatcgcccatgtcgacatggactgcttctatgnntcagtcgagcagcgnaggaacccgnncgctcagggacagccgaccgccgggntgcattacaaccgctggaaaaggcgnggcttgattgccgtcagctacgaggttcgtggatttggtgggaaaaagtccatgccccgaaaatatagccaaaaaaatgcccgggaaataatcttgttcaggccccagggggccgtgggaagggtggcctttaatttttacaaaaagctggggcctaagagtttgtcaaacccttgcaaaaaaaagggaaggggaagggggtctcccctcgggcaaattttttttggcctttttgggggt

SEQ ID NO: 27778 - protein, 130 aa, Zea mays
  misc_feature: Ceres CLONE 1401231-F
  misc_feature: SWISSPROT Homolog: EC 2.7.7.7 DNA-directed DNA polymerase
  misc_feature (6)..(6): Xaa is any aa, unknown, or other
  misc_feature (24)..(24): Xaa is any aa, unknown, or other
  misc_feature (33)..(33): Xaa is any aa, unknown, or other
  misc_feature (42)..(42): Xaa is any aa, unknown, or other
MPVARXEPQEPRVIAHVDMDCFYXSVEQRRNPXAQGQPTAGXHYNRWKRRGLIAVSYEVRGFGGKKSMPRKYSQKNAREIILFRPQGAVGRVAFNFYKKLGPKSLSNPCKKKGRGRGSPLGQIFFGLFGG

SEQ ID NO: 27779 - DNA, 644 bp, Zea mays
  misc_feature: Ceres CLONE 1401232-F
  misc_feature (153)..(153): n is a, c, t, g, unknown, or other
  misc_feature (317)..(317): n is a, c, t, g, unknown, or other
  misc_feature (334)..(334): n is a, c, t, g, unknown, or other
  misc_feature (359)..(359): n is a, c, t, g, unknown, or other
  misc_feature (410)..(410): n is a, c, t, g, unknown, or other
  misc_feature (459)..(459): n is a, c, t, g, unknown, or other
  misc_feature (534)..(534): n is a, c, t, g, unknown, or other
  misc_feature (535)..(535): n is a, c, t, g, unknown, or other
  misc_feature (561)..(561): n is a, c, t, g, unknown, or other
  misc_feature (587)..(587): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (597)..(597): n is a, c, t, g, unknown, or other
  misc_feature (605)..(605): n is a, c, t, g, unknown, or other
  misc_feature (609)..(609): n is a, c, t, g, unknown, or other
  misc_feature (610)..(610): n is a, c, t, g, unknown, or other
aaagctggagctccccgcggtggcggccgctctagaactagtggatcccccgggctgcaggaattcgcacgagaccattacctagaacatcctaatcgaaaaaacttcgacccacacccacggcacggcagtcggcagcagccagcgtcgagncgcagtgccctcttgtctgctgcctcctacctccccgcccgctgccccgcgcccagtctcactcacacactcacacggtccgatcggagggggctgaggagatggagccagattcggcgacgacgaggctcgccattgctggcgcttccttctcctgggcggcnccccgcccccgcccggnccttcggggggtctcccgggggggnaggttgcccctgctccaccaatgggtgggacctctcccccccggccccccncccgggggggtttccgaaaagatttcggccgcgcgggtggccgaacggntcgcctcccgccgaatcccccgggggtggggcacagacccgaagtgggcgcccgctgtcgccgcaagcgcttttnncggtgttgtcacggggacgcggcccncgcccgcccgccccgggtggttgggngnnnnnnggncgcggggntatnncaccacgcgggggtgcctttctccggtagaggag

SEQ ID NO: 27780 - DNA, 646 bp, Zea mays
  misc_feature: Ceres CLONE 1401234-F
  misc_feature (216)..(216): n is a, c, t, g, unknown, or other
  misc_feature (219)..(219): n is a, c, t, g, unknown, or other
  misc_feature (225)..(225): n is a, c, t, g, unknown, or other
  misc_feature (262)..(262): n is a, c, t, g, unknown, or other
  misc_feature (602)..(602): n is a, c, t, g, unknown, or other
aaaagctggagctccccgcggtggcggccgctctagaactagtgatcccccgggctgcaggaattcgcacgagaccattacctagaacatcctaatcgaaaaattccatcggtcgtgaaaagaaaaagggaaacaaaccaagctagagaaaagaagaaggtactacatactagctagctagcttagctatgggcaccatcgtcgacgctgacgtcnggntctcgntgaagaggacgagcaggtcgctggtgccgcctgcgtncgcgacgccgcgggagacgctgcggctgtcggtgatccaccgcgtggcgggggctgccccaccctgtgggggcccttgcaccgggttcccccggggcggggaacaaaaaaagggaaaaaggggaaagggaaaccccgccccaagggccttgggaaaggcccttgggaaaaacccctctgggggaaaaaaaccccctttcgggggggggtttttgggggggggagaaaccagagggggggggggaaaaaaaaccggggggggggtccccccccaagaggggcctttttttttttggaagaaaaaaacccccgcgggggtttttctttgggggggggggggnccccccttttaaacaccccctggtgtgtgttttctcccagggga

SEQ ID NO: 27781 - DNA, 645 bp, Zea mays
  misc_feature: Ceres CLONE 1401243-F
  misc_feature: Encodes the peptide sequence at SEQ ID NO. 27782
  misc_feature (425)..(425): n is a, c, t, g, unknown, or other
  misc_feature (473)..(473): n is a, c, t, g, unknown, or other
ccccgcggtggcggccgctctagaactagtggatcccccgggctgcaggaattcgcacgagaccattacctagaacatcctaatcgaaaacttgctcgatgagccgccgcctccgatatcgtgcccttcctccccacgagcatgcgataatccggtcggcggtgagatgtggcattatacaggatctcctatctggcgacgagctcctgacggattcattcacctacatggagctagagaacgctaccctgtgtgagttcgagtgaaagtgtttcacccaaggtcctgctgaggtgaacattgctgccatgccatccgcggagttggtcgagaaccatagagctgatgacacagctgcgatggcgattatgatggtagacacttgcgactgcagctgcatctgccttttgcgagatatcatttgngtctgactcaagaaatacgtcaatgatctcgctgctgtgtgtgaggcnaccaagcgcatgatctccacagggtggcgagggtgcaatcaagtttcgtcctaccaagtgaggacctgcaatttttcgttgaggaggccatgaagcatgagcgtctgggtattcgcctattacgagggtggtgccactaatccaaattcctctatttaacggacggtgctaa

SEQ ID NO: 27782 - protein, 55 aa, Zea mays
  misc_feature: Ceres CLONE 1401243-F
MSRRLRYRALPPHEHAIIRSAVRCGIIQDLLSGDELLTDSFTYMELENATLCEFE

SEQ ID NO: 27783 - DNA, 618 bp, Zea mays
  misc_feature: Ceres CLONE 1401244-F
  misc_feature: Translation starting site: 206
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (592)..(592): n is a, c, t, g, unknown, or other
tccccgcggtggcggccgctctagaactagtggatcccccgggctgcaggaattcgcacgagaccattacctagaacatcctaatcgaaaaaagtcatagggacattgcattggggaactacagaaaagggtccgaatcgaatccgtggtgcactgccccttcctcccccacaagccgccgccgccgccgtgaggactccggcgaatggcgtcccgcgtcgcctcgggcctcctccgccgccgcgccggcgccacactaggcctcctaaggagttatgcacatgtcagaagctacaacagtcaactttcagcttttggtttctgctacatctgaatgctcaaatctgccgagaagatgctattacttacctaatccctctccataccaagttttggagtaggtcatttgcttcagacacggagacaggtttgaggctggtgtgcccttcatgggtgaatctgtaactgatggaactcttgctaacttcttaaagaaactgggagacagaatccaagggttgatgaacccaatgggggcgagaaattgtggggtggnnngnnnnnnncgggggggaaagggaggggggggganaaggggggcgcgagcaaagggggaag

SEQ ID NO: 27784 - DNA, 726 bp, Zea mays
  misc_feature: Ceres CLONE 1401245-F
  misc_feature: Encodes the peptide sequence at SEQ ID NO. 27785
  misc_feature (479)..(479): n is a, c, t, g, unknown, or other
  misc_feature (480)..(480): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (532)..(532): n is a, c, t, g, unknown, or other
  misc_feature (557)..(557): n is a, c, t, g, unknown, or other
  misc_feature (594)..(594): n is a, c, t, g, unknown, or other
caaagctggagctccccgcggtggcggccgctctagaactagtggatcccccgggctgcaggaattcgcacgagaccattacctagaacatcctaatcgaaaagttcctttcttccccactacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctggcatgaaggtcctcgtcctcgacccccaaaccgttgggatggtgagcgtggtgtacagccagtcggatctgctgcggaaggaggtcttcctcgtcgagaccatggacaacgcctccagctccagggagtccatggcgcacctcaagggcgtctactttcctcgaccnntcgctannncacgtcagaagctcccgcagcacctcgcccatgcgcgcttcgncgagtaccacctattctttctcagnatattgaaggtccgccagattcaatacttgctgactncgatgaaccaggaggttgtgcagcaagttcagggagtcctatgctgatttttggggcattggcccaaaaccttttccttctcaaatacaaaaaaacccctggttttgtctccccaaagggggcacccttcct

SEQ ID NO: 27785 - protein, 128 aa, Zea mays
  misc_feature: Ceres CLONE 1401245-F
  misc_feature (76)..(76): Xaa is any aa, unknown, or other
  misc_feature (78)..(78): Xaa is any aa, unknown, or other
  misc_feature (79)..(79): Xaa is any aa, unknown, or other
  misc_feature (93)..(93): Xaa is any aa, unknown, or other
  misc_feature (101)..(101): Xaa is any aa, unknown, or other
  misc_feature (114)..(114): Xaa is any aa, unknown, or other
MVLITLVRDYIDRMLHDIPGMKVLVLDPQTVGMVSVVYSQSDLLRKEVFLVETMDNASSSRESMAHLKGVYFPRPXAXXRQKLPQHLAHARFXEYHLFFLXILKVRQIQYLLTXMNQEVVQQVQGVLC

SEQ ID NO: 27786 - DNA, 680 bp, Zea mays
  misc_feature: Ceres CLONE 1401249-F
  misc_feature (230)..(230): n is a, c, t, g, unknown, or other
  misc_feature (390)..(390): n is a, c, t, g, unknown, or other
tggagctccccgcggtggcggccgctctagaactagtggatcccccgggctgcaggaattcgcacgagaccattacctagaacatcctaatcgaaaactatcgctcataaccatagcccacaggccgccggcgcccgccagccgacgtcctcccatttcgctcccctcctccgctgcggtcgagcaaaagttccggccatccggtaatcccccggcacccggcgtctcanatcgtatgctgacctgacgcggctacaacgtcgctcctccggtctcttcgatccggtggagtccgtttctttcaagcgcgtgctcgctgagcgcctcgaggaagggaccgtcgtaccctctataaatcgagtgcccggagcacccttcctcgatgacacnacccaaagcagccacagcaggctcccttcgagggctacgtcctcccaatcctggtcgggctggggctcggtacatgcgcttcgattccattcaaagaaaaccggggaaagggcaaggaaaaggcaaaattttcatcaaagagcttccggggcgaaggcccccccggggggggacggccccaaagggaaaaaaatcgggaaacccggtaccaaccccgggagttgggcccccgagggggggggggggggcccccggggggggtcgcccccccccaaccccccaataaggaa

SEQ ID NO: 27787 - DNA, 578 bp, Zea mays
  misc_feature: Ceres CLONE 1401252-F
  misc_feature: Encodes the peptide sequence at SEQ ID NO. 27788
caaagctggagctccccgcggtggcggccgctctagaactagtggatcccccgggctgcaggaattcgcacgagaccattacctagaacatcctaatcaaaaaccgaacccaacaacacacgttcatagtggaaaacctcagaaaaccacaataaatcatcctcgtccaccactgcccccgctctgctgcaactccactcggaccggacgccctttccacccaccttgatcctctgatccggtgatgcttgaccgatccatggacacccatatcgcatacgtgaacggagcgcgattgaaccaaactgatggctgcccggcattcgagccgggggggtcccatggccccaacccggagaaacccggggcgacccatgcaggaggggggagggccccttggggggccccccttccccgtggctccttcggggagggaggggcaaaaccggaaaatccgggggcttctgggggggttttaaaaaaaaaaggggggggcccccctcttttttggaaccccacaaaaacgcgggggttgggggcacaccacccaaggtggtgttttttaaaaaaaaaaaaat

SEQ ID NO: 27788 - protein, 34 aa, Zea mays
  misc_feature: Ceres CLONE 1401252-F
MQEGGGPLGGPPFPVAPSGREGQNRKIRGLLGGF

SEQ ID NO: 27789 - DNA, 706 bp, Zea mays
  misc_feature: Ceres CLONE 1401254-F
agagctggagctccccgcggtggcggccgctctagaactagtggatcccccgggctgcaggaattcgcacgagaccattacctagaacatcctaatcgaaaaattgattttgagtgcatctttccccgtcgtcgggcgtgatctctcctcgtcgctgaccgacccgcctgtcccggcattctctcgcgctccagatacagggccctcatagagcctccgctcgatctagccccccggattggatgtgtcgccgcacatctcatgggtgaggaagctgtcccacttcattgtacgtttacgtcaacgactgcaaacagagtgcctttgaagtcggcgataagacgtatgtgatttgtagatcaaatgaagatatgaaaacatctgatgtgaaaatatcacgacaagctcactcacagatgggtctcacccacaatacttgttgaacagccacttctaaccaagtcacagtctgtgattcctgacaatgatgacaagatattagctatcgagaaggaggttcccttgaatgagtccatctggttccttgagatagacaccacctttgttaagcacaacggaaaatcaaggaaacagaagatgtttcttggagcaaggaagtaatcggcgatctgcaaaaagcagatgtgattagcggtacttctgttgctagtacagctaattgtgttgcaagttgatgaagagtatt

SEQ ID NO: 27790 - DNA, 706 bp, Zea mays
  misc_feature: Ceres CLONE 1401256-F
  misc_feature (548)..(548): n is a, c, t, g, unknown, or other
  misc_feature (584)..(584): n is a, c, t, g, unknown, or other
  misc_feature (585)..(585): n is a, c, t, g, unknown, or other
  misc_feature (650)..(650): n is a, c, t, g, unknown, or other
  misc_feature (656)..(656): n is a, c, t, g, unknown, or other
aaagctggagctccccgcggtggcggccgctctagaactagtggatcccccgggctgcaggaattcgcacgagaccattacctagaacatcctaatcgaaaaagtgtttcgcactttgctattcagcttcgttcttcaccggttcaccctagccgccaccccaacccccagcgacagggaccttcgccgccaggccgcccccaatccctagcgactgcgagcaccgtcgccaggcgccgtgcagcgagcgtcgccgcctggcgaagtcgcgcgactcgtgccctgcagcgagcgccgctgtcccgcacccaccgtcgaacggctgccgatgcccaacgccctgcagcgagttgcgccgtcgtccgcttcctctcgctggtaacctcgtgtttcgatttggacagattgctcgtgacttggtgttgcgccgccgaccgagcctccttcccctaagtccctaaccgtaagtcctaaatcttggtgagttctgttcatgtgcatttgagcttacgcatctatgatacgcgccttagggattgtgatctgtngattaggggttgtgaaattgagatgccattttaggnnattgtggaagtgtgaactgtgccttactgaaatcgagatgccatttgagcaagttttcaactatnttgttnggattggcgaggttatgagacctttccagatactttatatccgaattgtt

SEQ ID NO: 27791 - DNA, 710 bp, Zea mays
  misc_feature: Ceres CLONE 1401257-F
  misc_feature: Encodes the peptide sequence at SEQ ID NO. 27792
  misc_feature (443)..(443): n is a, c, t, g, unknown, or other
  misc_feature (700)..(700): n is a, c, t, g, unknown, or other
caaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgacctccgggagaagtacgggcccatcttcancatgcggatggggcagcgaaccctcatcgtggtcacctcggcggagctcatccacgaggcgcttggtgaagcagggccccatgttcgcgagccggcccgaggacagccccacccgcctcctcttcagcgtcggcaagtgcaccgtcaactcggcgcctacggccccccctgtggcgtgctctgcgccgcaactttcgtcgccgagatcgtgtccccgcaccgcgtcagggctttctcctggaattcgggaattgggnccgtggacgc

SEQ ID NO: 27792 - protein, 159 aa, Zea mays
  misc_feature: Ceres CLONE 1401257-F
  misc_feature: SWISSPROT Homolog: EC 1.14.13.11 Trans-cinnamate 4-monooxygenase
  misc_feature (71)..(71): Xaa is any aa, unknown, or other
  misc_feature (157)..(157): Xaa is any aa, unknown, or other
MDVNDVLLVVLAAALAAMWWRRCSKTGGVDGLPPGPPGWPVVGNLFQVILQRRPFMYVVRDLREKYGPIFXMRMGQRTLIVVTSAELIHEALGEAGPHVREPARGQPHPPPLQRRQVHRQLGAYGPPCGVLCAATFVAEIVSPHRVRAFSWNSGIGXVD

SEQ ID NO: 27793 - DNA, 657 bp, Zea mays
  misc_feature: Ceres CLONE 1401261-F
  misc_feature: Encodes the peptide sequence at SEQ ID NO. 27794
  misc_feature (289)..(289): n is a, c, t, g, unknown, or other
  misc_feature (528)..(528): n is a, c, t, g, unknown, or other
  misc_feature (533)..(533): n is a, c, t, g, unknown, or other
cgctctagaactagtggatcccccgggctgcaggaattcgcacgagaccattacctagaacatcctaatcgaaaaggtcgggactccggactcgggagtcggcactcgggtctcgacgtctcgtctcgtctcgtctcgcctgcccgcagccccttggctttgttccatccggcttcttcggcggcggcggagaggagggggatggcgcaccggctgctgcgggacgcgcaggcggacgggtgggagcggtcggacttccccatcatctgcgagtcatgcctcggcgacnacccctacgtccggatgttaagagctgaatatgacaaagaatgcaaaatttgtgcacgtccttttactgtacttccggtggcgtcctgggcgagatgcaaggtacaagaagactgagatctgccagacatgttgcaagctaaagaatgtctgccaggtctgccctgctggatcttgaatatgggcttggcctgtttcaggtccgagatacagcactctctatcaattccaatgatgcanttccnaagggagtgatgtcaatcggcgaatatttttgcagaagagcattggataggaggggccaagagcttggcattagactatgattcatcccatatggggaaaggctcgccccaaaatgataccatt

SEQ ID NO: 27794 - protein, 67 aa, Zea mays
  misc_feature: Ceres CLONE 1401261-F
  misc_feature (30)..(30): Xaa is any aa, unknown, or other
MAHRLLRDAQADGWERSDFPIICESCLGDXPYVRMLRAEYDKECKICARPFTVLPVASWARCKVQED

SEQ ID NO: 27795 - DNA, 669 bp, Zea mays
  misc_feature: Ceres CLONE 1401264-F
  misc_feature: Encodes the peptide sequence at SEQ ID NO. 27796
  misc_feature (531)..(531): n is a, c, t, g, unknown, or other
  misc_feature (545)..(545): n is a, c, t, g, unknown, or other
  misc_feature (552)..(552): n is a, c, t, g, unknown, or other
caaagctggagctccccgcggtggcggccgctctagaactagtggatcccccgggctgcaggaattcgcacgagaccattacctagaacatcctaatcgaaaaaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcacccggccggacaccttcttcaccgccgccgactccgtgaggtctgtctgcacggaggtggccacggacctgcagatcctcgtggataactgcctctaccatctccacaaggtaattagctcaaggatcgtcagagatcgtgcccaccctttggcctttattcaggaatttgaatctttagttaggatcgttccatacagtgggatcccgtctaggctttgttcggttttcacggattggagacccagataattcctagccggnatacttctctattnatataanttttgatgagttggaacgaaaccgggtttattccatagaaacgaacggccccctagaaatggagaagtcccccccggcgatcttgagattaagactctttctgtttcttgccatgtc

SEQ ID NO: 27796 - protein, 90 aa, Zea mays
  misc_feature: Ceres CLONE 1401264-F
MKFMRLGTRPDTFFTAADSVRSVCTEVATDLQILVDNCLYHLHKVISSRIVRDRAHPLAFIQEFESLVRIVPYSGIPSRLCSVFTDWRPR

SEQ ID NO: 27797 - DNA, 783 bp, Zea mays
  misc_feature: Ceres CLONE 1401269-F
  misc_feature (531)..(531): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (626)..(626): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (754)..(754): n is a, c, t, g, unknown, or other
  misc_feature (779)..(779): n is a, c, t, g, unknown, or other
aaaagctggagctccccgcggtggcggccgctctagaactagtggatcccccgggctgcaggaattcgcacgagaccattacctagaacatcctaatcgaaaaaatcaactcgtttctctccgattgctcctccgagtccgagactccgttctctcccgcatccaccgccgtctcatccccaatccgagcaacgcctcccctcgcctccaaaaccctacccctcctgtcaccggcggggggatggaaccggggatcgcttacctgggctcgtctgtctggggcacgcgcgaaggcagtgaggtggagcattgcggtgggtccgatcgccccgcggggggggcatggcgcgtcttgtggcgggatcgggcgggcgggggccaagcgcgcgggggccggctgggggttttaagaaaacttacttcttcaagagaccccccgaagggggcgggacacaagctgttgcggtataccgaagaaagacgcaacttccccccccgcccgtcggtggacttaccaaccaccaacagggnaaaaaacccgtccgccccagaatgaagcggtggcattattttgagggagaagnnnnnncagagcagggttgccgctcttctacaccannnnaaanaatttggtaaaaaggggaggcgtctgcagcttgcgagacttgcctttttttggcacctggggatatgtagccgggagacttcatctttnnntcggagagcaagggtgaacgcacannnncaaagctgntgttctttcagaggaacgccatggntgtg

SEQ ID NO: 27798 - DNA, 829 bp, Zea mays
  misc_feature: Ceres CLONE 1401280-F
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (44)..(44): n is a, c, t, g, unknown, or other
  misc_feature (45)..(45): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (397)..(397): n is a, c, t, g, unknown, or other
  misc_feature (398)..(398): n is a, c, t, g, unknown, or other
  misc_feature (424)..(424): n is a, c, t, g, unknown, or other
ggtgtttggtatatggggaattgggagcgccttctcnnnccccnnaaannnnnnnccaaagctggagctcaccgcggtggcggccgctctagaatagtggatcccccgggctgcaggaattcgcacgagaccattacctagaacatcctaatcgaaaaactctgctcacgtaccggcgatgatcaccgcgccgtgcggaggttaggcgcgagccgatcagtgtcccgcgactggtgcagcctgccgaaacagtgccggacacggtccgggcggggtgagctgcgggtctacaacgtggcctcggattcgcggcgccccgccgcgcccttgggcgctgccggactgagcccccgtgcggtcttcgcggtcgcgcgcggtgggagcgccccgcgagganncgggcgcggctccataggccccgagncgctgccccgctgcgggttttcaccggcggccctcccaaacggcccgccccgtgggggcgaccccgccagagaagggggaacaaggctgggacggactctccccattaacaggagtggaggggaccccgggacgggggacccgtcggcaaccggcggcgcaactttccgtgggagggctcccggcctcgcccggagcgcgggggggtcgattacggagcgggaaagccccgccggggcgccgcgggggaacggggcgcgccttgggggggggccccctggggccttgggggggggctgggaagaccccacgggtcggggcgggggacccgcggccggtgggggtacgggacaaagagtcggaccgggctctggggggagggtccccttcaggggggacctttcgg

SEQ ID NO: 27799 - DNA, 669 bp, Zea mays
  misc_feature: Ceres CLONE 1401285-F
  misc_feature (336)..(336): n is a, c, t, g, unknown, or other
gctggagctccccgcggtggcggccgctctagaactagtggatcccccgggctgcaggaattcgcacgagaccattacctagaacatcctaatcgaaaaattgtggattgattgttcctccccgcctcattcctttgtctcctcgcctcgtgctcgctcgctcccctcgccctggcgaggagggcagcagaaaccctagcggctcaggtcgagaggcttctacatcgctccaaggttcgagaggcaaggctaggttagtggcgcgccatcgactatgcgctgcgtcttcggccgggcggctgcgtcgtcctctgcagcgccgaactaatagtgtcncaaaggcgacgtcatccccgcagtccgaagcgaagtcgccctccgtagtcgccgccaccgacgttcacgggaggccgcgtcgaagcctcgtggacagcacgttgtcgggactcagaaggcctgcagacccgcgtttgccgcgtagaagaacatcaccagcagttcgacaccatgtcctcgtaacacagctagataggccttcagcggatggcagctgtgccgcacaagaaactgcaatatttgtaaaaagatcgggacgggagcgaacctgcatgtgttacggtcttgggccaccccggcttttccgtacctgttccttaaaaaaggccggtt

SEQ ID NO: 27800 - DNA, 688 bp, Zea mays
  misc_feature: Ceres CLONE 1401287-F
  misc_feature: Translation starting site: 157
  misc_feature (386)..(386): n is a, c, t, g, unknown, or other
  misc_feature (421)..(421): n is a, c, t, g, unknown, or other
  misc_feature (429)..(429): n is a, c, t, g, unknown, or other
  misc_feature (484)..(484): n is a, c, t, g, unknown, or other
  misc_feature (616)..(616): n is a, c, t, g, unknown, or other
tggagctccccgcggtggcggccgctctagaactagtggatcccccgggctgcaggaattcgcacgagaccattacctagaacatcctaatcgaaaaatattctcccaaaaaacccaacactccagtggcggcaaagacctaacatttcaaaatcaatggccaagaaccccaaggcgcccgacacccgcagtggccgttctcccaccagaaggccccgaccacgccgcgccaaggcggtgccagaagcctcctccgcagctgatatcgaagacctggctccctcagtgcctggggccgctgcccctggcgctgccgcacccacggccctgcgcgcacagctgctccggtggtatgacgcgcaccgtaaggacctgccgtggcgatngcgtaagcggcagcgaggaaaagagggcgtacgcnggtgtggntgtccgaggtgatgctgcagcagacgcgggtgccccgtggtcgtcgcttactacnagcgtgggaattggcgcggtggccgaccgtacgaagcctcgccgcccgctaccccaggaggaggtgaacgaaaatgggggggcgggttcttggttactaccgaaagggctcgattttctgctggagggagcnaagaaatcatctccaaaaaagggggttggttcccttgcacggcgttagccccttccggggagggtccggggg

SEQ ID NO: 27801 - DNA, 595 bp, Zea mays
  misc_feature: Ceres CLONE 1401288-F
  misc_feature (250)..(250): n is a, c, t, g, unknown, or other
  misc_feature (251)..(251): n is a, c, t, g, unknown, or other
caaagctggagctccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctccccttacctcgggctatcgcctganngataaagtggggtctgtaggggagtcttaggggggagcaaaagggataggaatagggagagatggaagcatcaatttcttcgtcgcctccggccctgttaaggtccccgttacaaacccaaggaaaattcgggcttttttccgtttttaaacccgaactcttttccgtttaggcccaccaagaaagggggggggaagcctttcaaaaattttcccaaaaaaaaaggggaaaaaaaaacatttgtccaagtttaatttggggggagaaaaaaaaaccccggggccgggggttttattttttcaaacaaaaaagggggccaaaaaaaaaaaaaataattttgtgga

SEQ ID NO: 27802 - DNA, 580 bp, Zea mays
  misc_feature: Ceres CLONE 1401289-F
aaagctggagctccccgcggtggcggccgctctagaactagtggatcccccgggctgcaggaattcgcacgagaccattacctagaacatcctaatcgaaaaacacacccggaccccggtctgcgtttgtccctgcgggctgcggccctgcctcttctcgtctcccgttcccctcgccgcgtgagctctctctctctctctctctcctctgaggagacgactgggcgcccgcaccccttggcagccgccgccggcccagtccccgtcggggccttttcggaaggtctttctttgggccttttcccccggggaaaaacccgaacccaggggtaaattgggcaaccccccgcccagggcctttaaatggggcccccccccccttgaaagggggttttccccgggggggtttccggggggaatttttttcccccccaaaaaatttttgcccccccctctttttaagaacccccgcgcgaaaaattttctctttgttaaaaaaacaaaaaaaagggggccccccccccactatttgggtggggggaacccccccccctcaattatatttatttttttttttttt

SEQ ID NO: 27803 - DNA, 572 bp, Zea mays
  misc_feature: Ceres CLONE 1401290-F
  misc_feature (541)..(541): n is a, c, t, g, unknown, or other
aaagctggagctccccgcggtggcggccgctctagaactagtggatcccccgggctgcaggaattcgcacgagaccattacctagaacatcctaatcgaaaaactcccaccgtatcctcacctgcgtagggtttaaccactcgcagcagccgccgtggactcgagaatcatgtcagcgtcgtcgtcgctcaaagaccccggcaaccggcgtagcggtctctcggggctcgttcggcacccggaaaggcaaccgggcttcccgggggccgggggttcccccgaattcgggggcccccggggggttaaaccctcccccccccccggggccggggggttttccccccccaaaaagaggttaagggcccccccttgtgaacgggggaaaaaaaaagggccctctgtgggggggggtttcccccccctttttggggggggaaaacaaaaaaaactttttttgttttttggggggggggctttctcccccccccgtgggaagggggggggggaaaaaaaacccctctttttctcccgagggaagggntggtggcccccctttttttttttagggggag

SEQ ID NO: 27804 - DNA, 697 bp, Zea mays
  misc_feature: Ceres CLONE 1401291-F
  misc_feature: Translation starting site: 217
  misc_feature: SWISSPROT Homolog: EC 1.4.1.2 Glutamate dehydrogenase
  misc_feature (519)..(519): n is a, c, t, g, unknown, or other
  misc_feature (557)..(557): n is a, c, t, g, unknown, or other
  misc_feature (643)..(643): n is a, c, t, g, unknown, or other
  misc_feature (652)..(652): n is a, c, t, g, unknown, or other
aaagctggagctccccgcggtggcggccgctctagaactagtggatcccccgggctgcaggaattcgcacgagaccattacctagaacatcctaatcgaaaaatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgatccgtcagtgcagagtgacatgaagctatggccgttcagggtcatccccaggcctggntgacagcccatgattggtagtgactaccagggcgaggnagaagcagtttgcttgctgaggagatctccctcatggtctcattcagatggagggagatgctgaagcctaccttggtccacatcanaaaacgaantgggtgacagtggcggcctacttcaacgactcgcagaggcagcac

SEQ ID NO: 27805 - DNA, 679 bp, Zea mays
  misc_feature: Ceres CLONE 1401292-F
  misc_feature (241)..(241): n is a, c, t, g, unknown, or other
  misc_feature (289)..(289): n is a, c, t, g, unknown, or other
  misc_feature (290)..(290): n is a, c, t, g, unknown, or other
  misc_feature (297)..(297): n is a, c, t, g, unknown, or other
  misc_feature (302)..(302): n is a, c, t, g, unknown, or other
  misc_feature (306)..(306): n is a, c, t, g, unknown, or other
  misc_feature (307)..(307): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (340)..(340): n is a, c, t, g, unknown, or other
  misc_feature (617)..(617): n is a, c, t, g, unknown, or other
caaagctggagctccccgcggtggcggccgctctagaactagtggatcccccgggctgcaggaattcgcacgagaccattacctagaacatcctaatcgaaaaacggatcaaaatcgaatccaacgctactgcctagggtttcctctgcatttcccctaccacaccccgcgccgcccacccatggccgccgcagacgcgtccgccgagaccgccgccatcgcgcggcgcctggcctcctgncacaccggcacccgggagcgcgcgctccgctacctccctctcgaattnnctgcggnctcgngcgnngctctcgnnncacgactctcagctctggaaggncatctctctgcttctggcacggcgacagcgtctacagagtccgtggcttgcctcgcgttccgcccgcgtcccggcaatggggcgcttcctggggttactaacaagtcgccggaggggccaattgagtcccgccctcaaagtttaccccaaacccgggtccccccagcccctggtttcccggaaacccccccccccaaacccccccagggggggcccttttaaaaaagctttttctcaaaaaaaaaaaccccctccccccccgggggtggaaaaaaanggggaggttttttttaaccctccggtctccccccgggaaagaaaaaaaacaccccttttttc

SEQ ID NO: 27806 - DNA, 709 bp, Zea mays
  misc_feature: Ceres CLONE 1401294-F
  misc_feature: Translation starting site: 263
aaagctggagctccccgcggtggcggccgctctagaactagtggatcccccgggctgcaggaattcgcacgagaccattacctagaacatcctaatcgaaaacacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggttagtggggtttattcggatgataataaccttcagcttgaggccaccacacagttccgcacattgctctctatagagaggagtccccccatcgaagaagttatcaaaacaggtgtagtttcaagatttgtgcagtctctcaccagagagatttcctccagctgcagtttgaagctgcatgggctctcacaaatatagcttctggcacttcagaaaatacaaagt

SEQ ID NO: 27807 - DNA, 709 bp, Zea mays
  misc_feature: Ceres CLONE 1401296-F
  misc_feature: Encodes the peptide sequence at SEQ ID NO. 27808
  misc_feature (352)..(352): n is a, c, t, g, unknown, or other
  misc_feature (385)..(385): n is a, c, t, g, unknown, or other
  misc_feature (401)..(401): n is a, c, t, g, unknown, or other
tggagctccccgcggtggcggccgctctagaactagtggatcccccgggctgcaggaattcgcacgagaccattacctagaacatcctaatcgaaaaaggatgacaaaatttcccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgccgccgccatgatctgcgcgatctccggtgaggtgccggacgagccggtggtgtcgaagaagtcggggcttctcttcgagcgncggctcatcgagcgctacattgaggaccatggncagtgccccatcaccnaggatgagcttactatggatgatatcgtgccggtcaataccaacagggtcgtgaaagccaggcctttgcaggctgcaagcatcccaggactccttgggatttttcagaacggagggggagctctcatggctttcaaattttgcttggggagagcggttccccccgcaaggacaagaactaagccttggactccaccacatggccctgccttgccgggttaaacccagttgaaaaaagaaagaatagggctaaagcccttttggcccaggtgggaaaaaaattcccttttgtgtggagaattgtcccct

SEQ ID NO: 27808 - protein, 114 aa, Zea mays
  misc_feature: Ceres CLONE 1401296-F
  misc_feature (42)..(42): Xaa is any aa, unknown, or other
MICAISGEVPDEPVVSKKSGLLFERRLIERYIEDHGQCPITXDELTMDDIVPVNTNRVVKARPLQAASIPGLLGIFQNGGGALMAFKFCLGRAVPPARTRTKPWTPPHGPALPG

SEQ ID NO: 27809 - DNA, 829 bp, Zea mays
  misc_feature: Ceres CLONE 1401299-F
  misc_feature (1)..(1): n is a, c, t, g, unknown, or other
  misc_feature (301)..(301): n is a, c, t, g, unknown, or other
  misc_feature (302)..(302): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (309)..(309): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (315)..(315): n is a, c, t, g, unknown, or other
  misc_feature (316)..(316): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (344)..(344): n is a, c, t, g, unknown, or other
  misc_feature (352)..(352): n is a, c, t, g, unknown, or other
  misc_feature (360)..(360): n is a, c, t, g, unknown, or other
  misc_feature (442)..(442): n is a, c, t, g, unknown, or other
  misc_feature (443)..(443): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (509)..(509): n is a, c, t, g, unknown, or other
  misc_feature (511)..(511): n is a, c, t, g, unknown, or other
  misc_feature (512)..(512): n is a, c, t, g, unknown, or other
  misc_feature (525)..(525): n is a, c, t, g, unknown, or other
  misc_feature (533)..(533): n is a, c, t, g, unknown, or other
  misc_feature (551)..(551): n is a, c, t, g, unknown, or other
  misc_feature (584)..(584): n is a, c, t, g, unknown, or other
  misc_feature (638)..(638): n is a, c, t, g, unknown, or other
  misc_feature (639)..(639): n is a, c, t, g, unknown, or other
  misc_feature (661)..(661): n is a, c, t, g, unknown, or other
  misc_feature (662)..(662): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (699)..(699): n is a, c, t, g, unknown, or other
  misc_feature (737)..(737): n is a, c, t, g, unknown, or other
  misc_feature (758)..(758): n is a, c, t, g, unknown, or other
  misc_feature (759)..(759): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (780)..(780): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (793)..(793): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (800)..(800): n is a, c, t, g, unknown, or other
  misc_feature (802)..(802): n is a, c, t, g, unknown, or other
ncaagctggagctccccgcggtggcggccgctctagaactagtggatcccccgggctgcaggaattcgcacgagaccattacctagaacatcctaatcgaaaacttgcaagcaagcagctgctctcgtgtgacatctagtcgtcgccagtcagtcacctctccagcctccagcaccaaccatccaccaccgagctagcagctgtctgctcgcctcccccacctaggctaggactaggagccaccaaactctgccccgccatgccgggcctcgccgcctagaatctgggcccccccgggggnngnnnncntnnncnnttnnngtctctcgttttgggttgtctcngctggggngccgctgnttgccttcggccctcttggtgccgctcccggccgggtgggggcgccgcttcccggcccgctcgggggttttggttctggcgnncttgggggtttggcgcggcgggttccctcctggttnnnggggcccccctcttcctttggtgtttcngnnggggggggggggnttggtacntggggcccccttttttcnggccccgccccccttccgccgggtgggggggcnctgggttccccctcccgccccctctggggggggttttccgccggggcggggggnnggggggctcccgggggtcgggnnccccccnnnnngggggggtttccccccgggggnnngngtttttggggggcccccctttttcccccttttctcccntttctggggggggggggggcnnggttttggtttttttnnnncncnnnnnnnnnngnggnnncncnctgggggtggcgctttttttttttttt

SEQ ID NO: 27810 - DNA, 721 bp, Zea mays
  misc_feature: Ceres CLONE 1401300-F
  misc_feature: Encodes the peptide sequence at SEQ ID NO. 27811
  misc_feature (421)..(421): n is a, c, t, g, unknown, or other
aaagctggagctccccgcggtggcggccgctctagaactagtggatcccccgggctgcaggaattcgcacgagaccattacctagaacatcctaatcgaaaagagaagagggcgggcatcggccagtgggggctcggaggccgagggaggcgaggaaagcggcgggtgccgggccgcccgcgccggtgccgaggccctcaccagtcaccaccccctcccctcttccgtctgtcccccgcttgccgccaccgccgctgcctgctcgcgacccttcccccttttaacgctcccgcggccccgcgtcgtgctcccttttgtcgccgctgccttcgtgcccgtactcgcgggttctcctcgctcctcaatctccgcgcctgggcgcggcgttcgccgccggatctgggcgcgggacggtgcccgnaacgtcgatgggcgcgggtggggcttccggttgggcgcccgcgcgctcgcgggtctcgtcctcgtgtcagtggctctgcttccacttgtcagttccgacgatggacacaaccctgcgaagggtgttgtcagggggctgggcggattccttcacggggccgcgggaaggacgggaccaactgagcctcaaggtttgggtcttcttcctcccatttcctaggactgggggccgcacctactttccctgttttctaaaaaaagttggatacaaatggccaggaatgccccgggtttttatgaa

SEQ ID NO: 27811 - protein, 97 aa, Zea mays
  misc_feature: Ceres CLONE 1401300-F
MGAGGASGWAPARSRVSSSCQWLCFHLSVPTMDTTLRRVLSGGWADSFTGPREGRDQLSLKVWVFFLPFPRTGGRTYFPCFLKKVGYKWPGMPRVFM

SEQ ID NO: 27812 - DNA, 696 bp, Zea mays
  misc_feature: Ceres CLONE 1401302-F
  misc_feature (679)..(679): n is a, c, t, g, unknown, or other
aaagctggagctccccgcggtggcggccgctctagaactagtggatcccccgggctgcaggaattcgcacgagacctttacctagaacatcctaatcaaaaagacgtccacagtgcgccgtgttctgccgcgcctgcgttcccaccgcgtgtccgcaactctgccccacctcacatccgcgtccgcaatccgcgcctccgccgccgcagcccttcctccgcgcagcgtccgtccatccatggctctccctacacgcagtgtcgtgccgctttccgcaatccgtgcctcaatccccttccttcgcgcagtgcccttccatccatggctcgcttccagaaatcccctacctacggcgcagcgtcgcagtcaggaatccgcccccaaaatcactacccgctctgcggcgatggaagggaatcaatccgtcaatggaaggaacacgtgcttcccccttccatcctcggcgctgcgcggattgcggattgcatggccatcgtttcgcgccccaatccgtcgatgcaaggaacgcgtgcttcccccttccatcctcggcgctgcgcgaattgcagattgcatggtcatcgtttcgccccagttcttgcccgatcaaaatggaggggtgccccgatccgcctcactccatcaatgaggtgcctgcctttcttgcatggagacgccnaagagaaggaaccatca

SEQ ID NO: 27813 - DNA, 709 bp, Zea mays
  misc_feature: Ceres CLONE 1401303-F
  misc_feature: Encodes the peptide sequence at SEQ ID NO. 27814
  misc_feature (591)..(591): n is a, c, t, g, unknown, or other
  misc_feature (611)..(611): n is a, c, t, g, unknown, or other
caaagctggagctcaccgcggtggcggccgctctagaactagtggatcccccgggctgcaggaattcgcacgagaccatttaccttgaacatcctaatcgaaaaaccacgttcactccgtatctctcgtgcctttttcctttcctggttgcgacgagccgacgactgggcggacgccgctgccgccctacgccaggtcttcgtcggccccttcgacgagcacacacaagattcagtcgggaatgttgaatgcatagtgtaatttctgcgcaaaaagatggcatcagacgagttcatcagccttgacgcaccttgtgaggctgatgcgaaagatgaagggggagacgttcaggttaaagctcctgatgtgagtgggatggagcctctggtatcggatctccaaccagaagggaaagctggtgctgtgggtagtaatcccaagacatctgctgggaacctggatcttgaagaggggcaagtggaagatatggacctctcggatgattgacgtagtgggttggaaaggatcagctattagatgcttccattcagcccgagatcagtgttgcagctgtgcagactgtgatttggnttttgaggtcaagctggacnaagggggacgggactgaaaaatgaataatttatgagtcaacagcatctcttattgaagaaagtcccttcagaggagctaaaagagcccgtgtggaata

SEQ ID NO: 27814 - protein, 76 aa, Zea mays
  misc_feature: Ceres CLONE 1401303-F
MASDEFISLDAPCEADAKDEGGDVQVKAPDVSGMEPLVSDLQPEGKAGAVGSNPKTSAGNLDLEEGQVEDMDLSDD

SEQ ID NO: 27815 - DNA, 711 bp, Zea mays
  misc_feature: Ceres CLONE 1401305-F
  misc_feature: Encodes the peptide sequence at SEQ ID NO. 27816
  misc_feature (452)..(452): n is a, c, t, g, unknown, or other
  misc_feature (453)..(453): n is a, c, t, g, unknown, or other
  misc_feature (488)..(488): n is a, c, t, g, unknown, or other
  misc_feature (501)..(501): n is a, c, t, g, unknown, or other
  misc_feature (618)..(618): n is a, c, t, g, unknown, or other
  misc_feature (652)..(652): n is a, c, t, g, unknown, or other
  misc_feature (663)..(663): n is a, c, t, g, unknown, or other
aaagctggagctccccgcggtggcggccgctctagaactagtggatcccccgggctgcaggaattcgcacgagaccattacctagaacatcctaatcgaaaaacattccatcggtcgtgaaaagaaaaagggaaacaaaccaagctagagaaaagaagaaggtactacatactagctagctagcttagctatgggcaccatcgtcgacgctgacgtcgggttcgcggtgaagaggacgagcaggtcgctggtgccgcctgcgtcggcgacgccgcgggagacgctgcggctgtcggtgatcgaccgcgtggcggggctgcgccacctggtgcggtcgctgcacgtgttcgccgcgggcggcgacaagaagcggcagcaggcgacggcgacgccggccaaggcgctgcgggaggcgctggggaagacgctggtggactactacccgttcgcgnngcgggttcgtggtggtggacgcggagggcggcggngaagaaccccggntggcgtgcaccggcgagggcggcctggttcgtggaggccaacgccgcgtggctcgctcgaggaggcccgccacctcgaccaccccatgctcatccccaaggagcagctgctgccggnagcctcgccggacgtcaacccgctggaatgccgntcatgatgcanggtgacggagttctcgtgcggggccttcgtggtggggctcatctccgt

SEQ ID NO: 27816 - protein, 155 aa, Zea mays
  misc_feature: Ceres CLONE 1401305-F
  misc_feature: SWISSPROT Homolog: EC 2.3.1.167 10-deacetylbaccatin III 10-O-acetyltransferase
  misc_feature (88)..(88): Xaa is any aa, unknown, or other
  misc_feature (100)..(100): Xaa is any aa, unknown, or other
  misc_feature (104)..(104): Xaa is any aa, unknown, or other
  misc_feature (143)..(143): Xaa is any aa, unknown, or other
MGTIVDADVGFAVKRTSRSLVPPASATPRETLRLSVIDRVAGLRHLVRSLHVFAAGGDKKRQQATATPAKALREALGKTLVDYYPFAXRVRGGGRGGRRXRTPXGVHRRGRPGSWRPTPRGSLEEARHLDHPMLIPKEQLLPXASPDVNPLECRS

SEQ ID NO: 27817 - DNA, 605 bp, Zea mays
  misc_feature: Ceres CLONE 1401306-F
  misc_feature: Encodes the peptide sequence at SEQ ID NO. 27818
  misc_feature (300)..(300): n is a, c, t, g, unknown, or other
  misc_feature (353)..(353): n is a, c, t, g, unknown, or other
  misc_feature (413)..(413): n is a, c, t, g, unknown, or other
  misc_feature (437)..(437): n is a, c, t, g, unknown, or other
aaaagctggagctccccgcggtggcggccgctctagaactagtggatcccccgggctgcaggaattcgcacgagaccattacctagaacatcctaatcgaaaaagttaagtctcgttcactgcctgtgctgctcagtgctctgctcacacatcctcgtcgccaatggcggctcccgtccgggccatcccgctcccgtcgcccgtcctgtacccccgcatgtccttatggggccgagcagctgcagccggcgacgtgcccccggagttcgcgcagcagtggaggcggcggagggtgcttcncgggcgacggagaccgtggaggtggtcggcgtaggcagccggaaggacgccgncatcgacttctgcctgggctcacgcacgctgtccctcaccccccatcgcttctggacagnacatgtgatggataattctaaagntcagttaatacaaaaagggcatggaactgatgcagtgttcaaaagacttggaacctcccttatttcttcattcctggccacctgcggtaattctttgtttttagtgcggggcaggaagttggtcatataactggcatggggttccttatcgggttggcaaactggctg

SEQ ID NO: 27818 - protein, 113 aa, Zea mays
  misc_feature: Ceres CLONE 1401306-F
  misc_feature (43)..(43): Xaa is any aa, unknown, or other
  misc_feature (63)..(63): Xaa is any aa, unknown, or other
  misc_feature (71)..(71): Xaa is any aa, unknown, or other
MGPSSCSRRRAPGVRAAVEAAEGASRATETVEVVGVGSRKDAXIDFCLGSRTLSLTPHRFWTXHVMDNSKXQLIQKGHGTDAVFKRLGTSLISSFLATCGNSLFLVRGRKLVI

SEQ ID NO: 27819 - DNA, 694 bp, Zea mays
  misc_feature: Ceres CLONE 1401307-F
  misc_feature: Encodes the peptide sequence at SEQ ID NO. 27820
  misc_feature (521)..(521): n is a, c, t, g, unknown, or other
  misc_feature (522)..(522): n is a, c, t, g, unknown, or other
caaagctggagctccccgcggtggcggccgctctagaactagtggatcccccgggctgcaggaattcgcacgagaccattacctagaacatcctaatcgaaaaaatcacgagaagggcgccgatctgggaaggcattgtcttgttgtactttcccttccggcagtggcctcgattcgcatccccttttcccgtccatgcgcgcgccggcgggcggtgccagtgccaccgcgctcgcggcggccatgaacattaagcagccgctgcacggcgcatcgacgctgttcgcgctgctctctctctcgctgctcctcctccgcctgctcctccgcctccgcctggccgccttccgcgaacgcggcgctgtcgctccacctgctggcgcgcctccgcctccgccccgtcctcctctgcctcccggagcctggcacgacgggcggcgccgggcgccggcgccacccacgctgcgcgtctggtgccccgccaccccatcctccaagccgccgctgctcctcctcacggnnttcggcggggacgccaggtgaacgtgggcgcgcaacctcccgcgcctgtcccgcacttcacgtggacgcgcgggacttccgggtcttccgggggcagtcccgggcccgggtcgcgctgggcttccggggggtccaggcccgttgggccggccgaggccgggcccctccccgg

SEQ ID NO: 27820 - protein, 115 aa, Zea mays
  misc_feature: Ceres CLONE 1401307-F
  misc_feature (109)..(109): Xaa is any aa, unknown, or other
MRAPAGGASATALAAAMNIKQPLHGASTLFALLSLSLLLLRLLLRLRLAAFRERGAVAPPAGAPPPPPRPPLPPGAWHDGRRRAPAPPTLRVWCPATPSSKPPLLLLTXFGGDAR

SEQ ID NO: 27821 - DNA, 722 bp, Zea mays
  misc_feature: Ceres CLONE 1401308-F
  misc_feature: Encodes the peptide sequence at SEQ ID NO. 27822
  misc_feature (362)..(362): n is a, c, t, g, unknown, or other
  misc_feature (366)..(366): n is a, c, t, g, unknown, or other
  misc_feature (380)..(380): n is a, c, t, g, unknown, or other
aaagctggagctccccgcggtggcggccgctctagaactagtggatcccccgggctgcaggaattcgcacgagaccattacctagaacatcctaatcgaaaaagcctacacgcccccgcctcctgccctctgtccacatcctcgcctctccccactagttcgctcgcgtgatggtggtgcgggagcagcggaacaagggttcgtcgtcggccaccctgtgacaccccgcccacgcccccgcggcggaacctgcaaacccggaggccggagctccgacttcgtcggccatcgaccgcgtctgatcggcgctgggacctgccgtccggacgaaatcggtcagcatgacggggcccaatgaaaangcgncggcggaaggcggnggtggcgagaggcgcaagtacccgatccacgtggaggactacgagctgtacgaggagatcgggcagggcgtcagcgccatcgggtaccgcggactctgcaggcactcgaagagatcgtcggcgttcagggtggtcaacttcgagggcaccaaaggggacctgaaaaaattcgttcggggaattcaaaacaggattttggaaaacccttccaacggtggaagggggttttgttctttggaaaaacccaaggttagggggggattgcggaaatgggggggggggctcggttttcctaaaaggaaaaggggctcccatgtggttcggggggccccctcccgggaa

SEQ ID NO: 27822 - protein, 127 aa, Zea mays
  misc_feature: Ceres CLONE 1401308-F
  misc_feature (7)..(7): Xaa is any aa, unknown, or other
  misc_feature (9)..(9): Xaa is any aa, unknown, or other
MTGPNEXAXAEGGGGERRKYPIHVEDYELYEEIGQGVSAIGYRGLCRHSKRSSAFRVVNFEGTKGDLKKFVRGIQNRILENPSNGGRGFCSLEKPKVRGGLRKWGGGLGFPKRKRGSHVVRGAPSRE

SEQ ID NO: 27823 - DNA, 930 bp, Zea mays
  misc_feature: Ceres CLONE 1401309-R
  misc_feature (1)..(1): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (826)..(826): n is a, c, t, g, unknown, or other
  misc_feature (930)..(930): n is a, c, t, g, unknown, or other
ntttgtgttggcnnnccnnnccaccaagaagtcggtccagaggccaaggggcccattattttcgctgctttatggcatgacttgggcagcagcatttcaatgggtatacatatagggctgttcccagcattatattgtaccttctgcttctgttgaagaggcgctgtccagactgaggacgcatcgatggccgatgggcgcgtgtgtgtgtgtaagccaccatgtgtgtgtgagacataaatcatgtacatctggaaatagggccgcttgatcattatcatcaggaagcgcgcgtctccgttagctcgaaccgaattcctcgttccagttctccagctcgtcccatttgctcttctgcaagcttggcctgatctccgtcatcgcgttcttgaagtcctcgttggtgacaccacgcagctgatttgctttgatagaaagaatattttgtggaccgagctctcttatttgggtgattgcatcttcttcacacaggggtctcgggtgaatttcagaatacccttccgtctccacaggaagtctttctaaatcatggtgcggacgtagggaatgagtgtcctgaggagctgattttttctggaagttacccttcgtacattgagtattacggaattggtacctcttatgctgttaaccaacgttggtaaaaaaagattcaaccatattcggggggggtttgtggggagtccgctagcatagattgcttgtatcgtttcggggggttggtggaaccgctgattaaatactttaataagtatatagcgcatatgtgtaaaagccgattgatccggcacatttccttttgaanctttaacggacagtacgtaccccgggggtatgtggtgaatgggtgtccggtgcagaagaacatgggagattaaatattagtctggatactttaccacgcgactn

SEQ ID NO: 27824 - DNA, 698 bp, Zea mays
  misc_feature: Ceres CLONE 1401311-F
  misc_feature: Encodes the peptide sequence at SEQ ID NO. 27825
  misc_feature (543)..(543): n is a, c, t, g, unknown, or other
  misc_feature (559)..(559): n is a, c, t, g, unknown, or other
  misc_feature (560)..(560): n is a, c, t, g, unknown, or other
  misc_feature (606)..(606): n is a, c, t, g, unknown, or other
  misc_feature (607)..(607): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
aaagctggagctccccgcggtggcggccgctctagaactagtggatcccccgggctgcaggaattcgcacgagaccattacctagaacatcctaatcgaaaaaaaaaagagggaagccgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttcaactctgatctacttcaacatcttcctgggcgacatgtggtccgccatgaagtcggagaagaagcgccagaagcagcacgacgagaacgtgcagaaggtcgtgaagcggctcaagcagaggaacccgaagaaggacggtcttgtttgcacggccaggaagccctggatcgctgttggcatgcgcaacgtgnactacaagcgtgcagnncatttcgaggtcgacctttcttccttcaggaccatccttgaatcannaaaaaaaagggatgggtttgcaaggtcgagccccttgtcaaacatgggtcagataacagagtactgcgannnnnncccccccggggggggt

SEQ ID NO: 27825 - protein, 152 aa, Zea mays
  misc_feature: Ceres CLONE 1401311-F
  misc_feature (101)..(101): Xaa is any aa, unknown, or other
  misc_feature (106)..(106): Xaa is any aa, unknown, or other
  misc_feature (122)..(122): Xaa is any aa, unknown, or other
  misc_feature (145)..(145): Xaa is any aa, unknown, or other
  misc_feature (146)..(146): Xaa is any aa, unknown, or other
  misc_feature (147)..(147): Xaa is any aa, unknown, or other
MADVHEPLVRRKRKKVLVDYLVKFRWILVIFVVLPISTLIYFNIFLGDMWSAMKSEKKRQKQHDENVQKVVKRLKQRNPKKDGLVCTARKPWIAVGMRNVXYKRAXHFEVDLSSFRTILESXKKRDGFARSSPLSNMGQITEYCXXXPPGGG

SEQ ID NO: 27826 - DNA, 726 bp, Zea mays
  misc_feature: Ceres CLONE 1401313-F
  misc_feature: Pfam Name: TPT Pfam Description: Triose-phosphate Transporter family
  misc_feature (335)..(335): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (359)..(359): n is a, c, t, g, unknown, or other
  misc_feature (360)..(360): n is a, c, t, g, unknown, or other
  misc_feature (380)..(380): n is a, c, t, g, unknown, or other
  misc_feature (399)..(399): n is a, c, t, g, unknown, or other
  misc_feature (400)..(400): n is a, c, t, g, unknown, or other
  misc_feature (488)..(488): n is a, c, t, g, unknown, or other
  misc_feature (525)..(525): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (561)..(561): n is a, c, t, g, unknown, or other
  misc_feature (564)..(564): n is a, c, t, g, unknown, or other
caaagctggagctccccgcggtggcggccgctctagaactagtggatcccccgggctgcaggaattcgcacgagaccattaacctagaacatcctaatcgaaaacaatccaattcacaaacacacacgggcaatcaattagcagaacccgcgccacccccccttcctcggagtcggagcgagtcgaggaacggctcgtctgcctctcccgttctccttcccctcctccccagaagatctgatccatcatcgaggactcgccgggaagaatcaaggatatatagataataaacaaacaaaggttcctccagagcccagaggagggaagtcaccggncgtcggcgnnngaggagatgtcgnnacggcgcgggctcccggacnggcgtcgctggcgcgctgnngcctctcgggtcacctcgtcgggtggccatcgtcatctgcaacaagtacctcatcagcactctagggctcttctttgcgacgaccctnacgagctggcacctcatggggaccttcttcacgctgnacgttggcgcaacgggtgggccttttttttnnnncnaanccaaagccgattgaagggggggaaccgtattttcctttgggctgggttaaggggattctccattggccctcctcaacttttgggccgggggttacaaattttgtggggttttcacaaaaaggcccaggtggggccattaaccccttcccaaaagactttggg

SEQ ID NO: 27827 - DNA, 677 bp, Zea mays
  misc_feature: Ceres CLONE 1401314-F
  misc_feature: Encodes the peptide sequence at SEQ ID NO. 27828
  misc_feature (627)..(627): n is a, c, t, g, unknown, or other
aaagctggagctccccgcggtggcggccgctctagaactagtggatcccccgggctgcaggaattcgcacgagaccattacctagaacatcctaatcaaaagtgttttgctcattccctctcctcccactcgcttttcctccaaagcgagcgagctaggcgttacgccggagctcgtttgggcggtggtggaggagagaggaaagggaggagatgaaggcggtggagcgagcgaaactggtgaggagcctccggcacgagtcgcggcggctgcgtctactcgtcctcgttatcggtttcttcctcgttactctcaccttcgttgtcgtctccaagcccgacgcgctcctcttcaacctgaacggtaggctgtcggtggaccaggcgccgcgctcgctcttgatccgccagcgggttgacgccgacgaggggagatccgccgaaactctcgcctcagccaccggagatccaaaggtggtcgaagacgatacctacggcgaggaagccagcgccaaagccagagccaacgccaatgcccgagggaccactgctgaggaggaacggatgctcgctagtgagcccgagcagagaaaaagggcacaggaagccactacatctgagattttanctgggggagacggaccggggaaggaaaagccagcaagagggacacaaaga

SEQ ID NO: 27828 - protein, 155 aa, Zea mays
  misc_feature: Ceres CLONE 1401314-F
  misc_feature (139)..(139): Xaa is any aa, unknown, or other
MKAVERAKLVRSLRHESRRLRLLVLVIGFFLVTLTFVVVSKPDALLFNLNGRLSVDQAPRSLLIRQRVDADEGRSAETLASATGDPKVVEDDTYGEEASAKARANANARGTTAEEERMLASEPEQRKRAQEATTSEILXGGDGPGKEKPARGTQR

SEQ ID NO: 27829 - DNA, 706 bp, Zea mays
  misc_feature: Ceres CLONE 1401319-F
  misc_feature: Encodes the peptide sequence at SEQ ID NO. 27830
  misc_feature (488)..(488): n is a, c, t, g, unknown, or other
  misc_feature (555)..(555): n is a, c, t, g, unknown, or other
cagagctggagctccccgcggtggcggccgctctagaactagtggatcccccgggctgcaggaattcgcacgagaccattacctagaacatcctaatcaaaaattaataaaaagtttgctagtgagtcgagaagagagagagaggcgtccggaattcatcgccagcgatgtctccgtccgccgacgcccccggcccggcctcctccgcctcggcgcccccgctcgcgcccctcatcgccgcgcagctcaactacctcctctcgcactccaagctgcccattagggtggtacagatctggtccggctgccgcaacggtcgccctgccgatcggttcaggctcgccatccccttctgcctcgactacgtccactggggatttcgtgtacaatgcgctgtctccccaggtggcaccagacgtggtggttcggtccgagggatgagaggttccagccgctggtcgattacgctgctgctggaaatggcgatnagagctgcttggcgcgttgggattggcgcgcccccgagggactccctgcgctcgtacgggagtttcnagagaattggacattgatacaaaaagagcggttccccttgggggatgacccgagactaaggtttgaactaagcaagtcttctaaaggggggggatggagactgcagggacccttcggctggaaggccaaaggggccaaatttggtgaccct

SEQ ID NO: 27830 - protein, 134 aa, Zea mays
  misc_feature: Ceres CLONE 1401319-F
  misc_feature (107)..(107): Xaa is any aa, unknown, or other
  misc_feature (130)..(130): Xaa is any aa, unknown, or other
MSPSADAPGPASSASAPPLAPLIAAQLNYLLSHSKLPIRVVQIWSGCRNGRPADRFRLAIPFCLDYVHWGFRVQCAVSPGGTRRGGSVRGMRGSSRWSITLLLEMAXRAAWRVGIGAPPRDSLRSYGSFXRIGH

SEQ ID NO: 27831 - DNA, 712 bp, Zea mays
  misc_feature: Ceres CLONE 1401320-F
  misc_feature: Encodes the peptide sequence at SEQ ID NO. 27832
  misc_feature (447)..(447): n is a, c, t, g, unknown, or other
  misc_feature (462)..(462): n is a, c, t, g, unknown, or other
  misc_feature (547)..(547): n is a, c, t, g, unknown, or other
  misc_feature (700)..(700): n is a, c, t, g, unknown, or other
caaagctgggagctcaccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggccccggccacatccaagccgccgcctccggccccggccacacccaagccgccgcctccggccccggccacacccaagccgccgccagcgggggaggnagaagggcgggtggncgcgggggtggagctcacgggcgtccccgcggagggttaacgtggaggcgcggcggctgcggacgaagcggggcacggagggggncgcgatgcacgtgcgccaggcgggggccaagctcacgctgctctactcccacggaaacgccgccgacctcggccagatgtacgagctcttcgtcgagctcagcgcccacctcaacgtcaacctcatggggaatgaccatttctggttatgggnaatccactgggt

SEQ ID NO: 27832 - protein, 53 aa, Zea mays
  misc_feature: Ceres CLONE 1401320-F
  misc_feature (50)..(50): Xaa is any aa, unknown, or other
MHVRQAGAKLTLLYSHGNAADLGQMYELFVELSAHLNVNLMGNDHFWLWXIHW

SEQ ID NO: 27833 - DNA, 613 bp, Zea mays
  misc_feature: Ceres CLONE 1401324-F
  misc_feature (282)..(282): n is a, c, t, g, unknown, or other
  misc_feature (307)..(307): n is a, c, t, g, unknown, or other
  misc_feature (311)..(311): n is a, c, t, g, unknown, or other
  misc_feature (312)..(312): n is a, c, t, g, unknown, or other
  misc_feature (416)..(416): n is a, c, t, g, unknown, or other
aaagctggagctccccgcggtggcggccgctctagaactagtggatcccccgggctgcaggaattcgcacgagaccattacctagaacatcctaatcgaaaaataaagattactcatagattaaagtagggtttggacgtctgcctgtccatttcggcgtctgttcttagcggccgacaagcggaatctggatcaagtcccctgcttcaacccatcccctctcatcgattcattgccacaaagggcagcttgattgctcacagcgttggatgtgagatttgnattcggacccacgatcgatatgcgntcgnncacacgcgctcgatgtcggcggtcgccgcagtcgttctacctctgctgctcacaaccaccgtcgccgtattcctcccgctctgcctggtggcttggggaatggntcctccaaggttctccccctggccagttcccccctttcaagccaaaaggggggccctgggggcgcccttgactttcctccggccccggaaatttacccgggtggatcgggggggggggtctccccccccttggggtcccccccccggcgacaaaaaatttcccccctgaaaaaaaacggggtggggggaaaaaacca

SEQ ID NO: 27834 - DNA, 721 bp, Zea mays
  misc_feature: Ceres CLONE 1401325-F
  misc_feature: Translation starting site: 226
  misc_feature: Pfam Name: TAP42 Pfam Description: TAP42-like family
  misc_feature (1)..(1): n is a, c, t, g, unknown, or other
  misc_feature (385)..(385): n is a, c, t, g, unknown, or other
  misc_feature (463)..(463): n is a, c, t, g, unknown, or other
  misc_feature (545)..(545): n is a, c, t, g, unknown, or other
naaagctggagctccacgcgggggcggccgctctagaactagtgggatcccccgggctgcaggaattcgcacgagaccattacctaaaacatcctaatcgaaaagacgacgcttcccgagctctctccttcccgcgaccctctcctctgccccgctccgctagggttttgccgcagacctctcgctcgcttccggttccgcgaggcaaccgtccgaccggtcggaatggtggatgtggaggagaccgggaacaagttgcaatcgcagatgcgcctccacgcggagccggaggacgacgccgccgacctccccctcccggccctcttcgatagggcgtcgcggctccacgccctggcctccagctccgcctcgaccaggatggatnccgccacgggggttgacctgctgcggcgctgcgatgacatggtcagcaagctcggcctcttctcccccaacgagaccnaaggaggacgtctccacagcaaacctcaagtacctactggtcccatattaccttgcagaaatgaccgaaaaatagcacaggnagggatcggatcccggtttcttaagacgtcacaggaccattctgaaggagttcattggctctatgtgaagtactagagcttatccccagaggatgagctagaattgtctaggcagaagcagccagatactctgacaaacaaaaaagcgcagaaaggttgcccggttcaaacgtcaa

SEQ ID NO: 27835 - DNA, 731 bp, Zea mays
  misc_feature: Ceres CLONE 1401326-F
  misc_feature: Encodes the peptide sequence at SEQ ID NO. 27836
  misc_feature (133)..(133): n is a, c, t, g, unknown, or other
  misc_feature (366)..(366): n is a, c, t, g, unknown, or other
  misc_feature (371)..(371): n is a, c, t, g, unknown, or other
  misc_feature (385)..(385): n is a, c, t, g, unknown, or other
  misc_feature (389)..(389): n is a, c, t, g, unknown, or other
  misc_feature (391)..(391): n is a, c, t, g, unknown, or other
  misc_feature (392)..(392): n is a, c, t, g, unknown, or other
  misc_feature (416)..(416): n is a, c, t, g, unknown, or other
  misc_feature (429)..(429): n is a, c, t, g, unknown, or other
caaagctggagctccccgcggtggcggccgctctagaactagtggatcccccgggctgcaggaattcgcacgagaccattacctagaacatcctaatcgaaaaaagtagccctccctgttccatcgaacccangcagagcagccagccgaacaacgaagcatgccgtcgaagccgaacgccgcgtcgcgcctcgtcttcctcgctttcctcctcgtcatcagcgccgccgcggccaacgatgacgccgcggcgcggcggacgatggagcagttcgccggcttccccgcctccgacgacggcgagggcccttccagcgacttccacgtcgactccgagggcctccagcgtcagatcgatgaactggnctcgntctccgactcgccngcgncnngtcgtgaccgcgttctgtacaccngacaggatgtganggctcgaagggatataaaggggatatggatccactgggcctttgttgtcgagaagatgctggtgttaacatatttggcccgctggggaggggtccgagcctggacttaagacaattggaaatggatccccggggtgaggcccttccttcccgggaaatttggttggggggtgtgggaattctggggggttttggggaaataaattgtgggaaagggtttgtttctcggaaaaaaatttttggggggttttttggtttaccccaagggcgccccccctttgggaattatgggttggggagacc

SEQ ID NO: 27836 - protein, 125 aa, Zea mays
  misc_feature: Ceres CLONE 1401326-F
  misc_feature (69)..(69): Xaa is any aa, unknown, or other
  misc_feature (71)..(71): Xaa is any aa, unknown, or other
  misc_feature (77)..(77): Xaa is any aa, unknown, or other
  misc_feature (78)..(78): Xaa is any aa, unknown, or other
  misc_feature (86)..(86): Xaa is any aa, unknown, or other
  misc_feature (90)..(90): Xaa is any aa, unknown, or other
MPSKPNAASRLVFLAFLLVISAAAANDDAAARRTMEQFAGFPASDDGEGPSSDFHVDSEGLQRQIDELXSXSDSPAXXRDRVLYTXQDVXARRDIKGIWIHWAFVVEKMLVLTYLARWGGVRAWT

SEQ ID NO: 27837 - DNA, 684 bp, Zea mays
  misc_feature: Ceres CLONE 1401329-F
  misc_feature (351)..(351): n is a, c, t, g, unknown, or other
  misc_feature (659)..(659): n is a, c, t, g, unknown, or other
aaagctggagctccccgcggtggcggccgctctagaactagtggatcccccgggctgcaggaattcgcacgagaccattacctagaacatcctaatcgaaaaaccgtctcttctgttctgccctgctcgtgctcgtgcattcacccaccggggcgggcgtctctctcaccgccttgccacgccagcacgccactgtgctctgcctctgctcgactgctcctccatattaagaggccctcccgcgcgcccgcctctcgccgtgctcgtcgtcccttcgttacccgggtcagtgccgccgtcggtagcagaggagcagtaggtggccagtcagtcagccaattgtccgctcgntcactccgttcgagctctgctactcttcagcacccacgcatccatccatccatccatcggcgagcgcgagagcacactgttgcattgctgatcgctccgtctccgctgccgacgaggacgaggaagaacgagggagagacgcagacaggctgcgttgcgccatagagagagcagggtgtctatcgcgcgacggccacggcgcggcgccggcggcggggatcatgccgagcggcggcgtctcgcttcataccggcgtaccactgctttcactccgtgaagaagctgctggcgctgccgttttcggcggnggtggtggttgccaaggcggggacg

SEQ ID NO: 27838 - DNA, 699 bp, Zea mays
  misc_feature: Ceres CLONE 1401330-F
  misc_feature: Encodes the peptide sequence at SEQ ID NO. 27839
  misc_feature (313)..(313): n is a, c, t, g, unknown, or other
  misc_feature (335)..(335): n is a, c, t, g, unknown, or other
  misc_feature (351)..(351): n is a, c, t, g, unknown, or other
  misc_feature (394)..(394): n is a, c, t, g, unknown, or other
  misc_feature (511)..(511): n is a, c, t, g, unknown, or other
caaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatggtggtggcgtcggtgctcaagaaccgcngggtgtcgacggcctcccgccngggcctccgggttggncgggtggtggggaacctgttccaggtgatcctgcagcgacggnccttcatgtacgtggtgcgcgacctcccggagaagtacgggcccatcttcaccatgcggatggggcaggcaccctcatcgtggtcacctcggcggagctcatccacgaggcgcttgntgaagcagggccccctggtcgcgaggccggcccgaagacagccccacccgcctcttcttcagggggcggaaagggaacgtcaattcggggcctaacggcccccgtgggggtggtttggggcgaaaattctttccccgaaaatcggccccccgcccccggtaaggggctttcccgggaatccggaaagg

SEQ ID NO: 27839 - protein, 124 aa, Zea mays
  misc_feature: Ceres CLONE 1401330-F
  misc_feature (28)..(28): Xaa is any aa, unknown, or other
  misc_feature (35)..(35): Xaa is any aa, unknown, or other
  misc_feature (55)..(55): Xaa is any aa, unknown, or other
  misc_feature (94)..(94): Xaa is any aa, unknown, or other
MDVNDVLLVVLAAALAAMVVASVLKNRXVSTASRXGLRVGRVVGNLFQVILQRRXFMYVVRDLPEKYGPIFTMRMGQAPSSWSPRRSSSTRRLXKQGPLVARPARRQPHPPLLQGAERERQFGA

SEQ ID NO: 27840 - DNA, 665 bp, Zea mays
  misc_feature: Ceres CLONE 1401332-F
  misc_feature (434)..(434): n is a, c, t, g, unknown, or other
  misc_feature (435)..(435): n is a, c, t, g, unknown, or other
  misc_feature (441)..(441): n is a, c, t, g, unknown, or other
  misc_feature (457)..(457): n is a, c, t, g, unknown, or other
  misc_feature (469)..(469): n is a, c, t, g, unknown, or other
  misc_feature (470)..(470): n is a, c, t, g, unknown, or other
  misc_feature (572)..(572): n is a, c, t, g, unknown, or other
  misc_feature (598)..(598): n is a, c, t, g, unknown, or other
caaagctggagctccccgcggtggcggccgctctagaactagtggatcccccgggctgcaggaattcgcacgagaccattacctagaacatcctaatcgaaaagagagccccgcccccgggaggccgggagagaagagaacacgcgcgtcaggagcgcacaccgcacggcgcacacacacacgcctcccgcggcaagcagcgcaggacaccgaacgacgaagcgaggagaggggaggaggcggagccgagcgcccgagcccaaccccgcaaccacgacccacttccccgtcgcgattcgcattgcccttccctcgggttctacccccagcctcgcgccgccgccgccgccgccgcccttgccagagagatcaccccccattcccacaatcccgtccctccctccgtccctcgaggagccgagccctccgcgcgnncgtggnatggggcagtgaccgntgagtggcgtgnngagccggtgggcggtggcaagggcataccatggtgcagtgcctggacggggtgagcagcctgctcgcggcctgctcatttgctgcgacgtccagtcaagcangccgcggggtttcaagaccccaggtnctccgggagggaaacgtcttccgcgtgagtggaggccaggcgttttaccaattgtttaaaggatcca

SEQ ID NO: 27841 - DNA, 712 bp, Zea mays
  misc_feature: Ceres CLONE 1401333-F
  misc_feature: Encodes the peptide sequence at SEQ ID NO. 27842
  misc_feature (502)..(502): n is a, c, t, g, unknown, or other
  misc_feature (507)..(507): n is a, c, t, g, unknown, or other
  misc_feature (639)..(639): n is a, c, t, g, unknown, or other
  misc_feature (640)..(640): n is a, c, t, g, unknown, or other
  misc_feature (645)..(645): n is a, c, t, g, unknown, or other
  misc_feature (671)..(671): n is a, c, t, g, unknown, or other
aaagctggagctccccgcggtggcggccgctctagaactagtggatcccccgggctgcaggaattcgcacgagaccattacctagaacatcctaatcgaaaaatcaagccattcgtccctgtggaagtttccacactcccttcccttcccttgtacccactccaatggcgccctccctcctggccgccgtctccgcctcgcccttcctcctacccggcagcagcggcatcagccgcaggccactgggcgctgccccaacccgccgggccggactgcgcgtggccgcgcttaagtacgaccctgctaaggtggcaccgcagaacgaccgggtgctcgtccgtcttcagcagatccctgagaaatctgctggtggtgtattgctaccgaaatctgctgttaagtttgagaggtatctgatgggtgagattctatcggttggtgctgatgttagtgaaagtgaggctgggaagaatgttctcttctcagacatcaatgcttacgnagtgnaccttgatacggatgagaagcactgcttctgccgggagtcagattttgtaagctgtagtgaatgaatttaccatgaaaatacagacttacttgcccatgctccaactgcatggactttatctgcacctactnntgtgnacttgaaactcgcttctagatgagtngtagttatcattgtatttttgccacaaaaaaaaaaaaaaaa

SEQ ID NO: 27842 - protein, 135 aa, Zea mays
  misc_feature: Ceres CLONE 1401333-F
  misc_feature (48)..(131): Pfam Name: Cpn10 Pfam Description: Chaperonin 10 Kd subunit
  misc_feature (113)..(113): Xaa is any aa, unknown, or other
  misc_feature (115)..(115): Xaa is any aa, unknown, or other
MAPSLLAAVSASPFLLPGSSGISRRPLGAAPTRRAGLRVAALKYDPAKVAPQNDRVLVRLQQIPEKSAGGVLLPKSAVKFERYLMGEILSVGADVSESEAGKNVLFSDINAYXVXLDTDEKHCFCRESDFVSCSE

SEQ ID NO: 27843 - DNA, 705 bp, Zea mays
  misc_feature: Ceres CLONE 1401336-F
  misc_feature (569)..(569): n is a, c, t, g, unknown, or other
  misc_feature (689)..(689): n is a, c, t, g, unknown, or other
  misc_feature (690)..(690): n is a, c, t, g, unknown, or other
aaagctggagctccccgcggtggcggccgctctagaactagtggatcccccgggctgcaggaattcgcacgagaccattacctagaacatcctaatcgaaaaattcttttctgctgctgcgaccgtaggatcggcgtccagcagcctcgccgcgtcggtatggttttcccttggcccacacatcctagctcttccgcattcttgaatttcgtggtcgaggattagggggtttctcgtgcgctggtccaatttcgcgctaatcgtcctgttcctgcctcggattactcgccttctcgtggtccccatctgttcttggcgttcgcacgcttgccgtgcggcgggcagggctgcagcagcagccggcagcgcgtgcatcttgcgaccccctttccaagaaccagctgcaagctttggccttttccgcctgccgtacccgaaatcccgcaagaaactccacccaagaaaaaagcggcgctccttttggctggctggctgccattcctcacgccccaccgagtttgggtgaggctttgaaacgagcacagttcacaagacagtgaggcttgccnggtgggtgtttcctcgtcgggagatgggagggaaatttgccgccgcaaaccatggtccccaggcggaggcccccttcgatctgggggcagccgtttccacttcgccgtccaaacccaggnngctccaggttttacc

SEQ ID NO: 27844 - DNA, 717 bp, Zea mays
  misc_feature: Ceres CLONE 1401337-F
  misc_feature (541)..(541): n is a, c, t, g, unknown, or other
  misc_feature (594)..(594): n is a, c, t, g, unknown, or other
  misc_feature (601)..(601): n is a, c, t, g, unknown, or other
  misc_feature (602)..(602): n is a, c, t, g, unknown, or other
  misc_feature (604)..(604): n is a, c, t, g, unknown, or other
  misc_feature (651)..(651): n is a, c, t, g, unknown, or other
caaagctggagctccccgcggtggcggccgctctagaactagtggatcccccgggctgcaggaattcgcacgagaccattacctagaacatcctaatcgaaaaagaaaatacgcacctgctcctcactcttctttatatttttttctccatttggcaacttttgcttgtcgttcatgtatatgcatgaccctttcacacatatgatcagaagataagcacatgcaagacgatctcgcgtggatatgatgcatggatcagacctaacctctatatcatcaccaaacgctcgtagatgatgctatacaattccatgattaaattatatataagtaaaaaaaaaagaaccgtacgtgcatacataaaattaagaattaatggctgccaatggacgacatatgcatggacaggtaagctggtgatcccactgaaccgggaggcgcccaacttccggtccatgatcgggatgatcgacgggaggacggagctgaagccgctgccagccagcggcggcccagaggacggcggctgcaggtgtgggcngttcctccgcggccgccggatccgggcggcgatgacacttaacttggacgtgnagagcgnnanccgcgccgggtgccgctggtgcagcagcagtacgtgaacgggggggntcgtccgcctcgcaacttctcccgggttcgaggggagcatgatggccgccaagatcgcctacgaga

SEQ ID NO: 27845 - DNA, 711 bp, Zea mays
  misc_feature: Ceres CLONE 1401338-F
  misc_feature: Encodes the peptide sequence at SEQ ID NO. 27846
  misc_feature (356)..(356): n is a, c, t, g, unknown, or other
  misc_feature (414)..(414): n is a, c, t, g, unknown, or other
  misc_feature (471)..(471): n is a, c, t, g, unknown, or other
  misc_feature (490)..(490): n is a, c, t, g, unknown, or other
aaagctggagctccccgcggtggcggccgctctagaatagtggatcccccgggctgcaggaattcgcacgagaccattacctagaacatcctaatcaaaaaggtagctttcgctgccgtcctacggcaggtgcccaagtcttcttcgggcccttcaacgacgacgagcactaccagtttgttgaagatggaaaataaagagttgttcaagatgggaagtgcagatacagatactgctgcactgcacaaggagtgggatgatgttctctgtccgatatgcatggaccatccgcacaatgctgtccttctgttgtgcagctcccatgacaaaggatgccgatcctatatatgtgatancagctataggcattcaaattgcctagataggttcaagaaaatgaaagtgaatgatgangacagtccttcacagtcaagctcggtcatgcctaggggtacaggaaaccaaaatgtngtccagagatctcgttttngtcccactagagagagccccaggctaccctaagactatctggaccggatgaactttccgatcatcaggatgccgccacagaactgtttgcattaattggagacgggaaaaaacttctcatgggaggccaaaatttacttggaaactcccgggggtggggacaaggggttttcgggggaaggggggggggaaggttaaaccattttggccccctgggcaaag

SEQ ID NO: 27846 - protein, 111 aa, Zea mays
  misc_feature: Ceres CLONE 1401338-F
  misc_feature (23)..(111): Pfam Name: DUF1644 Pfam Description: Protein of unknown function (DUF1644)
  misc_feature (57)..(57): Xaa is any aa, unknown, or other
  misc_feature (76)..(76): Xaa is any aa, unknown, or other
  misc_feature (102)..(102): Xaa is any aa, unknown, or other
MENKELFKMGSADTDTAALHKEWDDVLCPICMDHPHNAVLLLCSSHDKGCRSYICDXSYRHSNCLDRFKKMKVNDXDSPSQSSSVMPRGTGNQNVVQRSRFXPTRESPRLP

SEQ ID NO: 27847 - DNA, 709 bp, Zea mays
  misc_feature: Ceres CLONE 1401340-F
  misc_feature: Encodes the peptide sequence at SEQ ID NO. 27848
  misc_feature (515)..(515): n is a, c, t, g, unknown, or other
  misc_feature (516)..(516): n is a, c, t, g, unknown, or other
  misc_feature (527)..(527): n is a, c, t, g, unknown, or other
  misc_feature (530)..(530): n is a, c, t, g, unknown, or other
  misc_feature (623)..(623): n is a, c, t, g, unknown, or other
aaagctggagctccccgcggtggcggccgctctagaactagtggatcccccgggctgcaggaattcgcacgagaccattacctagaacatcctaatcgaaaacacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacacctccccgggctcgcccgcgcagcgcttcgtgtcggaggaacgcgtcatcaactcgcgcccgcnnggtgctggcgncgncagctgcatcaacgccggcttctacacgcgggccagcgacgactacggtgcgggcgtcgggtgggacctgggcgccgccgggcggcgtaccgntggggggaggacgtggtggcgttcagccgagctgggggccctggcaggcgcgctgcagggcgcctgctcaaagccggggtcccgcg

SEQ ID NO: 27848 - protein, 186 aa, Zea mays
  misc_feature: Ceres CLONE 1401340-F
  misc_feature: SWISSPROT Homolog: EC 4.1.2.10 Mandelonitrile lyase
  misc_feature (122)..(122): Xaa is any aa, unknown, or other
  misc_feature (126)..(126): Xaa is any aa, unknown, or other
  misc_feature (127)..(127): Xaa is any aa, unknown, or other
  misc_feature (158)..(158): Xaa is any aa, unknown, or other
MSGRSRHFTMSTLLATSFFFVLLCSSLQVRGVNYTFVKDAALAPSVSYYDYIIVGGGTAGCPLAATLSERFRVLLLERGASPYDDDRIGDMARFADTLSDTSPGSPAQRFVSEERVINSRPXGAGXXSCINAGFYTRASDDYGAGVGWDLGAAGRRTXGGRTWWRSAELGALAGALQGACSKPGSR

SEQ ID NO: 27849 - DNA, 721 bp, Zea mays
  misc_feature: Ceres CLONE 1401343-F
  misc_feature: Encodes the peptide sequence at SEQ ID NO. 27850
  misc_feature (514)..(514): n is a, c, t, g, unknown, or other
  misc_feature (519)..(519): n is a, c, t, g, unknown, or other
  misc_feature (520)..(520): n is a, c, t, g, unknown, or other
  misc_feature (553)..(553): n is a, c, t, g, unknown, or other
  misc_feature (602)..(602): n is a, c, t, g, unknown, or other
  misc_feature (632)..(632): n is a, c, t, g, unknown, or other
  misc_feature (667)..(667): n is a, c, t, g, unknown, or other
tggagctccccgcggtggcggccgctctagaactagtggatcccccgggctgcaggaattcgcacgagaccattacctagaacatcctaatcgaaaaattatccccagctttttctccaagcgtccgttcaggaagctgtccggcaacgagccgctcggcactgggcggtggccgtgcaagagcgatcgggaccgcatcgctcgtctgctcctccaggcctccgcctccctcatcatcactgcagcggcgagaagaacaagggacggtccggcggtggtctccactgacatcgcctaccatggctaccatgctgcgccggtgcatgcgggatctgcgcccgctgcggtctctcgcgagggtccccagaccgatcttcttcgagagtccaacatttcttagatgtagaagcaactcaacaaaggcatctccaaagagttctacacagaatgctgccccaggtcctcaagggacaccttctcagtcgggaagtaatgtttcaaagcttgctcttgnaactnncttgtggtcgtgcagcagctataggtgcacatncacttgggtatatagatctttcatttaaggacaagacattgccttttancttaaagaagggagatgtcggaaaggtggnatatgaagatctgaagattcttctggacagaaggntgacagacacaaaactgtcaggacaaacactgagatttgtcagagaccatatga

SEQ ID NO: 27850 - protein, 90 aa, Zea mays
  misc_feature: Ceres CLONE 1401343-F
  misc_feature (69)..(69): Xaa is any aa, unknown, or other
  misc_feature (71)..(71): Xaa is any aa, unknown, or other
  misc_feature (82)..(82): Xaa is any aa, unknown, or other
MLRRCMRDLRPLRSLARVPRPIFFESPTFLRCRSNSTKASPKSSTQNAAPGPQGTPSQSGSNVSKLALXTXLWSCSSYRCTXTWVYRSFI

SEQ ID NO: 27851 - DNA, 720 bp, Zea mays
  misc_feature: Ceres CLONE 1401346-F
  misc_feature: Encodes the peptide sequence at SEQ ID NO. 27852
  misc_feature (650)..(650): n is a, c, t, g, unknown, or other
tggagctccccgcggtggcggccgctctagaactagtggatcccccgggctgcaggaattcgcacgagaccattacctagaacatcctaaaaaaaaaacgaaccaaacataaattcagcccaccgctcctgctgctgctgcttcgaggacaggacggagggagctcacgcgcgagcaaagcaaagcacaagcagcaatggggatctgctgcggcaaggccaaggcggcggcaggggagcccgacgacgacgagggcctgggcttcccatggatgcacgacgacctgttccacagccacctgtgggccagcgccggcgtctccgtgcacaccaagcagggatggaagggcgccaaccaggacgccatgaccgtctgccaggacttcgccggccagaaaggtcacatccctctgcggagtgttcgatggccacggccctcgtgggccgggaagtcgctcgccacgtccgcgacaccctcccggtggaactagccgccgctctgaagccgagaaccggggacgaagatccctccgcctcgagcgacgcttcgaagcctaaacctgacgaagatggcccaggcgagaaatggagaagatggctcaggcaagaatggagacgcttcgagcaacgccgatttggattccttcgacnagtcaggaggtagcggctcgtccagcgacgaaacgagcgacgagagcagcagcagctgctgctgtcactt

SEQ ID NO: 27852 - protein, 97 aa, Zea mays
  misc_feature: Ceres CLONE 1401346-F
MGICCGKAKAAAGEPDDDEGLGFPWMHDDLFHSHLWASAGVSVHTKQGWKGANQDAMTVCQDFAGQKGHIPLRSVRWPRPSWAGKSLATSATPSRWN

SEQ ID NO: 27853 - DNA, 683 bp, Zea mays
  misc_feature: Ceres CLONE 1401348-F
  misc_feature: Encodes the peptide sequence at SEQ ID NO. 27854
  misc_feature (444)..(444): n is a, c, t, g, unknown, or other
  misc_feature (447)..(447): n is a, c, t, g, unknown, or other
  misc_feature (449)..(449): n is a, c, t, g, unknown, or other
  misc_feature (454)..(454): n is a, c, t, g, unknown, or other
  misc_feature (455)..(455): n is a, c, t, g, unknown, or other
  misc_feature (497)..(497): n is a, c, t, g, unknown, or other
  misc_feature (600)..(600): n is a, c, t, g, unknown, or other
tggagctccccgcggtggcggccgctctagaactagtggatcccccgggctgcaggaattcgcacgagaccattacctagaacatcctaatcgaaaaagccatcagatcagatcaaacaatccgcctccgcctccgcctccctagggttttgctctcggctcgtcggatccagttcgggggatcctccatggcgtcgcgtccgtcgctgaagtcgaagcccaagggcaagggcgggaagaaggccaccgctgacgacgaggacgccaccgcggcggcgaccacggtgaggctcatgaaggagtggaccacgtggacgatgaagaaggcgaaggtggtggcgcactacggcttcatccccctcgtcatcgtcatcggcatgaactccgagccccagccctccgtcttccagctcctctcccccgtctgatcggatcatgacaggnccngnatganngtcgtccgtagtagtttgtagctgggacttcatttgcttacntatgtccgagatcgagttgaagaaaggtgatcatgctttcttggccgattttgaaaggattgggtaaataattttgaaggggcggatgccttctaaacatcgnatcaaaaatggcttgggtatggggactgcagggctaaggtttggtggactaaaaaaaaaaaaaaaggtttcgatccgcccacc

SEQ ID NO: 27854 - protein, 79 aa, Zea mays
  misc_feature: Ceres CLONE 1401348-F
  misc_feature (37)..(76): Pfam Name: Tom7 Pfam Description: TOM7 family
MASRPSLKSKPKGKGGKKATADDEDATAAATTVRLMKEWTTWTMKKAKVVAHYGFIPLVIVIGMNSEPQPSVFQLLSPV

SEQ ID NO: 27855 - DNA, 683 bp, Zea mays
  misc_feature: Ceres CLONE 1401354-F
  misc_feature (620)..(620): n is a, c, t, g, unknown, or other
tggagctcaccgcggtggcggccgctctagaactagtggatcccccgggctgcaggaattcgcacgagaccattacctagaacatcctaatcgaaaaaaaacccggagcccggcactgcgtttgtccctgcatgctgcgaaccctgactcttctcgtctcccgatcccctcgccgagagagctcgctctctctctctctctcctctgaggagacgactgggcgcccgcaaccctggcagccaccgccgcccagtccccgacgggccattcgacagatcttcttcggcctcttctccgacgaggagacacactactcgaacatgcgtacacccagtccaatgcgttaactgcgcccgcccctgagactagtaatcctgctgagttctgaggatctggctagcggaggattgacgagactatacgatcacgatagattcgctgtgaaatacgaaggacgctcagatcatgatctaggaccagcgcatgatactggccatagactcgtcaaccacatcaatcactgcccctgatttgagcgcgctgaagagcaacttctgagataagaagttgcagtacgagcgtcatggatgtggagcggacgcaaaaaagagaaaagtagnacgtttggggcgaattgtataccaaaaagaagaacaacaccggccaggggtcaaaggatgatg

SEQ ID NO: 27856 - DNA, 695 bp, Zea mays
  misc_feature: Ceres CLONE 1401355-F
  misc_feature: Encodes the peptide sequence at SEQ ID NO. 27857
  misc_feature (462)..(462): n is a, c, t, g, unknown, or other
  misc_feature (468)..(468): n is a, c, t, g, unknown, or other
  misc_feature (469)..(469): n is a, c, t, g, unknown, or other
  misc_feature (550)..(550): n is a, c, t, g, unknown, or other
  misc_feature (622)..(622): n is a, c, t, g, unknown, or other
  misc_feature (686)..(686): n is a, c, t, g, unknown, or other
tggagctccccgcggtggcggccgctctagaactagtggatcccccgggctgcaggaattcgcacgagaccattacctagaacatcctaatcgaaaagtttcctctctccaattcccacccgcgtcaaggagcttctcgtctgagcccgagctaacaagctcaccggcgggcaggatgctggcggcgtccaccaaggtcggctctaggctggcctctccgcacgcctccttgtccgccggtgctgcagcggcggcgctggcgagctcccccgtgctgggctctgggatgctcccaggcgccgggttcggcgagacggggagtcaccacgcggcggacgcgccgccgccgctgccttgcagttcctcgggcgattcaagggaatattatcagtggaagagactggtgaatcaaaggcagtcaacgctagatggaggcaaagtgcctgctgcattgggccaccnatggtnnttggtgcgggcttttcctcacggaaccaacatatctacagatatttttcatcttctcatcaggggagtatatgggccgggnagcaaggttctacatgacctgccagggtatgtaaaaattggtggactagggccacgagatggtctacagaantgagaaggacatcgtgccaacaccctggtaaaggtgagcttatacgaagatggccacatccggnattacctgg

SEQ ID NO: 27857 - protein, 148 aa, Zea mays
  misc_feature: Ceres CLONE 1401355-F
  misc_feature (96)..(96): Xaa is any aa, unknown, or other
  misc_feature (98)..(98): Xaa is any aa, unknown, or other
MLAASTKVGSRLASPHASLSAGAAAAALASSPVLGSGMLPGAGFGETGSHHAADAPPPLPCSSSGDSREYYQWKRLVNQRQSTLDGGKVPAALGHXWXLVRAFPHGTNISTDIFHLLIRGVYGPGSKVLHDLPGYVKIGGLGPRDGLQ

SEQ ID NO: 27858 - DNA, 684 bp, Zea mays
  misc_feature: Ceres CLONE 1401363-F
  misc_feature: Encodes the peptide sequence at SEQ ID NO. 27859
  misc_feature (590)..(590): n is a, c, t, g, unknown, or other
  misc_feature (591)..(591): n is a, c, t, g, unknown, or other
  misc_feature (632)..(632): n is a, c, t, g, unknown, or other
  misc_feature (667)..(667): n is a, c, t, g, unknown, or other
ggagctccccgcggtggcggccgctctagaactagtggatcccccgggctgcaggaattcgcacgagaccattacctagaacatcctaatcgaaaaacattattcaggtccaggtcacatgatgcacagacagcccgtccgacgccgcgttagctacttgcctacttcagctatatgaaacggcaaaagtcttcccctcgttccccaatctcctctccatcgaaaccctagcacgacgcaattcccgtcttcccacgccgtgtcgccgttgctatgggcaagaagcggaagctcgagcccaaatcggcggcagggttcacgccggttaaggcctccccgaccaccaggtctgccaccgctaaggccgctggtctatccgaggtcctcgcccccgtcgaggctacgatggagaagctgccgcagggggcaggcggcgaggatgtagaggaaatcgaggaggtggaggtcgaggaggaagtggaagtggaagaggaagaagaaggcgagagcgaccaggcttcgatccaggcgctgctggattcgttccccaaggaccagctcgtcgagctggtacgcgacgctgccatcgnntcacggcgacgtgctaaccactatccggcgcgtggccgacngcgaccccgctcagcggaagatcttcgtacacggnctcggctgggacacacg

SEQ ID NO: 27859 - protein, 137 aa, Zea mays
  misc_feature: Ceres CLONE 1401363-F
  misc_feature (106)..(106): Xaa is any aa, unknown, or other
  misc_feature (120)..(120): Xaa is any aa, unknown, or other
  misc_feature (132)..(132): Xaa is any aa, unknown, or other
MGKKRKLEPKSAAGFTPVKASPTTRSATAKAAGLSEVLAPVEATMEKLPQGAGGEDVEEIEEVEVEEEVEVEEEEEGESDQASIQALLDSFPKDQLVELVRDAAIXSRRRANHYPARGRXRPRSAEDLRTRXRLGHT

SEQ ID NO: 27860 - DNA, 709 bp, Zea mays
  misc_feature: Ceres CLONE 1401365-F
  misc_feature: Encodes the peptide sequence at SEQ ID NO. 27861
  misc_feature (250)..(250): n is a, c, t, g, unknown, or other
  misc_feature (281)..(281): n is a, c, t, g, unknown, or other
  misc_feature (399)..(399): n is a, c, t, g, unknown, or other
  misc_feature (499)..(499): n is a, c, t, g, unknown, or other
  misc_feature (630)..(630): n is a, c, t, g, unknown, or other
  misc_feature (645)..(645): n is a, c, t, g, unknown, or other
  misc_feature (661)..(661): n is a, c, t, g, unknown, or other
  misc_feature (670)..(670): n is a, c, t, g, unknown, or other
aagctggagctccccgcggtggcggccgctctagaactagtggatcccccgggctgcaggaattcgcacgagaccattacctaaaacatcctaaatcgaaaagagctcaaacacacatcaagaaagcaagaaagaaaagactgtagctagctagccaccgcgcgcgcgcacgagtagtctaactagaatacactcgcgttcaaaacaaacacacagcgtcgtgcttgcgtgatctctgaccgcgtcgacnactaccgcagcaccaagcagctgatggcggncaccgtatcttcctgcctgagcctcgtccccacgtgcacccacgggccggcgggttccccagcagtgtgcactgacgacacgcttcagcgccgtcgtcgttctcgcgctatcttgtcngcgccttcgggaacagagccgacaggaagtcgcccctggacgatcgaggagtgggactcaggtttatcaaggcgcggccgacacagggactcccccccgntggcgggaaggtcaccgcagcacactggggaagggtctgttgacacccttgaaggggtgggtcttcaggagatcattcgctatgggaaggtccccaaggccacctaagaaggtttcgattacgaccgcttnctcccctactggggnagctgcagtaacccgngaagacttnctttcacgacgtccgccttcgggggatttgggttacgag

SEQ ID NO: 27861 - protein, 110 aa, Zea mays
  misc_feature: Ceres CLONE 1401365-F
  misc_feature (3)..(3): Xaa is any aa, unknown, or other
  misc_feature (76)..(76): Xaa is any aa, unknown, or other
MAXTVSSCLSLVPTCTHGPAGSPAVCTDDTLQRRRRSRAILSAPSGTEPTGSRPWTIEEWDSGLSRRGRHRDSPPXAGRSPQHTGEGSVDTLEGVGLQEIIRYGKVPKAT

SEQ ID NO: 27862 - DNA, 698 bp, Zea mays
  misc_feature: Ceres CLONE 1401367-F
  misc_feature: Encodes the peptide sequence at SEQ ID NO. 27863
  misc_feature (351)..(351): n is a, c, t, g, unknown, or other
  misc_feature (560)..(560): n is a, c, t, g, unknown, or other
aaagctggagctccccgcggtggcggccgctctagaactagtggatcccccgggctgcaggaattcgcacgagaccattacctagaacatcctaatcgaaaactctttccataccttgccgggtcgttgccaaatgccaacgcaggcgccgggcagtgcacgcacatggctgcgcgcgtgggcctgctcccgcacgcgatcctcgtctcctcccgagctctacccacgccccgagctcgcgtcccttatcctcttccacccgtcccttcctacctccgccacgcctcctcctccgccttccgctcctgccgcgcgtcgccgcgttttgtcgcagtccgcgccatggcttcngggaacccctacgccgccgagctcgccgccgccaagaaggccgtcaccctcgccgccaaactctgccagacagttcaacaggatattatgcattctggcgttcaggctaaggcagacaaaagtcctgttacagtggctgattatggatctcaaatattgggtcggttttcccttaagatggatgtatcatctggaccattttcattggntgctgaagagactcagatgaattgagaaaagatgcgctgaagaaattttggaagatatactgaccttgtcatgaacccatcttgatgatggtcatatacatttcattacaagggaggtatctctctgcaatgatgatg

SEQ ID NO: 27863 - protein, 80 aa, Zea mays
  misc_feature: Ceres CLONE 1401367-F
  misc_feature: SWISSPROT Homolog: EC 3.1.3.7 3'(2'),5'-bisphosphate nucleotidase
  misc_feature (73)..(73): Xaa is any aa, unknown, or other
MASGNPYAAELAAAKKAVTLAAKLCQTVQQDIMHSGVQAKADKSPVTVADYGSQILGRFSLKMDVSSGPFSLXAEETQMN

SEQ ID NO: 27864 - DNA, 708 bp, Zea mays
  misc_feature: Ceres CLONE 1401368-F
  misc_feature: Encodes the peptide sequence at SEQ ID NO. 27865
aagctggagctccccgcggtggcggccgctctagaactagtggatcccccgggctgcaggaattcgcacgagaccattacctagaacatcctaatcgaaaaattaggaccgccgcacgagttcgcgactgccgatgtcgacatcgcgcgcgcagacccctacctctgtcgagtcctccgatgggtcgagcctcctatccgcttggctcgacgcgcccgtgtctctatggagatctctcgacgcgagcttccctcccctcccggagtcttccaggttccttgctgaggtctccgaccgccggctccgatgcttcagcaactgccggcccctgcgctgaaggcgctcggctctacctctccctcgccgtccggtgggcgcgcactctgatctaattggtggtgacatgccctcagtcttggagaccttagatgatggtgcgcatgacaccctgtctagttttgcacagcattcgcagagcttactatctgggaggctccagtctgagtcacttgtcggcgaaagtgtactcaattaatttcagagaggccaagggcttgtggagatgagcgtataaaccctccctagattcgggagtatggtcgcgctgcaaaaaatattggaatctgtgtcggaatggggccaccatagtggttggccttacaagtatgcaactgggcttggcccttttccttgggagggtcattctgg

SEQ ID NO: 27865 - protein, 67 aa, Zea mays
  misc_feature: Ceres CLONE 1401368-F
MSTSRAQTPTSVESSDGSSLLSAWLDAPVSLWRSLDASFPPLPESSRFLAEVSDRRLRCFSNCRPLR

SEQ ID NO: 27866 - DNA, 728 bp, Zea mays
  misc_feature: Ceres CLONE 1401369-F
  misc_feature: Encodes the peptide sequence at SEQ ID NO. 27867
  misc_feature (445)..(445): n is a, c, t, g, unknown, or other
  misc_feature (466)..(466): n is a, c, t, g, unknown, or other
  misc_feature (507)..(507): n is a, c, t, g, unknown, or other
  misc_feature (508)..(508): n is a, c, t, g, unknown, or other
  misc_feature (571)..(571): n is a, c, t, g, unknown, or other
  misc_feature (572)..(572): n is a, c, t, g, unknown, or other
  misc_feature (601)..(601): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
ggagctccccgcggtggcggccgctctagaactagtggatcccccgggctgcaggaattcgcacgagaccattacctagaacatcctaatcgaaaaaaaggtggcaggcacagagagagctagctttggccaggcgtccacagcagccagcacaagatgtcgacggtggtcatgggggtggatcttgagtgccacaagtgctacaagaagatcaggaaggtcctctgcaaggtccaagacaaggtgagcatcaggaccatctcctacgacgagaagaacaacacggtgacggtgtccgggcccttcgacgccgaggaggtcgccgacaggctcaccgccgacgccggcaaggtcatcaccgacatacacgtcgtcgggggcttcggcttcggctttgggcggggggcggaggcgggaggcggagggaaacaacagaagcacgggngccgtcgctaccgggcccgancacgcccactcctcgatggcaccactcgtgtcacctcttcnncgcgcgacgcagccgccatggaccccgtcgcccaaatgggggctaaccccgctcgcggggccnnaacccgggagatctacgaccctctggagnccgcgagaagcgggcgccagcgtcccgacatcgagctcatcgccgtccgagaactcaccttcttcgccggggtttgggaccggggnnnnnnnnnnnnnnnnnnnnnnnnnnnnnnnnnnnnnnnnnn

SEQ ID NO: 27867 - protein, 177 aa, Zea mays
  misc_feature: Ceres CLONE 1401369-F
  misc_feature (97)..(97): Xaa is any aa, unknown, or other
  misc_feature (104)..(104): Xaa is any aa, unknown, or other
  misc_feature (118)..(118): Xaa is any aa, unknown, or other
  misc_feature (139)..(139): Xaa is any aa, unknown, or other
  misc_feature (149)..(149): Xaa is any aa, unknown, or other
MSTVVMGVDLECHKCYKKIRKVLCKVQDKVSIRTISYDEKNNTVTVSGPFDAEEVADRLTADAGKVITDIHVVGGFGFGFGRGAEAGGGGKQQKHGXRRYRARXRPLLDGTTRVTSSXRDAAAMDPVAQMGANPARGAXTREIYDPLEXARSGRQRPDIELIAVRELTFFAGVWDRG

SEQ ID NO: 27868 - DNA, 716 bp, Zea mays
  misc_feature: Ceres CLONE 1401370-F
  misc_feature: Encodes the peptide sequence at SEQ ID NO. 27869
  misc_feature (560)..(560): n is a, c, t, g, unknown, or other
  misc_feature (568)..(568): n is a, c, t, g, unknown, or other
  misc_feature (569)..(569): n is a, c, t, g, unknown, or other
  misc_feature (632)..(632): n is a, c, t, g, unknown, or other
  misc_feature (652)..(652): n is a, c, t, g, unknown, or other
  misc_feature (654)..(654): n is a, c, t, g, unknown, or other
  misc_feature (657)..(657): n is a, c, t, g, unknown, or other
aaagctggagctccccgcggtggcggccgctctagaactagtggatcccccgggctgcaggaattcgcacgagaccattacctagaacatcctaatcgaaaaacaatccacccgcgtcggcacgagcacccacagcagttggcgcgcaccaaaaccctaccctccctctgctctcagccgccaacgccatgggctccaccgccgctgcctccgtgctcccggtgtccgccggctccggcgagaacctcgtcctcatcctcgactacggctcgcagtacacgcacctcatcacccgccgcgtgcgccagctcggcgtcctctccctctgcgtgtccggcacggcgccgctcgcctccctggagggcctccgcccacgcgccgtcatcctctccggcgggccccactcagtccacgcccccggggcgcccgccttccccgagggattcctgggcttcgcggctgccgcgggcgcgcacgtgctcggcgtctgctatgggatgcagctcctcgtgcagtccctcggaggcgccgttgtgtccggggagcgccaggagtacggnaaaatggnnacgttgaggtgacggcggcctcctccgcgctctacgggcaggcggagaccggaagcggcagancgggtgtggatgagcatggncnacnaggtggtaggcttgtgcgaaagggtttctcgaggtggttggctcgcagcgtggcaggga

SEQ ID NO: 27869 - protein, 130 aa, Zea mays
  misc_feature: Ceres CLONE 1401370-F
  misc_feature: SWISSPROT Homolog: EC 6.3.5.2 GMP synthase (glutamine-hydrolyzing)
  misc_feature (127)..(127): Xaa is any aa, unknown, or other
MGSTAAASVLPVSAGSGENLVLILDYGSQYTHLITRRVRQLGVLSLCVSGTAPLASLEGLRPRAVILSGGPHSVHAPGAPAFPEGFLGFAAAAGAHVLGVCYGMQLLVQSLGGAVVSGERQEYGKMXTLR

SEQ ID NO: 27870 - DNA, 696 bp, Zea mays
  misc_feature: Ceres CLONE 1401372-F
  misc_feature: Encodes the peptide sequence at SEQ ID NO. 27871
ggagctccccgcggtggcggccgctctagaactagtggatcccccgggctgcaggaattcgcacgagaccattacctagaacatcctaatcaaaaaagactagattagtgttgctaagagcctttttaactacgggattacgcaagtctcgtatactcatccagagagagacacggaggacctgggtttggttgcgctgcttgactcgctccgtgttccaagcgccttttgagcattcaggcagatataaaattcctctttttacactacaatccccgctgaatcagcagcagcaactctctccctctccgttcttggtggtccgagacccttggccgtacgctctgcctcactcctccgtctcttgcttcccttgccgccggcggcgcgcggcgccggacgcggatcggcggcgggtgcatgcaggaggccgacgccgccatgccgtaaggcaccttgcgtcggttgacatggggaaaatcattcgtgaacggaccgctgaggttcaggaaatcatcgacatgggtgattatgctgggggactaagtcgccaactaaatggatccattttaccatctgaacgaccaaaccatttgatggagaaaggtgtgaaacccccttgaagttgtggctgttataacgacatttaatttccctgcgctgagcttgcctggaaagcttgctttgctttggccg

SEQ ID NO: 27871 - protein, 50 aa, Zea mays
  misc_feature: Ceres CLONE 1401372-F
  misc_feature: SWISSPROT Homolog: EC 1.2.1.3 Aldehyde dehydrogenase (NAD(+))
MGKIIRERTAEVQEIIDMGDYAGGLSRQLNGSILPSERPNHLMEKGVKPP

SEQ ID NO: 27872 - DNA, 724 bp, Zea mays
  misc_feature: Ceres CLONE 1401374-F
  misc_feature: Encodes the peptide sequence at SEQ ID NO. 27873
  misc_feature (615)..(615): n is a, c, t, g, unknown, or other
  misc_feature (633)..(633): n is a, c, t, g, unknown, or other
aaagctggagctccccgcggtggcggccgctctagaactagtggatcccccgggctgcaggaattcgcacgagaccattacctagaacatcctaatcgaaaaattcccctttccacctcgctctctctctctctcctcccactgctcgccctctctctcttacgcgcgcgtgacaacctccctccctccactgcgcgcggcgcgggagcagcagcggcagcacccaccgactgatcgccggtgggcggggcgggggcgatctgatgcgggcgcggcggtgatggcagcgccatccggcggtgggggcggcggtgcgggggaggtctcctcctcggccgccgcagctgcgacgatcggggtccacggggtggaccaagttgcagaggcgatgtggcagatgaatttggaagaagccatggaactggggccatacccagagcgtgttggtgagccagactgtagctattacatgaggactggcatgtgcaggtttgggattacctgtaaatttaatcacccagcagacagaaagctggctgttgctgctgcaagaatgaagggagaatatcctcaaagaattgggcagcctgaatgtcaatactatctgaagactgncacgtgcaagttttgagncaacttgcaagtttcatcatcccccgagaaagggctgcatggcaacttcgagttcagtttgatgaactgggctacccactccgccgaatga

SEQ ID NO: 27873 - protein, 116 aa, Zea mays
  misc_feature: Ceres CLONE 1401374-F
  misc_feature (55)..(81): Pfam Name: zf-CCCH Pfam Description: Zinc finger C-x8-C-x5-C-x3-H type (and similar)
  misc_feature (112)..(112): Xaa is any aa, unknown, or other
MAAPSGGGGGGAGEVSSSAAAAATIGVHGVDQVAEAMWQMNLEEAMELGPYPERVGEPDCSYYMRTGMCRFGITCKFNHPADRKLAVAAARMKGEYPQRIGQPECQYYLKTXTCKF

SEQ ID NO: 27874 - DNA, 745 bp, Zea mays
  misc_feature: Ceres CLONE 1401378-F
  misc_feature (282)..(282): n is a, c, t, g, unknown, or other
  misc_feature (288)..(288): n is a, c, t, g, unknown, or other
  misc_feature (292)..(292): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (308)..(308): n is a, c, t, g, unknown, or other
  misc_feature (310)..(310): n is a, c, t, g, unknown, or other
  misc_feature (311)..(311): n is a, c, t, g, unknown, or other
  misc_feature (318)..(318): n is a, c, t, g, unknown, or other
  misc_feature (319)..(319): n is a, c, t, g, unknown, or other
  misc_feature (321)..(321): n is a, c, t, g, unknown, or other
  misc_feature (322)..(322): n is a, c, t, g, unknown, or other
  misc_feature (327)..(327): n is a, c, t, g, unknown, or other
aaagctggagctccccgcggtggcggccgctctagaactagtggatcccccgggctgcaggaattcgcacgagaccattacctagaacatcctaatcaaaaaacaacgcacatgcggaagcggagacgctgacgcacctctgagcctggcggcgatttttctatataaccagcgccgctaattccgggtgcttcgctgtagagatgcggtaaaagcgaaagaagaatccgatccgcttctccacgccgaacccggtaaggccgccgccgcttctcgaatggnctcaanctcntcnnntctcgctcagncnngcgcggnngnnggcgncagcgtcgcccggggcagctccctcgcccgaggatccccgcgaaggtggagggccggggggcccgcccccggtcccgcctaatgcaagggggcggcggggtcccctggccgggtcctggaagggggttgcctggcccccatcaaatttttaaaaaaggggttttgattcccccgcccgggggccccccgggaaatccgcaattggggcccacccggggccccccaaaagggggggcccccctttaaaagagggcccccccctttttttaaccccctccggaaaaaaagacggttggggtgttggtaaaaaacccgggtttttttttgttttaaaacccccccccccgggggggggtttccccggggggggcccctcccctctctttttgggggggggataaaaaggcccccccttttt

SEQ ID NO: 27875 - DNA, 690 bp, Zea mays
  misc_feature: Ceres CLONE 1401379-F
  misc_feature: Encodes the peptide sequence at SEQ ID NO. 27876
  misc_feature (429)..(429): n is a, c, t, g, unknown, or other
aaagctggagctccccgcggtggcggccgctctagaactagtggatcccccgggctgcaggaattcgcacgagacattacctagaacatcctaatcgaaaaattcatcagacggactcacagctcgcagcacctgcaccacttgacaaccagccagctagctaaccaaccggcggagccaagaacaagcaagagacaacttgccccgtccaggcagcatgtgcaactccaacgtcaagtccgcgggcgtcgcccagatcgacggccgcccggtgctgcagccggcgggcaaccgcgtggcggcgccggacgccgcccgcccgctcaagaagtccctgcacaagtccttctccatgccgccttcctacgacaacaatgccaccgtgcccgcccgtcccgcccctgccgagaacaccccgtgcgacgccgnctccgcattctctgctgcctcctaaaacgccggccccggccccggccgccggaagggcacccaaagcgcgggccgcccggccgtggagaaacccccggccaaagggagaacccccttggacgaaaagacggatacaccgccacttcctagaacgggggacacccgagtgaaaaaatcctgggtcaaaccgccgggcccccgcggggaaacgatatgtagaagaggaaaccggctaccccccctaaaaaaaacacaagcgga

SEQ ID NO: 27876 - protein, 78 aa, Zea mays
  misc_feature: Ceres CLONE 1401379-F
  misc_feature (71)..(71): Xaa is any aa, unknown, or other
MCNSNVKSAGVAQIDGRPVLQPAGNRVAAPDAARPLKKSLHKSFSMPPSYDNNATVPARPAPAENTPCDAXSAFSAAS

SEQ ID NO: 27877 - DNA, 708 bp, Zea mays
  misc_feature: Ceres CLONE 1401382-F
  misc_feature: Encodes the peptide sequence at SEQ ID NO. 27878
  misc_feature (633)..(633): n is a, c, t, g, unknown, or other
  misc_feature (656)..(656): n is a, c, t, g, unknown, or other
  misc_feature (674)..(674): n is a, c, t, g, unknown, or other
aagctggagctccccgcggtggcggccgctctagaactagtggatcccccgggctgcaggaattcgcacgagaccattacctagaacatcctaatcgaaaaatttcaaacgcatctcccccctcacctcgctggcctacgtacgtgtacgtctctctctctccgccgcgacccccccacaagcggcgccggcgcccgcgctgcagctaaaccaaaccctaagccacggccaccgccctacgccgcgggctctccgcgatgcgccggcgcgcggaggcgatcgcgagggccgtggtcgagttcctcgacgccgtcatcctggcctgtctccgctcgtgcttcggcgcgcgcccccgccgcggctccggccgccgagatgcgctcgtgcgcggagatcggcccgcggaggtcatctgggatgaagaaggcttagtaaggtacggacgatttcatgaggatttggctgacgggtgtggaatcgatgaggagctcagacgcgaggcaagctacctgaagctatgcggcactatctctgaaacccagctgcactacgcagtgagcaatcgtatgaaaaacatttggcaactactaatgagtgtgatagcaagctcacgtatggaccactggcaaattngcaatgtgctgttgaagctattncatcacaggggcacgcantcccagatggtgagagcgcactcgctcatgtcta

SEQ ID NO: 27878 - protein, 150 aa, Zea mays
  misc_feature: Ceres CLONE 1401382-F
  misc_feature (126)..(126): Xaa is any aa, unknown, or other
  misc_feature (133)..(133): Xaa is any aa, unknown, or other
  misc_feature (139)..(139): Xaa is any aa, unknown, or other
MRRRAEAIARAVVEFLDAVILACLRSCFGARPRRGSGRRDALVRGDRPAEVIWDEEGLVRYGRFHEDLADGCGIDEELRREASYLKLCGTISETQLHYAVSNRMKNIWQLLMSVIASSRMDHWQIXNVLLKLXHHRGTXSQMVRAHSLMS

SEQ ID NO: 27879 - DNA, 732 bp, Zea mays
  misc_feature: Ceres CLONE 1401383-F
  misc_feature: Encodes the peptide sequence at SEQ ID NO. 27880
aaagctggagctccccgcggtggcggccgctctagaactagtggatcccccgggctgcaggaattcgcacgagaccattacctaaaacatcctaatcgaaaaaagtagacaacccagctctccagcggtccagcggtccagcctctcctagccgaggccaaaacccccataccaacacacacttcgcttctcgctgcctccgcggcggcgcgccgctccgctccgagccctcttcctcctcctcctctgcccgttcggtcgagaatgttctactcgcatcagcttctcgcgcggaaggcgccgctcggccagatatggatggcggcgacgctccactcgaagatcaaccgcaaacggctcgacaagctcgacatcatcaaaatctgtgaggaaattttgaacccctcggtgcccatggctctgaggctctctggaatcctcatgggtggcgtggtgatcgtgtacgagagaaagtgaagcttctctacactgatgtctctcggcttctgactgagatcaacgaggcatggcggatcaaaccggtcacagaccccaccggtcctccccaagggtaaaactccagcccaagtatgaagcagtaacactgccagaaatcaatatgggtggtgaaacagcccatggttttctcaaaggctgagggtgccaagttcccgaccaattggaattggaagatctgggatgaacagtattgttcaagtccaatcttgatgg

SEQ ID NO: 27880 - protein, 70 aa, Zea mays
  misc_feature: Ceres CLONE 1401383-F
  misc_feature (1)..(71): Pfam Name: Rad21_Rec8_N Pfam Description: N terminus of Rad21 / Rec8 like protein
MFYSHQLLARKAPLGQIWMAATLHSKINRKRLDKLDIIKICEEILNPSVPMALRLSGILMGGVVIVYERK

SEQ ID NO: 27881 - DNA, 710 bp, Zea mays
  misc_feature: Ceres CLONE 1401386-F
  misc_feature: Encodes the peptide sequence at SEQ ID NO. 27882
  misc_feature (553)..(553): n is a, c, t, g, unknown, or other
  misc_feature (571)..(571): n is a, c, t, g, unknown, or other
  misc_feature (617)..(617): n is a, c, t, g, unknown, or other
  misc_feature (654)..(654): n is a, c, t, g, unknown, or other
aaagctggagctccccgcggtggcggccgctctagaactagtggatcccccgggctgcaggaattcgcacgagaccattacctagaacatcctaatcgaaaatggctgtttctgggagtgggcagcaacatggcagtgtttattggaagaagggcagccatgctgtgttatcctccttggatgctagtaaaagcttgttatctcaactcaaggatgcattttctacaatgaactcaccattatggatggatagtagcacaacaaagcaatgcagagaaatagagaatgcagttggaggtgcactggagttagcaaaactgacaggatctcgtgcgtatgaaagattcactggcccccagataaggaagatctatcagacagcgcctgatgtttatgaagataccgagagaatatctttggtgagctcgttcatggcatctatccttgttggaagctatgcaagtattgatgaaactgatggtgcggggatgaacttgatggatatcaagcaaaggacctggtcaaagtctgctttagaggcaactgctcctgnacttgaaagcaagcttgnaaaatctgcaccagcatattcagctgctggccgaattgctccttanttttgtagaaagtttcagtttgataagaaactgttgntcattcagtggtctgaagatatcctaataggctttgcagttaactctgaatacccc

SEQ ID NO: 27882 - protein, 203 aa, Zea mays
  misc_feature: Ceres CLONE 1401386-F
  misc_feature (1)..(195): Pfam Name: FGGY_N Pfam Description: FGGY family of carbohydrate kinases, N-terminal domain
  misc_feature: SWISSPROT Homolog: EC 2.7.1.17 Xylulokinase
  misc_feature (151)..(151): Xaa is any aa, unknown, or other
  misc_feature (157)..(157): Xaa is any aa, unknown, or other
  misc_feature (172)..(172): Xaa is any aa, unknown, or other
  misc_feature (185)..(185): Xaa is any aa, unknown, or other
MAVSGSGQQHGSVYWKKGSHAVLSSLDASKSLLSQLKDAFSTMNSPLWMDSSTTKQCREIENAVGGALELAKLTGSRAYERFTGPQIRKIYQTAPDVYEDTERISLVSSFMASILVGSYASIDETDGAGMNLMDIKQRTWSKSALEATAPXLESKLXKSAPAYSAAGRIAPXFCRKFQFDKKLLXIQWSEDILIGFAVNSEYP

SEQ ID NO: 27883 - DNA, 723 bp, Zea mays
  misc_feature: Ceres CLONE 1401388-F
  misc_feature: Encodes the peptide sequence at SEQ ID NO. 27884
tggagctccccgcggtggcggccgctctagaactagtggatcccccgggctgcaggatttcgcacgagaccattaccttaaaacattcctaatcgaaaaaaatcgaattcgccattgggcattggttgctccgcgcgcgccgcttgccttcttcccccaacttgcttgcttcctcctcgttgccgcgcttccttcgccgccgcttccccttccctaagggcggccagggcggacgagttcgacgtccgccgccacctctccaccgtcaccaggtatgatgtggccagggagtccagtagtgtcatctccatgccgtcaatcccagacgggtgccgtgtcattcacctcaatttagtggcaagacatgggactcgcgctcctaccaagaagcgcatcaaggagctgattagattggcagttcgactggaagcccttctgaaagaggcaaatcaggtccttgatagtgattctctgaagaaattccatcctggattaaaggctgggatcacgctggaaggtaggactaaaggtgtgagctggattagtgaaaggggagaagagctttacatttagctaccgaatggagggagagggtttcagatctatttgatgacgatatcaccctgatgtatattccataagagccacccagggtcctcgagcatcagctagtgcagtgggcatttgggtttggactactttctgggaaaggaaagcttgaaa

SEQ ID NO: 27884 - protein, 87 aa, Zea mays
  misc_feature: Ceres CLONE 1401388-F
  misc_feature: SWISSPROT Homolog: EC 3.1.3.8 3-phytase
MPSIPDGCRVIHLNLVARHGTRAPTKKRIKELIRLAVRLEALLKEANQVLDSDSLKKFHPGLKAGITLEGRTKGVSWISERGEELYI

SEQ ID NO: 27885 - DNA, 702 bp, Zea mays
  misc_feature: Ceres CLONE 1401390-F
  misc_feature: Encodes the peptide sequence at SEQ ID NO. 27886
  misc_feature (283)..(283): n is a, c, t, g, unknown, or other
  misc_feature (333)..(333): n is a, c, t, g, unknown, or other
  misc_feature (345)..(345): n is a, c, t, g, unknown, or other
  misc_feature (399)..(399): n is a, c, t, g, unknown, or other
  misc_feature (420)..(420): n is a, c, t, g, unknown, or other
  misc_feature (446)..(446): n is a, c, t, g, unknown, or other
ggagctccccgcggtggcggccgctctagaactagtggatcccccgggctgcaggaattcgcacgagaccattacctagaacatcctaaaaaaaaaggaattctgccttcttctctcatcttcctgctcaacatcagtagcagctttagctgtagcagcgccaccggccaccgccacgctatggccaccacgttgcacaagcccctgggggcgatcaccgttgacgacctcgccgcggcggcgcctgggtcggacgccaccgcgctccacgcagcgctccggngcgcgctcgactcgcacggacccaccgaagtgtggggcgagctctgccgntccgtgctctgntcgtctgtccccttcgccgtcaccggatgctctactacggttgctttcggcggntcccgtctcccacggcggcgnctggacgccgaccccaaagagggtgncttggacaatggccgccggtgcctccaaggcgcggggaagggatttcattggcgacgggaaaaaggaatccatccccagtttcccaaaacctccaaaagtttcccaacaaaacccaaaggggaattgaaaaaaggattttagggaatggggaacccatttcgggaaaagccctccctgttttggaaaaaaaactttaaatccggggggggaggggtaccaagggccaagataaaaggtttttaatttttttttttt

SEQ ID NO: 27886 - protein, 135 aa, Zea mays
  misc_feature: Ceres CLONE 1401390-F
  misc_feature (35)..(35): Xaa is any aa, unknown, or other
  misc_feature (55)..(55): Xaa is any aa, unknown, or other
  misc_feature (89)..(89): Xaa is any aa, unknown, or other
MATTLHKPLGAITVDDLAAAAPGSDATALHAALRXALDSHGPTEVWGELCRSVLXSSVPFAVTGCSTTVAFGGSRLPRRRLDADPKEGXLDNGRRCLQGAGKGFHWRREKGIHPQFPKTSKSFPTKPKGELKKGF

SEQ ID NO: 27887 - DNA, 709 bp, Zea mays
  misc_feature: Ceres CLONE 1401392-F
aaagctggagctccccgcggtggcggccgctctagaactagtggatcccccgggctgcaggaattcgcacgagaccattacctagaacatcctaatcaaaacatccagagagagacacggaggacctgggtttggttgcgctgcttgactcgctccgtgttccaagcgccttttgagcattcaggcagatataaaattcctctttttacactacaatccccgctgaatcagcagcagcaactctctccctctccgttcttggtggtccgagacccttggccgtacgctctgcctcactcctccgtctcttgcttcccttgccgccggcggcgcgcggcgccggacgcgaatcggcggcgggtgcatgatgggagcccgccgcgggcgccaaacaaggacagccgccggggccctaccggcagcggagggaacaccgaaacctgtccgcgctcgccgttgcggggggcgtcgacatggtcaccacccggtcctgtgggtccaccacaaaaaccgaacagtgaatggccaccgaaacctgctagaaaaaaatgccgccccccttgaggcggccgaagaaggaaggaaggacttctttcaactgcctcctccgattgcccgacccgtttagtcttgcaatgagctatcgcgccaacccacacaaaagccgggaacccctggttaataccaggacctccgcccccgcggccag

SEQ ID NO: 27888 - DNA, 686 bp, Zea mays
  misc_feature: Ceres CLONE 1401394-F
  misc_feature: Encodes the peptide sequence at SEQ ID NO. 27889
  misc_feature (461)..(461): n is a, c, t, g, unknown, or other
  misc_feature (469)..(469): n is a, c, t, g, unknown, or other
  misc_feature (548)..(548): n is a, c, t, g, unknown, or other
  misc_feature (555)..(555): n is a, c, t, g, unknown, or other
  misc_feature (627)..(627): n is a, c, t, g, unknown, or other
  misc_feature (678)..(678): n is a, c, t, g, unknown, or other
ttagaactagtggatcccccgggctgcaggaattcgcacgagaccattacctagaacatcctaatcgaaaaatcaactcgcaattccgcattcgttccaactcctgagcactttctcctcgtccccgacaagccaatcgaagccgagatacggccatggactccaccggcaccggagcagggggtaaggggaagaagggagcggccgggcgcaaggtcggcgggccaaggaagaagtcggtgtcgaggtccgtgaaggccgggctccagttccccgtcggccgcatcgggcgctacttgaagaagggccgctacgcgcagcgtgtcggcaccggcgcccccgtctaccctcgcgctgtcctcaaatacctcgccgctgaggttctggagctcgctggtaatgctgcccaggacaacaagaagactcgcattattccgcgccacgtgcttctggcgatccgnaacgacgnagagcttgggaagctgctgggcggcgtgaccatcgctcacggcggtgtgctccccatatcacccctggtctgctgcccnagagacngcgaagaaagcgtccagtgtggggagcaaggagcaaagtcgccaagaagggccgcagccccccagagcatanactgactgtctggagtgatctgatgttagcaggacctgatacagtatgcgnggtgcgaa

SEQ ID NO: 27889 - protein, 157 aa, Zea mays
  misc_feature: Ceres CLONE 1401394-F
  misc_feature (31)..(104): Pfam Name: Histone Pfam Description: Core histone H2A/H2B/H3/H4
  misc_feature (105)..(105): Xaa is any aa, unknown, or other
  misc_feature (134)..(134): Xaa is any aa, unknown, or other
MDSTGTGAGGKGKKGAAGRKVGGPRKKSVSRSVKAGLQFPVGRIGRYLKKGRYAQRVGTGAPVYPRAVLKYLAAEVLELAGNAAQDNKKTRIIPRHVLLAIRNDXELGKLLGGVTIAHGGVLPISPLVCCPRDXEESVQCGEQGAKSPRRAAAPQSI

SEQ ID NO: 27890 - DNA, 695 bp, Zea mays
  misc_feature: Ceres CLONE 1401399-F
  misc_feature: Pfam Name: Dak1 Pfam Description: Dak1 domain
  misc_feature: SWISSPROT Homolog: EC 2.7.1.29 Glycerone kinase
  misc_feature (319)..(319): n is a, c, t, g, unknown, or other
  misc_feature (662)..(662): n is a, c, t, g, unknown, or other
aagctggagctccccgcggtggcggccgctctagaatagtggatcccccgggctgcaggaattcgcacgagaccattacctagaacatcctaatcgaaaagacttcatactgctcgcctcgccgtctttcccccaatctgttgctcctccaagctgcgggcgatcgccgtaccccggccgccgcagggaaccccctcgccatggccttgcaggggaagaactcatcaacaaccccgacgatgtggtgacggagttcatcgaaggggtggtgaagacttacccgggtctgcagtacctcgacgggctccctcagattaangtcgttcttcgtgctgatgtccagcgcggtttctatgacaaagttgcagtcatctcgggtggtgaaagtggccatgaaacttcccatgctggatttgttgggccagggatgttgacagctgctgtttctgaagatgttttcgcctcctcacctgttgattctattttagctgctattcgagctgtacctgctcccatggggtgccattctaaagaaaaagactacactggcgataaactcaattttgaaataactgctgagcagcaaaatctgaaggttataaattgagatggccattggtggaaatgaattgtcccctccctccaccaaagggatacctggnaaaaaaggttaacctgaacaattcttgggaaaa

SEQ ID NO: 27891 - DNA, 680 bp, Zea mays
  misc_feature: Ceres CLONE 1401400-F
  misc_feature: Encodes the peptide sequence at SEQ ID NO. 27892
  misc_feature (295)..(295): n is a, c, t, g, unknown, or other
gctcttgaactagtggatcccccgggctgcaggaattcgcacgagaccattacctagaacatcctaatcgaaaaaagccccccattcccattctaccaccgacccgtcccgtcccactgcctgccagcgtctcccccgctccctctcctcgagagatctcgcgctccggtgatcggtcgcgtcgggcgcaggatcgcgaagtgccctgcccacccccgatgctcttcgcgaagcggatcagctacgtggccccgatgctcgacgtcgccgctatcctgctcctcctcctctcggnctactacgagctcccctcgatgtccacactggagacgatctgtcgcggagtagagcgattctgcacggcgctcgactgcgtcggatggccgatcgtgacgcctcagctacgtcgtgaagacttacagtctggagagactatcgagggtgggcctccctagctcatgttcttatccatggggtgcattgataccgtgcttcagggcgttggcagcttgccgcatctggaaaagttcgtttcgcaaatgttcattcttggaaaaaatttggaaaagaaattggtcaaaaggtgggaaaactttccaaatccctgggtttggggggaaaggcctttttttggcctttggggggaaaacaaaaaaagcctgggttgtgttttttaatta

SEQ ID NO: 27892 - protein, 78 aa, Zea mays
  misc_feature: Ceres CLONE 1401400-F
  misc_feature (26)..(26): Xaa is any aa, unknown, or other
MLFAKRISYVAPMLDVAAILLLLLSXYYELPSMSTLETICRGVERFCTALDCVGWPIVTPQLRREDLQSGETIEGGPP

SEQ ID NO: 27893 - DNA, 678 bp, Zea mays
  misc_feature: Ceres CLONE 1401402-F
  misc_feature: Translation starting site: 151
  misc_feature (402)..(402): n is a, c, t, g, unknown, or other
  misc_feature (441)..(441): n is a, c, t, g, unknown, or other
  misc_feature (465)..(465): n is a, c, t, g, unknown, or other
  misc_feature (500)..(500): n is a, c, t, g, unknown, or other
  misc_feature (501)..(501): n is a, c, t, g, unknown, or other
tccccgcggtggcggccgctctagaactagtggatcccccgggctgcaggaattcgcacgagaccattacctagaacatcctaatcgaaaacccgatcagcctgccgcagtgccgctccttccctccctctacccgtcgccgctgctgccatggacgaagtcgtcagccagattttggagaagcaagtgctgtctgccgcgaaggcggtggaggacaagctcgatgaggagatcgccgcgctcgaccgcctcgatccggacgacatcgaggcgctccgcgagcgccggatccagcagatgcgccgcgccgccgagcgccgcgccaagtggcgtgcgctggggcacggggaggtacaccgaggtcccccgagaaggagttcttctccatcgccaaggccagcngagcggctcgtctgccacttctaccgcgacaactggccntgcaaaggtcgtggacaagcaccntgtcggctctggcaaaacagcacgttgagacacgnntttcgtgaaggtcacccgccgagaaggccccccttcctgacagagaagctccaggatagtcgtcctcccgaccctcgccatagttaagaacgccaagtcgaggaactacgtgggtcggcttcgacgagctcgggcggcaggacgacttcagcacgagggacctggagagcgcctggc

SEQ ID NO: 27894 - DNA, 675 bp, Zea mays
  misc_feature: Ceres CLONE 1401403-F
  misc_feature: Encodes the peptide sequence at SEQ ID NO. 27895
  misc_feature (278)..(278): n is a, c, t, g, unknown, or other
  misc_feature (428)..(428): n is a, c, t, g, unknown, or other
  misc_feature (526)..(526): n is a, c, t, g, unknown, or other
  misc_feature (579)..(579): n is a, c, t, g, unknown, or other
gctctagaactagtggatcccccgggctgcaggaattcgcacgagaccattacctagaacatcctaatcgaaaagaaaaactccaaaagctctgcgctttctgccccctcctccactcctcgagatcccatccatggtggcggccttcgcacctcgcccccggatctgagcccctccagctactgcgggatattttctccagcgcctccgcttcgctggtccgaccgccgcacggttctctgccgtgcaagattcgccgctcagttttcgtggagtcnggtagtgtccgtggctcggccatgtgttcctgaaacgggcctttgatgccagtggtgggtgcccacgctctcctgccgctatgtggaagcagtttctcggcaaaatctcgcggaagtcccccaaatcaggcgggcgcgggggctcgcggncggcgaagtcgccgtcgtcgcgtggcgccgacaatggggcgccgccggagctgagcgcttctcgcggggggggggggggtccccttccccccgccggnccggggggagaccagggaggacgggttcctccgaaagctcaacgtctgttgcngggggtccaactcccggccgacgggggaaggactccccgaagtgaaaagaaagcgcaagggttcttgtccctggcgacgggtctctaaggggaggg

SEQ ID NO: 27895 - protein, 102 aa, Zea mays
  misc_feature: Ceres CLONE 1401403-F
  misc_feature (24)..(24): Xaa is any aa, unknown, or other
  misc_feature (74)..(74): Xaa is any aa, unknown, or other
MWKQFLGKISRKSPKSGGRGGSRXAKSPSSRGADNGAPPELSASRGGGGGPLPPAGPGGDQGGRVPPKAQRLLXGVQLPADGGRTPRSEKKAQGFLSLATGL

SEQ ID NO: 27896 - DNA, 640 bp, Zea mays
  misc_feature: Ceres CLONE 1401404-F
  misc_feature: Encodes the peptide sequence at SEQ ID NO. 27897
  misc_feature (272)..(272): n is a, c, t, g, unknown, or other
  misc_feature (287)..(287): n is a, c, t, g, unknown, or other
  misc_feature (292)..(292): n is a, c, t, g, unknown, or other
  misc_feature (573)..(573): n is a, c, t, g, unknown, or other
ggagctccccgcggtggcggccgctctagaatagtggatcccccgggctgcaggaattcgcacgagaccattacctagaacatcctaatcgaaaatatataatggtattacccccgtcgtcaaatgcaccgccacccaaccccatggccgccgccaccggaaagaacatgaagacgatggcgctcgtcgtcgtcctcgccgccctcctctggttcatctcggtcgccgctgcagccagcgggcggctttcttcgtacgtggtgtacctcggncagcacgcgcacggngcggngcttggcacgcacggcgccaagagctgcagcgctggaacgccgaaccccccgaggcgactgcgactcctcgccggggttttgggcggagacagcagaagggcgggaggggatcttctattctacccgagcacatcacgcttcgcagcaactgacgcgcaccgcccccagaatggggggaaacccggggggttttttggttccccaccgagggcgaagtgcacacaccgggtatggggaattttcgggctggcggggccggggggtccccacggcgcggggngggggggggaggccaatttgggcgccaaccctttgggactttaaaaagggggggggggcccgaatcg

SEQ ID NO: 27897 - protein, 157 aa, Zea mays
  misc_feature: Ceres CLONE 1401404-F
  misc_feature (50)..(50): Xaa is any aa, unknown, or other
  misc_feature (144)..(144): Xaa is any aa, unknown, or other
MAAATGKNMKTMALVVVLAALLWFISVAAAASGRLSSYVVYLGQHAHGAXLGTHGAKSCSAGTPNPPRRLRLLAGVLGGDSRRAGGDLLFYPSTSRFAATDAHRPQNGGKPGGFFGSPPRAKCTHRVWGIFGLAGPGGPHGAGXGGEANLGANPLGL

SEQ ID NO: 27898 - DNA, 698 bp, Zea mays
  misc_feature: Ceres CLONE 1401409-F
  misc_feature: Encodes the peptide sequence at SEQ ID NO. 27899
  misc_feature (489)..(489): n is a, c, t, g, unknown, or other
  misc_feature (537)..(537): n is a, c, t, g, unknown, or other
  misc_feature (620)..(620): n is a, c, t, g, unknown, or other
ggagctccccgcggtggcggccgctctagaactagtggatcccccgggctgcaggaattcgcacgagaccattacctagaacatcctaatcgaaaaaggcaacacagcaatcagcagaaaaacatctccttggccttccatccatatgatccatccctccaggctccagctaactccaaactaccctctggttcgactcgcgttcgcatcgcaagcagcagcgtaccatcgaggcaatggcggtgatggccgaagtagtgtcgaccaccggcgcggcgctccggagcccggccacgcagcagccggcggcggcgggcgcggcgaagggcaccgacgctgagaagctccagttcatcgaggacatgaccctccacgtggacgccgtgcaggagcgcgtgctgggggagatcctcgcccgcaacgcggacaccgagtacctctccagcaggtgcggcctcgccggcgctacggaccgcgccaccttccgcngcagggtgccgatggcgacgtacgaggacctgcagccgtacatccggngcatcgccgacggcgaccgctcgcccatcctgtcggggcacccggtctccgaagtccatcacagctccggaacgtccgggggngagcggaagctcatgcccaccatcgaggacgagctcacccgccgccagctgctgtacagcctccagatggccgtcatg

SEQ ID NO: 27899 - protein, 154 aa, Zea mays
  misc_feature: Ceres CLONE 1401409-F
  misc_feature (85)..(85): Xaa is any aa, unknown, or other
  misc_feature (101)..(101): Xaa is any aa, unknown, or other
MAVMAEVVSTTGAALRSPATQQPAAAGAAKGTDAEKLQFIEDMTLHVDAVQERVLGEILARNADTEYLSSRCGLAGATDRATFRXRVPMATYEDLQPYIRXIADGDRSPILSGHPVSEVHHSSGTSGGERKLMPTIEDELTRRQLLYSLQMAVM

SEQ ID NO: 27900 - DNA, 709 bp, Zea mays
  misc_feature: Ceres CLONE 1401410-F
  misc_feature: Encodes the peptide sequence at SEQ ID NO. 27901
aagctggagctccccgcggtggcggccgctctagaactagtggatcccccgggctgcaggaattcgcacgagaccattacctagaacatcctaatcgaaaaaaaaaattaaaatcctcccggaaatcaaagacgagaatccctcgacccaggccccgaaatctccgagttctctcgccaattcaatccgcctcaccgccgccgcccgtccgccggtcgggcttgactgctccgtcgcacgtgtcggatcgcatcgcggaatctaccttgtgttgagagatccggcaaaacccttgttcccggtcgttccggctcgaattttctgcgtactgacaatgtaagcgttctcgatcggaggccgacgatctacggcctgcttgttggcgccattgaggtaatggagaacgtgttcgaaggaaagtttaggcttgggaagaagatcggtagcggatctttcgacgagctctatctcgacggcaacatacagagaggtgaggaggtggctatcaggttggaatctgcacaatcaagacgtcctcagcttcattatgagtagagactatacatgcttctccgaggcgaaactgtaattcgtcatttgaactgtctagaggcggatgccgagtagcatgtcgtggccattgatcgtcttgaccctacgtctggagacgtatacaacccgtgcactagaagcttgctactaaaacaga

SEQ ID NO: 27901 - protein, 52 aa, Zea mays
  misc_feature: Ceres CLONE 1401410-F
  misc_feature: SWISSPROT Homolog: EC 2.7.11.1 Non-specific serine/threonine protein kinase
  misc_feature: The sequence is a functional homolog of SEQ ID NO 32 in US patent 7179962
MENVFEGKFRLGKKIGSGSFDELYLDGNIQRGEEVAIRLESAQSRRPQLHYE

SEQ ID NO: 27902 - DNA, 753 bp, Zea mays
  misc_feature: Ceres CLONE 1401411-F
ggagctccccgcggtggcggccgctctagaactagtggatcccccgggctgcaggaattcgcacgagaccattacctagaacatcctaatcgaaaacattaattaacctctctccttcctcgccccttcccctccacgactccactaccaccaccttcaccttgtctcccacaaccgccgcgcgcaagccctagcccgatctcgccggcgacagacaccagatctcgccgcccgttgcgcgccgatacgcgccccgccggaattcaccgctcctcgcgctgcagcacgcccgggcctgggttactgcgtgacatgtagtattgtataattggagggtgtcaccatcaccccaagcatatgttgtgatttgtcgatggcgaggagatgaaacaggtgtagggggcgagcagcaaagacatgacagccatgccgcatccggcgcaccgaggggctgctaaaaagccctgggggtcataaggctattgctttggtttgggttgcccttaggggggcttatgttaacccccaggggggtactccggagggtactttttttggttcggggggtgtgacccccctccagggattggccccccgcggttgggccccgggggggaaccggggaaaaaaaaaacttccccccggggggggataaaggagcttcttttctccaggggcccgggcgttgtgtcaaaaaaacccccaaaattggtctttttttttgtctttcgaccccaccgagatttctttttt

SEQ ID NO: 27903 - DNA, 728 bp, Zea mays
  misc_feature: Ceres CLONE 1401415-F
  misc_feature: Encodes the peptide sequence at SEQ ID NO. 27904
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (630)..(630): n is a, c, t, g, unknown, or other
  misc_feature (636)..(636): n is a, c, t, g, unknown, or other
  misc_feature (642)..(642): n is a, c, t, g, unknown, or other
  misc_feature (655)..(655): n is a, c, t, g, unknown, or other
aagctggagctccccgcggtggcggccgctctagaactagtggatcccccgggctgcaggaattcgcacgagaccattacctagaacatccgaatcgaaaaatcgcagaaattctccgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaaggccaaggcggagaagcggctacctgcgggcaagtccgccggcaggaggcggnnngacaagaaggtgaggaagaaggcgaagaagagcgtggagacctacaagatctacatcttcaaggtctccgttctcccccaattcgccttcacctcgccgcttcctccttgaccgccaccgttgacgtcgtctttccggcgaggtagctcgccggaagacctcacctgggactttttcgacgcaccctccacacactctttacccctccggaatggcccgctgcttctagctcgtcgacgcccaaatctccgcttgcttcctcgacagccccatcccgctcttctcgntctcgntacggntcctctgctgttncgccatggggatccgcatcacgtctctactccggtttacgtggcgaaaacctcgccgcgtcgctcgacaccgt

SEQ ID NO: 27904 - protein, 88 aa, Zea mays
  misc_feature: Ceres CLONE 1401415-F
  misc_feature (52)..(52): Xaa is any aa, unknown, or other
MAPKAEKKPAAKKVAEEEPSEKAAPAEKAPAGKKAKAEKRLPAGKSAGRRRXDKKVRKKAKKSVETYKIYIFKVSVLPQFAFTSPLPP

SEQ ID NO: 27905 - DNA, 701 bp, Zea mays
  misc_feature: Ceres CLONE 1401417-F
  misc_feature: Encodes the peptide sequence at SEQ ID NO. 27906
  misc_feature (416)..(416): n is a, c, t, g, unknown, or other
  misc_feature (518)..(518): n is a, c, t, g, unknown, or other
  misc_feature (558)..(558): n is a, c, t, g, unknown, or other
  misc_feature (586)..(586): n is a, c, t, g, unknown, or other
  misc_feature (630)..(630): n is a, c, t, g, unknown, or other
  misc_feature (695)..(695): n is a, c, t, g, unknown, or other
ggagctccccgcggtggcggccgctctagaactagtggatcccccgggctgcaggaattcgcacgagaccattacctagaacatcctaatcgaaaactgctcctctaccccttcctctcccggcgaccagctggcctctcctttgttgaggcgagagacccccacccgatccggcgatggacgccgcgtccaggccgcctccgccccacggagcaggggtccgcgtccgcgccccgctggtggagtctgtctcctgctactgcagattagatacaggccttaaaactgttgttgaggccaggaagtttgttcctggcgcgaaaatgtgcatgcaacctgaagtcaaacaaaacaagcgcaagtcaaggtgctcaaaaaaggaaaggtgcaggactcaagcaccacttttacctggncttcctgatgatcttgctattgcctgccttatacgagttcctcgacttgaacagcccagactcaggatggtttgcaagagatggaaccgtcttttgtctggnaattacttttactccttgcgtaagaaaattggagtgtcanaagaaatgggtgtatgtctttaaaaggnaccgtgagaggaagatatcctggtatgcctttgatcactccacnagctatggaagtcactcccacagttccacagagtatccagagcatttgggctttgggtgggccgntctgag

SEQ ID NO: 27906 - protein, 134 aa, Zea mays
  misc_feature: Ceres CLONE 1401417-F
  misc_feature (76)..(123): Pfam Name: F-box Pfam Description: F-box domain
  misc_feature (128)..(128): Xaa is any aa, unknown, or other
MDAASRPPPPHGAGVRVRAPLVESVSCYCRLDTGLKTVVEARKFVPGAKMCMQPEVKQNKRKSRCSKKERCRTQAPLLPGLPDDLAIACLIRVPRLEQPRLRMVCKRWNRLLSGNYFYSLRKKIGVSXEMGVCL

SEQ ID NO: 27907 - DNA, 685 bp, Zea mays
  misc_feature: Ceres CLONE 1401418-F
  misc_feature: Encodes the peptide sequence at SEQ ID NO. 27908
  misc_feature (274)..(274): n is a, c, t, g, unknown, or other
  misc_feature (322)..(322): n is a, c, t, g, unknown, or other
  misc_feature (323)..(323): n is a, c, t, g, unknown, or other
  misc_feature (367)..(367): n is a, c, t, g, unknown, or other
  misc_feature (370)..(370): n is a, c, t, g, unknown, or other
  misc_feature (371)..(371): n is a, c, t, g, unknown, or other
  misc_feature (403)..(403): n is a, c, t, g, unknown, or other
  misc_feature (404)..(404): n is a, c, t, g, unknown, or other
  misc_feature (501)..(501): n is a, c, t, g, unknown, or other
tacccgcggtggcggccgctctagaactagtggatcccccgggctgcaggaattcgcacgagaccattacctagaacatcctaatcgaaaaacacaattcactccactcatcttttctcgtttagaacctctaaaatttcccccactcgccagtcgcagcagcacctgtagcagtcatggacgccagcggagccggtagcaaggggaagaagggggcggccgggcgcaaggcaggcggccccagaaagaagtcggtgacgcggtccgtcagggncgggctgcagttccccgtcgggcggatcgggcgctacctcaagaaggnncggtacgcgcagcgcgtgggcactggcgcccccgtctaactcgncgnncgtctgaagtactcgccgccgaggttctgganngtggcaggaacgcggcaaaagacaacagaaagacggcatcatcccgggcacgtgttctggcgatccccaacgacaaggagttcggaaagttggtggncggggtcaccatcgggcaggggggggtcctcccaaaattcattcgggggttcctggcaaaaaagggggggaaaaaaggggcacagggtgggaaaaaaggacccaaatcccccaaaaaagggggccaaggccccacaaaaaggtaaaaaaaagaggggccttccttttggccgtgggggggaaaa

SEQ ID NO: 27908 - protein, 61 aa, Zea mays
  misc_feature: Ceres CLONE 1401418-F
  misc_feature (33)..(33): Xaa is any aa, unknown, or other
  misc_feature (49)..(49): Xaa is any aa, unknown, or other
MDASGAGSKGKKGAAGRKAGGPRKKSVTRSVRXGLQFPVGRIGRYLKKXRYAQRVGTGAPV

SEQ ID NO: 27909 - DNA, 752 bp, Zea mays
  misc_feature: Ceres CLONE 1401419-F
  misc_feature: Translation starting site: 197
  misc_feature: SWISSPROT Homolog: EC 2.4.1.12 Cellulose synthase (UDP-forming)
  misc_feature (752)..(752): n is a, c, t, g, unknown, or other
ctagaactagtggatcccccgggctgcaggaattcgcaggaaagcattacgtacaagatcctaatccaaaaaaagttcctgacgaaaggatgtatcatgcaagatggcacaccatggccagcaaacaataccagggaccatcctggaatgattcaggttttccttgcccacagcggcgtccttgatactgagggcaatgacctaccccgtttggcctatgtttctcgaagaaaagcgtcctgaattccagcatcataagaacgctgctgccatgagtgctattgctcgtggctcgggtgggtttactaccgaacaatcactgccgactcttggttgggatcactactttacaaacagcaaggcttcccccgaaatttatgtgccttccctatggacccctaacctagggacggaggggcctgcctccttcccctactccccagaaggttccaccggtagttaccccccagggatccataaggcgcaccagggcccccccggggttttttcgctaaaaacccctgcaaagcggatcataggacatccaacgaacgccgcttaatattagacccccgtttcccggctatcatgccaaacaggccccgagggggtatccgcgcccccccattataagccactgaaaaggttttttttttcctcccccccccccaattttgcctgctcttacaaaaccgacatacccccataaaaccccccgccctctcacaaaataaaacatctcccaaatactn

SEQ ID NO: 27910 - DNA, 708 bp, Zea mays
  misc_feature: Ceres CLONE 1401421-F
  misc_feature: Encodes the peptide sequence at SEQ ID NO. 27911
  misc_feature (688)..(688): n is a, c, t, g, unknown, or other
aaagctggagctccccgcggtggcggccgctctagaactagtggatcccccgggctgcaggaattcgcacgagaccattacctagaacatcctaatcgaaaaaaaaccgaaaaggaggacaaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgatctccggcgaggtgccggacgagccggtcgtgtcgaagaagtcggggctactcttcgagcggcggctcatcgagcgctacattgaggaccatggcaagtgtcccgccaccaaggaggacctcaccatggatgatatcgtgccggtcaagaccaacacgatcgtgaagcccaggcctttgcaggctgcaagcattccaggactccttgggatttttcagaacgagtgggatgctctcatgctttctaattttgctttggagcagcagcttcacacagcaagacaagaacttagtcatgcactctaccagcatgacgctgcctggcgtgttatagccagattaaagaaggaaagagatgacgctagagcacttttggctcangctgagagacagattcctgc

SEQ ID NO: 27911 - protein, 137 aa, Zea mays
  misc_feature: Ceres CLONE 1401421-F
  misc_feature (64)..(133): Pfam Name: Prp19 Pfam Description: Prp19/Pso4-like
  misc_feature (131)..(131): Xaa is any aa, unknown, or other
MICAISGEVPDEPVVSKKSGLLFERRLIERYIEDHGKCPATKEDLTMDDIVPVKTNTIVKPRPLQAASIPGLLGIFQNEWDALMLSNFALEQQLHTARQELSHALYQHDAAWRVIARLKKERDDARALLAXAERQIP

SEQ ID NO: 27912 - DNA, 616 bp, Zea mays
  misc_feature: Ceres CLONE 1401434-F
  misc_feature (413)..(413): n is a, c, t, g, unknown, or other
  misc_feature (443)..(443): n is a, c, t, g, unknown, or other
  misc_feature (551)..(551): n is a, c, t, g, unknown, or other
  misc_feature (577)..(577): n is a, c, t, g, unknown, or other
gggggatccaccacccatcccgcgggctgcaggattacccacgagaccattacctagtacatcctaatcgaaaaacaccatcccgctccgctcaagtcgcctccgcattcctgccccctctacccgcccgccgccgcgcggacgacgggagacgccggcaccatgctctgcctctcgctgtgcgcaccgcaccttcacctccacctcccccgcagcccgaccgcacgacccgccgccgccacgtgcaggaacgcgcgctgcatcggcgtcacgctatgcctccggatgccgacgacaccggaggaacggcggcagaagcgcgggctggcccagttcctggacttatcgggcgcggcgacactcacgccacccgggcccacgcccgtgcatctcacgcccgcggccaaaacggngcggggggcccttccgaaaaaatccccccncgttggtgggggtgtggtcgggtgccgcgggaaatggggggaggggggggccccccccggttctcccccgggggggggggggggacaaaattttcccccccccccccnccggggggacgtagggagggtgaaancccccccaccgcggggaggggagggggaaacccgacccc

SEQ ID NO: 27913 - DNA, 720 bp, Zea mays
  misc_feature: Ceres CLONE 1401439-F
  misc_feature (235)..(235): n is a, c, t, g, unknown, or other
  misc_feature (294)..(294): n is a, c, t, g, unknown, or other
  misc_feature (307)..(307): n is a, c, t, g, unknown, or other
  misc_feature (325)..(325): n is a, c, t, g, unknown, or other
aaagctggagctccccgcggtggcggccgctctagaactagtggatcccccgggctgcaggaattcgcacgagaccattacctagaacatcctaatcgaaaaagttttccattccttgcgcccccttcagatccgatctgatccacgccggcgagacaccggaggaccgccatgacgctcagcctccgtcgcaagcagctcgatgttatcgtgcggatgctgcacctgaaccagncagcagttgccgaacggcggcgagggacagggagaagacgatgcgtacaagatcctggntatggatccgccntgtatctccaatctctcngccgtgtgctcaagctcggcgacctccgccacccaaggtgtcacccctcaccctccccattcaaacggccccgggaaagggggggcccaaatggccccggcccgttaaatttggtcgggccccaccccgcggaaacggggacccaaataaggggccaaacccccccccggggggtttaaaggggtttttcccaaggaaaaattttcccctcctccgccccgcgaacccctgtgggagggccccctaaaaagccggtggggccgcccttctccccccgtggtgggggggccccccgggggggcccctttttagaaaaaaaaaaaaactctttttggggggagagagaaaccctcttttttgtaaaaaaacgccgcgggtaatatataaaaaaaaaa

SEQ ID NO: 27914 - DNA, 754 bp, Zea mays
  misc_feature: Ceres CLONE 1401441-F
  misc_feature: Encodes the peptide sequence at SEQ ID NO. 27915
  misc_feature (675)..(675): n is a, c, t, g, unknown, or other
  misc_feature (729)..(729): n is a, c, t, g, unknown, or other
  misc_feature (732)..(732): n is a, c, t, g, unknown, or other
agagctggagctccccgcggtggcggccgctctagaactagtggatcccccgggctgcaggaattcgcacgagaccattacctagaacatcctaatcgaaaacgaaaaattcgaaagatccctccaggaaagatttttcttccctcctccgacgccccagcccaccaacacactctataaagcagccctcagtcacacacagaacgcacaagcgcaagccgggcaagaaaactccgtaggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctggcgagcccggaggcggcgcggttcgtgctggtgacgcaggcgcacctgttcaagccgacctacccgcggagcaaggagcgcatgatcgggccgtcggctctcttcttccaccagggcgactaccacctccgcctccgcaagctcgntcagggcgcgctcggccccgacgcgctgcgcgcgctcgttcctgaggtggaggncgncgtgcggtccactctcgcttcc

SEQ ID NO: 27915 - protein, 166 aa, Zea mays
  misc_feature: Ceres CLONE 1401441-F
  misc_feature: SWISSPROT Homolog: EC 1.14.13.93 (+)-abscisic acid 8'-hydroxylase
  misc_feature (140)..(140): Xaa is any aa, unknown, or other
  misc_feature (158)..(158): Xaa is any aa, unknown, or other
  misc_feature (159)..(159): Xaa is any aa, unknown, or other
MAFFLALVCILILLAIASYVQYTRWQKGKGRFGGHGRSAPLKLPPGSMGWPYLGETLQLYSQDPSFFFASKQKRYGEIFKTHLLGCPCVMLASPEAARFVLVTQAHLFKPTYPRSKERMIGPSALFFHQGDYHLRLRKLXQGALGPDALRALVPEVEXXVRSTLAS

SEQ ID NO: 27916 - DNA, 736 bp, Zea mays
  misc_feature: Ceres CLONE 1401446-F
  misc_feature: Encodes the peptide sequence at SEQ ID NO. 27917
  misc_feature (531)..(531): n is a, c, t, g, unknown, or other
  misc_feature (707)..(707): n is a, c, t, g, unknown, or other
caaagctggagctccccgcggtggcggccgctctatactagtggatcccccgggctgcaggaattcgcacgagaccattacctagaacatcctaatcgaaaaacataaataacacacactagttgtccgatcaaagctcgcgcgtttacaatgtctggacgatcaaggcacttcacaatgtccacccttctcgctacgagcttcttctttgtactcctatgcagctcgctacaagtacgtggcgtgaactacacattcgtgaaggacgcggcgctggcgcccagcgtgtcgtactacgactacatcatcgtgggcggcggcacggccggatgcccgctggccgccacgctgacggagcgcttccgcgtgctgctgctggagcgcggcgcctcgccctacgacgacgaccgcatcggggacatggcccgcttcgcggacacgctgtcggacacctccccgggctcgcccgcgcagcgcttcgtgtcggaggacggcgtcatcaactcgcgcccgcgggtgctgggcggcggnagctgcatcaacgccgtcttctacacgcgggacagcgacgactacctgcggcgcgtctggtggtacctgagcgccgccggggccccttaccagtgggttggaggacgtggtggagttccaagccgagctggggccctggaacgccgcgctgcagggcggcctgcatcaagtccggntccctcccgaaaaaacggcttccgttcga

SEQ ID NO: 27917 - protein, 195 aa, Zea mays
  misc_feature: Ceres CLONE 1401446-F
  misc_feature: SWISSPROT Homolog: EC 4.1.2.10 Mandelonitrile lyase
  misc_feature (186)..(186): Xaa is any aa, unknown, or other
MSGRSRHFTMSTLLATSFFFVLLCSSLQVRGVNYTFVKDAALAPSVSYYDYIIVGGGTAGCPLAATLTERFRVLLLERGASPYDDDRIGDMARFADTLSDTSPGSPAQRFVSEDGVINSRPRVLGGGSCINAVFYTRDSDDYLRRVWWYLSAAGAPYQWVGGRGGVPSRAGALERRAAGRPASSPXPSRKNGFRS

SEQ ID NO: 27918 - DNA, 687 bp, Zea mays
  misc_feature: Ceres CLONE 1401454-F
  misc_feature: Encodes the peptide sequence at SEQ ID NO. 27919
agagctggagctccccgcggtggcggccgctctagaactagtggatcccccgggctgcaggaattcgcacgagaccattacctagaacatcctaatcaaaagaaaacacaccatctccacctcgccgccgccgctcggatttccctctacctcaccctgtccgccgtcaaggagcagcaaggccaaggccgccgcggcgtcggcggccgtggtcgtggacgacatagccgagctgcaggggatgctagagcgcctgcggctggagaaggagaaggcggaggagatggttagggagcgggatgaggtcatccggaagaaggaggaggagatcgagaccagagacaaggagcaggagcgtctccaggccgagctcaggaaggcgcaacgcgccaaggagttcaagcctaccgtgagcttccccctcgtcaagtcgttgctggagaaagagcaagaagcagacgacaagggaaagaagaagaaggggaagggcggccacgagaggaagaagccgtgcccggcgtacgtgctctggctcaaggaccagtggaccgaggtcaagaaggagaaccctgaggccgacttcaaggaggtgtccaacacgctgggcgccaagtggaaggctctgggcgccgaggagaagcagccctatgaggatcgataccgccaggagaaggaggcctacctgca

SEQ ID NO: 27919 - protein, 148 aa, Zea mays
  misc_feature: Ceres CLONE 1401454-F
  misc_feature (88)..(148): Pfam Name: HMG_box Pfam Description: HMG (high mobility group) box
MLERLRLEKEKAEEMVRERDEVIRKKEEEIETRDKEQERLQAELRKAQRAKEFKPTVSFPLVKSLLEKEQEADDKGKKKKGKGGHERKKPCPAYVLWLKDQWTEVKKENPEADFKEVSNTLGAKWKALGAEEKQPYEDRYRQEKEAYL

SEQ ID NO: 27920 - DNA, 693 bp, Zea mays
  misc_feature: Ceres CLONE 1401457-F
  misc_feature: Encodes the peptide sequence at SEQ ID NO. 27921
  misc_feature (469)..(469): n is a, c, t, g, unknown, or other
aaagctggagctccccgcggtggcggccgctctagaactagtggatcccccgggctgcaggaattcgcacgagaccattacctagaacatcctaatcgaaaaatcgagacaaaatatctaccggggatgtggtggtggatgctcgggcattcgtcaaaccactcatcatcccatcccatcccatccaagggaatccgatcaatcccggactcgtcctcccggccaaccctagcttcccttctcttcccctcccccgatggacccgccgccaaccagggacagaggggaggagctggagcctgaaacccgcgccttccccgacgccgacgacccggagacctcccgatctgaacgcgaagagggtatccctccaccgccaccgccaccgcctctgcgccagcagctcatgggggcttgccgcgccgacgagcgcctcaggccgctcctcaccctcaacgtctcctgcggngcaggggacgaccgactcatcggacacctcgcgcagcacttcgaggtgttcgaggtgggcatgctcgcccgttgcctctggggtcccctggttcccctggcggtggcaaggttcaaaagggaagggccctccctctggcccaccccccctaaagggaaagctgaacccttggtttttggccatcaatctaaatgggggcttaacttttggtttggggagagggt

SEQ ID NO: 27921 - protein, 145 aa, Zea mays
  misc_feature: Ceres CLONE 1401457-F
MDPPPTRDRGEELEPETRAFPDADDPETSRSEREEGIPPPPPPPPLRQQLMGACRADERLRPLLTLNVSCGAGDDRLIGHLAQHFEVFEVGMLARCLWGPLVPLAVARFKREGPSLWPTPPKGKAEPLVFGHQSKWGLNFWFGER

SEQ ID NO: 27922 - DNA, 653 bp, Zea mays
  misc_feature: Ceres CLONE 1401459-F
  misc_feature (250)..(250): n is a, c, t, g, unknown, or other
  misc_feature (266)..(266): n is a, c, t, g, unknown, or other
aaagctggagctccccgcggtggcggccgctctagaactagtggatcccccgggctgcaggaattcgcacgagaccattacctagaacatcctaatcgaaaaagatttggatgtggactagatgcttaaggtgtgaacgtgaaagtggggtccccagatcatcacgaagggtgataatgtcagctgaagcacactacctttcatttgggaagttccttgaacttagtttttcaagccactcaaccgctangaggctgccaatatgncggcattcactcaatacggattgtctgcgctttttttggggtggggctcaaaggtgcaatgttccagtattcctcagtcgaaatttaccatggctgcaaaaccacagcctactcttgggaatcacaaccccgatatgcaccaaggatgcccaaggttgcctgcctcgcggttccggctctgaatgtgagggcttcatgggagctgaatccaggtaatttaaggggaacaagcttttgatatattcccttgggaaattgggggcacacataaaagggggaacaagctttttaaaggaaaatcccttgggcaaacaaaaggtcctaacaaaaaaatgaaacaaaatgtgggaattccccccaggggggggttaatgaaaaaaagaaaat

SEQ ID NO: 27923 - DNA, 731 bp, Zea mays
  misc_feature: Ceres CLONE 1401463-F
  misc_feature: Translation starting site: 417
  misc_feature: SWISSPROT Homolog: EC 3.6.3.14 H(+)-transporting two-sector ATPase
aagctggagctccccgtggaaggcggtgcctcaaaataagctagcctcggggggtgcgggtttactaacgaccccatgagctagaacatcctaatcgaaaagtctgtccgctaccccttcccgaccagatcgctacgagacgccgcgcgatccgacccaggccgacggcggggacccctctcgccgccggcggccatggcgtacggcgaccgcgtcaccaccttcgaggactccgagaaggagagcgagtacggctatgtccgcaaggtctctggacctgtggttgtggctgatggaatgggtggtgctgccatgtatgaacttgttcgtgtcggacatgataacctcattggggaaattatccgtcttgagggcgggggggggggatccaagtttatgaggaaacagctggactgatggttaatgaccctgtattgagaacaagaaagcctctttcagttgaattgggacctggaattcttggaaacatttttgacggtatccagcggcctctaaaaaccatcgctattaagtcaggagatgtgtatattcctcgtggtgtttcagttcctgcccttgacaaagatgtattgtgggaatttcagccaacaaagctaggtgttggagatgtcatcacaggtggagatctatacgctactgtttttgagaacacattgatgcagcaccatgttgctcttccaccgggttctatggggaaaataagttacatt

SEQ ID NO: 27924 - DNA, 745 bp, Zea mays
  misc_feature: Ceres CLONE 1401465-F
  misc_feature: Encodes the peptide sequence at SEQ ID NO. 27925
  misc_feature (594)..(594): n is a, c, t, g, unknown, or other
agagctggagctccccgcggtggcggccgctctattaactaatggatcccccgggctgcaggaattcgcacgagaccattacctagaacatcctaatcgaaaacccgggatcctcgttttgtttcccttcccccacccttcctcttcctccctatctatcagcactgctcgccggcgccgcctctgcaaaaggctcacttttgcctccggaacccagcggaatccgccggcggaccggaaacactcgctcgcccccctcaccccctgtctgcccggccgtcggagcgcgtcgcctcctgacgtgcagcagcagtccgaggaggtggagccgggaggaggaggaggaggacgaggacgaggcataatctgcctagagcggcacagcaggagtgggctgctccgctcgcgctggagccaaagctactgattgccttgtcctgaccagcgaaagagggatctttgggaggcaatcagaggtgttcggtttgatcaaacaaagctcagctctcttgggatgcttgctgcgagctgcttgtgttcatacttgagagaataaacagtgcatcatcttgctgtcttgtccttcgtgattgnaagagaaaacgagctgctgttcttgctatgtctgactccgagaggtgccgccatcgaagtcatcagcctcttcctcgccagatatgcatccgctgctgaaggatctcacggagaagaagttgacctttaggaagaacgtgttgtcattgac

SEQ ID NO: 27925 - protein, 141 aa, Zea mays
  misc_feature: Ceres CLONE 1401465-F
ELELPAVAAALLTNGSPGLQEFARDHYLEHPNRKPGILVLFPFPHPSSSSLSISTARRRRLCKRLTFASGTQRNPPADRKHSLAPLTPCLPGRRSASPPDVQQQSEEVEPGGGGGGRGRGIICLERHSRSGLLRSRWSQSY

SEQ ID NO: 27926 - DNA, 634 bp, Zea mays
  misc_feature: Ceres CLONE 1401468-F
  misc_feature: Encodes the peptide sequence at SEQ ID NO. 27927
  misc_feature (391)..(391): n is a, c, t, g, unknown, or other
aaagctggagctccccgcggtggcggccgctctagaactagtggatcccccgggctgcaggaattcgcacgagaccattacctagaacatcctaatcgaaaagaggaggcagtgcggagacgggagccagtggccagtgacagtgagcggcgacgttccagtgtccactgtccagtaggcgagcgaggaggtggtccattggccggccatggctcgtctccgctgcgtcttcgtcgtcttcgtcctgctctcgtctgccctccgccttccaggcgacgccattgcctcccgggggcaccatggccccgccgcacacgactacggggacgcgctcgtcaagtccatcctcttcttcgaggggcagcggtcgggggaggtgccggcgtcccancgcgtgtcctggcgcagggactcgggactcttcgaccgtcacttcgcccaggggacctggtgggcgggtacaccgacgctggggacaacgtccaagttcgggtttcccgatggcgttcaacatgaccatgctggcgtggacctgggtggaaattttgcgggctccttgaatccggagctgcaccacgcccagggacggcctcccggtgggggggcccaactaccttgttcaagggcacggggg

SEQ ID NO: 27927 - protein, 142 aa, Zea mays
  misc_feature: Ceres CLONE 1401468-F
  misc_feature: SWISSPROT Homolog: EC 3.2.1.4 Cellulase
  misc_feature (61)..(61): Xaa is any aa, unknown, or other
MARLRCVFVVFVLLSSALRLPGDAIASRGHHGPAAHDYGDALVKSILFFEGQRSGEVPASXRVSWRRDSGLFDRHFAQGTWWAGTPTLGTTSKFGFPDGVQHDHAGVDLGGNFAGSLNPELHHAQGRPPGGGAQLPCSRARG

SEQ ID NO: 27928 - DNA, 739 bp, Zea mays
  misc_feature: Ceres CLONE 1401469-F
  misc_feature: Encodes the peptide sequence at SEQ ID NO. 27929
  misc_feature (441)..(441): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (456)..(456): n is a, c, t, g, unknown, or other
  misc_feature (471)..(471): n is a, c, t, g, unknown, or other
aaagctggagctccccgcggtggcggccgctctagaactagtggatcccccgggctgcaggaattcgcacgagaccattacctagaacatcctaatcaaaaattcccttctccatccacaactgtcctccacacacatccacacacgccacactgaggagccctgagccctccgcccttaaaccctagcgagcgagccagcgagaggtctcatccccaccaacaccacccatggagctccgcctctaccacctcgcgctgctgctcggcctcgtcgcctgggcggcggctgctgccacgggagccgaggcgcagccggtgtgcgacccctccatcatcgccacccagatcgcgctcttctgcatgccggacatgcccacggcgccctgctgcgagccgatcatcgcctccgtcgacctcggcggcggcgtcccctgcctgncggcgcggcgnnncnaaaaaagggggaaanacacccaccaccccgcaccacgccggcgcgcccccgccgcggcccgtacgtcgcgcgcgagacagacacagcacggggataccccccacccccccgggctggccctgaacatggttccgccggcgcccgcggacgaggcgcgcggggcatataccagcacccacgctcggtcttggcgcggtgcggccgggtggagatcagtgcgggtgcgacaaattgcaccagggcagccgatcaaccccccaaaacgcgccaaaaccagcttata

SEQ ID NO: 27929 - protein, 169 aa, Zea mays
  misc_feature: Ceres CLONE 1401469-F
  misc_feature (71)..(71): Xaa is any aa, unknown, or other
  misc_feature (75)..(75): Xaa is any aa, unknown, or other
  misc_feature (76)..(76): Xaa is any aa, unknown, or other
  misc_feature (81)..(81): Xaa is any aa, unknown, or other
MELRLYHLALLLGLVAWAAAAATGAEAQPVCDPSIIATQIALFCMPDMPTAPCCEPIIASVDLGGGVPCLXARRXXKRGKXTHHPAPRRRAPAAARTSRARQTQHGDTPHPPGLALNMVPPAPADEARGAYTSTHARSWRGAAGWRSVRVRQIAPGQPINPPKRAKTSL

SEQ ID NO: 27930 - DNA, 696 bp, Zea mays
  misc_feature: Ceres CLONE 1401481-F
  misc_feature: Encodes the peptide sequence at SEQ ID NO. 27931
aaagctggagctccccgcggtggcggccgctctagaactagtggatcccccgggctgcaggaattcgcacgagaccattacctagaacatcctaatcgaaaaagcactgcactgcacgcctccgccatactgcgacgccgccgtgcatcgcttcacgcagagcagtgatggaatcccatcacggcggcgacgggaaggcgcgggacaagttctcggtgtaccagaacccgtccctcacccgcgccctagactcccgcagcgcccgcccctccgtcacagtcctcctcgtcctcgcggtcatatccgtcgcctccgcatcctccttcctcgccctcacctcccgggaggagcagctcaccaagctcgccggacgagcgggtatctctgtccttgctgctgtttttgtcattaggttgggtggaagcagcactcgggtctggtgtacttttcacactgctgggggtcttcccgggcactgatggtaatacatgggcaaaaaggactgggcaagggccgacaagggttgcctggcctggaccgccaactggggggcttccttggggtttaaaaaagggggagggtcccaaaaaggagggggggggaaaaggtgggggacaaaaccaaaaaggggccccccccccaagaaaaaaagaaggactcttctccttttacccccacgcgggtgggggaggaggg

SEQ ID NO: 27931 - protein, 103 aa, Zea mays
  misc_feature: Ceres CLONE 1401481-F
MESHHGGDGKARDKFSVYQNPSLTRALDSRSARPSVTVLLVLAVISVASASSFLALTSREEQLTKLAGRAGISVLAAVFVIRLGGSSTRVWCTFHTAGGLPGH

SEQ ID NO: 27932 - DNA, 749 bp, Zea mays
  misc_feature: Ceres CLONE 1401485-F
  misc_feature: Encodes the peptide sequence at SEQ ID NO. 27933
  misc_feature (699)..(699): n is a, c, t, g, unknown, or other
  misc_feature (700)..(700): n is a, c, t, g, unknown, or other
cagagctggagctccccgcggtggcggccgctctagaactagtggatcccccgggctgcaggaattcgcacgagaccattacctagaacatcctaaaaaaaaaaagcgaagccaaccagcacaaaaaggagcacaaagctctctctccctcccccctctctctctctcctgttccccgcgagagtcgctcaaggccgcggcgaggagaagcagcagcgcgtcacctctccaatggcatccccgtccttcctccgtgcaacctgtgcgcttctcgagtgctgaggctccctgtccctaagacaagcttgcgcgcgcgatggagggtttttcgagggacttgctgtgcgggattggcaagggggacgcgccgccaccggagaagaggccggggcagctgcgggaggagatggaggaggtggagcttagcctcgggctgtcgcttggcggccgattcgggctcgacaggaaggggagcaagctcccccggtcgtcgtccgtggcggccatgctgacaacgccggtggaggtgccggcgccgccctccctctcgcgggcgagctcgctgccggtccaggcggaggcgtcggaagttgagaggaagcaggggctggatggatggggttcttgccgtgagggcggcggtctcggcgtgcaacacgcggcgaggctgccggcgagcgggaacccttccctctgctnnctcggaggtgaaggacagattttgcaaggcaccctcatgaggactagtt

SEQ ID NO: 27933 - protein, 144 aa, Zea mays
  misc_feature: Ceres CLONE 1401485-F
  misc_feature (128)..(128): Xaa is any aa, unknown, or other
MEGFSRDLLCGIGKGDAPPPEKRPGQLREEMEEVELSLGLSLGGRFGLDRKGSKLPRSSSVAAMLTTPVEVPAPPSLSRASSLPVQAEASEVERKQGLDGWGSCREGGGLGVQHAARLPASGNPSLCXLGGEGQILQGTLMRTS

SEQ ID NO: 27934 - DNA, 745 bp, Zea mays
  misc_feature: Ceres CLONE 1401490-F
  misc_feature: Encodes the peptide sequence at SEQ ID NO. 27935
  misc_feature (351)..(351): n is a, c, t, g, unknown, or other
  misc_feature (570)..(570): n is a, c, t, g, unknown, or other
agagctggagctccccgcggtggcggccgctctagaactagtggatcccccgggctgcaggaattcgcacgagaccattacctagaacatcctaatcgaaaaagttccatcgctttcccctcctccccagtccccactcccagatgcgatttccctctccaccgccacagcgcctagcttagccagccagccggcggccatcgccgccgcaatggcgaccgcgtcggaggacgaggccgcctcggaccgctgcagcggcagctacagccccagcgccgacgtcagcgagtccgaaacctccagtgactgctccgcgcccaccacgcgccgcttcgcctcctcctcctcggnctccgccaccgtctcccgcctcgcgtcctcctcctcgtcgctccccaccccggcatcggccaccgccttctacctctccaagccaacccccgacctctccgagatcgacatgatgaaggagcgcttcgcgaagctcctgctcggcgaggacatgtcgggcagcgggaagggcgtctgcaccggcgctcgcatctccaatggcatcaccaacctctccgncaccgggttccggaaactggggaggctggagcccctccccacgccaaggaaggccatggacccggaaaatggagtgtttgctcccccccgggatccctcgggaaggtccccccctccttcaggaatcccccaaaggggggggccatttcaagggcaggtcccccccccccccaaa

SEQ ID NO: 27935 - protein, 178 aa, Zea mays
  misc_feature: Ceres CLONE 1401490-F
  misc_feature (47)..(47): Xaa is any aa, unknown, or other
  misc_feature (120)..(120): Xaa is any aa, unknown, or other
MATASEDEAASDRCSGSYSPSADVSESETSSDCSAPTTRRFASSSSXSATVSRLASSSSSLPTPASATAFYLSKPTPDLSEIDMMKERFAKLLLGEDMSGSGKGVCTGARISNGITNLSXTGFRKLGRLEPLPTPRKAMDPENGVFAPPRDPSGRSPPPSGIPQRGGPFQGQVPPPPK

SEQ ID NO: 27936 - DNA, 681 bp, Zea mays
  misc_feature: Ceres CLONE 1401492-F
  misc_feature: Encodes the peptide sequence at SEQ ID NO. 27937
  misc_feature (369)..(369): n is a, c, t, g, unknown, or other
caaagctggagctccccgcggtggcggccgctctagaactagtggatcccccgggctgcaggaattcgcacgagaccattacctagaacatcctaatcgaaaataccttcaataagaatggctccatgatatttctggatttgtcatttaatcagcttgactcaaagatcccaaaggagcttgggaacatgtactacctcatgatcctgaatcttggccacaacttgctgtctggcgtcatcccaccagaactagctggtgccaagaagcttgctgtactcgacctgtcacacaaccaggtgggaagggctattccccactctttctcgacggtgtccttggcggagatcaacctttcaaataatcaantgaatgggtcgagtgccgaactccggtcccttgtcacattccccaagatttcatatgagaataactctgggcttttggggcttccactggtggcctggcgggacaatggtgggtcaagttctttcgatgggcacccgaatccaccgggaacccggcttcccttccgggggaaaggttctatggggaatccttggtcccgctgttctcgtaaaaatgggaaatggcctcaaaaattttgtgaagggccagaagcgggaaagccaattcatgggagaagggcaagccccctcttcgggaattattccttggaaa

SEQ ID NO: 27937 - protein, 185 aa, Zea mays
  misc_feature: Ceres CLONE 1401492-F
  misc_feature: SWISSPROT Homolog: EC 2.7.11.1 Non-specific serine/threonine protein kinase
  misc_feature (82)..(82): Xaa is any aa, unknown, or other
MIFLDLSFNQLDSKIPKELGNMYYLMILNLGHNLLSGVIPPELAGAKKLAVLDLSHNQVGRAIPHSFSTVSLAEINLSNNQXNGSSAELRSLVTFPKISYENNSGLLGLPLVAWRDNGGSSSFDGHPNPPGTRLPFRGKGSMGNPWSRCSRKNGKWPQKFCEGPEAGKPIHGRRASPLFGNYSLE

SEQ ID NO: 27938 - DNA, 718 bp, Zea mays
  misc_feature: Ceres CLONE 1401494-F
  misc_feature (181)..(181): n is a, c, t, g, unknown, or other
  misc_feature (191)..(191): n is a, c, t, g, unknown, or other
  misc_feature (196)..(196): n is a, c, t, g, unknown, or other
  misc_feature (208)..(208): n is a, c, t, g, unknown, or other
  misc_feature (209)..(209): n is a, c, t, g, unknown, or other
aaagctggagctccccgcggtggcggccgctctagaactagtggatcccccgggctgcaggaattcgcacgagaccattacctagaacatcctaatcgaaaaaaaaacacaaaccgaaaaacctcctctacagtcccatctaggcgcccctcctcggctccgatccagtttcgccggcggncatgtcgcanccggncgcgaacgtggnncgccgcgggcaccgcaaggtcccgggccccgggggggcaaggcggcctggggcaaagatccccaggattccggggatgggggggtccgggactttgggccaagatttttggggccaaaggcccccccggggccccgggagggtctttggccacccccttcccaaaagggggggccatggtgatttgggtggtgttttttccaaaaaaaaaaaattcccccctttttttaaggagggggggcccttttttgggccgggggaaaaaaccaatatgagggggggggggaccccccccactaaaaaaaccggcgtttaaataacatatcctcccaagggcccccccaaaaaagggggcctttttagggaccaaggtaaaacccccccccccccgggtttttttggggggccccccccccccccaaatttggggggaaaattttctttttggggagcccccccccctggggggtgttttctcccgacacaaaaaagtggtgtaaaaaaaaaatt

SEQ ID NO: 27939 - DNA, 709 bp, Zea mays
  misc_feature: Ceres CLONE 1401499-F
  misc_feature (52)..(52): n is a, c, t, g, unknown, or other
  misc_feature (384)..(384): n is a, c, t, g, unknown, or other
  misc_feature (403)..(403): n is a, c, t, g, unknown, or other
  misc_feature (408)..(408): n is a, c, t, g, unknown, or other
  misc_feature (438)..(438): n is a, c, t, g, unknown, or other
agagctggagctccccgcggtggcggccgctctataactagtggatcccccngggctgcaggtaattcgcacgagaccattacctagaacatcctaatcgaaaagtccctccactcctcccgtcgagcacttggcactgccaatggcggcagccgcccacaccccttcgatgcgcgcaagccgcctcctttcctcctgagatcgacgcacctcctcctctcgtactccattcccgctccaagttcgtttcttcggcaccgagccatcgcacggccgcccccgcatctcgtcctgctctcaggtccttggcctccgccgttcttcgacaggggcgcgccccggtgcccactccgcgaaatccgagtcccttgtgcagctccgtanggtggaagagatccatcangcggntgagcggtaagaagccgccgtactactgangggacgggcaatggcgggcgtgggcaggccactctgcacgtggctccgtcgccgggtgtttggctgcgctttgcaccccaaaaaataaccagcacaaggctttgtttgccccggaagaaaccggccctggggggggggttaatggttgggctggggccccaccctctccgggggcggggttccgggtttggggcccccttggaaaagggaaaaggcgggggccctaaaaacctcaaaaaaaaggtcccttgaaaaaaaaaaaaacccccat

SEQ ID NO: 27940 - DNA, 680 bp, Zea mays
  misc_feature: Ceres CLONE 1401500-F
  misc_feature (680)..(680): n is a, c, t, g, unknown, or other
aaagctggagctccccgcggtggcggccgctctagaactagtggatcccccgggctgcaggaattcgcacgagaccattacctagaacatcctaatcgaaaaagggcgtcggccgccagccaccgagcggagggggaagcaaaagcttggcagaaaggagaggatgagacgatacgcgccgtccggacccaagccacttcctcccaccacctcctccctgccatgacgggatcaagatgttagggagagcagccaaaggagaggtgacgccgattggagcggcccctgatccctccgcggcggcgccggcaaccgacccacctctggaggaagaggatagggtgggtatgcacacatattgaggtgaagtccggaaatgtttgcggctggcgaactgtctcgggaaacggacgataatcgcctgcgcgtgcactttgggcactttagtgacacggccgagccgttatcatgctgaatctgcacgccggccacatcggggtagtcaaattcctcggcgtctccgatgtggagatcgctgaacgtctctccctcggtgaacacatgatcgacggtcgcattgtttgagacaagaagggcgctcctacacagcgccagaggattgcgatcctacaacaacagtagagtccggttgccgttgaccagaaggcactacatagatn

SEQ ID NO: 27941 - DNA, 718 bp, Zea mays
  misc_feature: Ceres CLONE 1401501-F
  misc_feature: Encodes the peptide sequence at SEQ ID NO. 27942
caaagctggagctccccgcggtggcggccgctctagaactagtggatcccccgggctgcaggaattcgcacgagaccattacctagaacatcctaatcgaaaaaccgctctcttctccctaatcctggcaatcaggagtagccactagtggtggtgccggtctcttctcctacccgacacaagttccaccacctctatctaccacacgccaccactgtaggagctcctccacgatcatcccgccctatagccataataattcgatgaagaggagggggttcttataaccagagggcggatacctgcgaaagatacccgtgctgctgggtgctggtgttcctctagctagagtcgtgtgtggactgagacagattgcacagcgcagcttccagtctcagtattgctttcaatggtgacgcactcctgctgctacaagcagaagctgaggaaggggttctggtctcctgaggaagatgacaagctcatgatccacataaccaagcacgatgatggatgctggagcactgtccccaagcttgcaaggcttcacatgtgtggcaatacctgcatgctgaggtgtataaattacctgaggcctgaccttacaagaggagcgttctctgaggaggacgaagacctcatcgtctaacttcatgctgtactgcagaacaggtgctctcatattgcaacaagctgtctgaagagactgacaactaga

SEQ ID NO: 27942 - protein, 79 aa, Zea mays
  misc_feature: Ceres CLONE 1401501-F
MVTHSCCYKQKLRKGFWSPEEDDKLMIHITKHDDGCWSTVPKLARLHMCGNTCMLRCINYLRPDLTRGAFSEEDEDLIV

SEQ ID NO: 27943 - DNA, 688 bp, Zea mays
  misc_feature: Ceres CLONE 1401505-F
  misc_feature (441)..(441): n is a, c, t, g, unknown, or other
  misc_feature (480)..(480): n is a, c, t, g, unknown, or other
  misc_feature (481)..(481): n is a, c, t, g, unknown, or other
aaagctggagctccccgcggtggcggccgctctagaactagtggatcccccgggctgcaggaattcgcacgagaccattacctagaacatcctaatcgaaaacacacaccccacatcacaacagctccctctgcatctccgcctcgtcgccgtcgtctgcctgcacaaccttcttcttcctcatctctctctctcttcttccgctgccaccctcccagcaccgagggaagggaagcccaggaatctccgtcccgctcccggccgccgtccttctcataacctcatcggatctgtattgggttttcagtaaggagcataaaacgccttagggaatgcagaaagatgtgcttgcacgtcgaagagctactttgtgagggacttggcaggaaagcacgccatactcttcattctctgccacctcttgatgacttcgaagctcangagtacacgtatctccagctcgtgctttcgcacaatggnngtcgacgatgcgtctcaaccgtcttcttagatcacccatctcgtggagacgggtgaagtcttcaaaccctctcgaccgtcttggtgcctcatttttttttaccggccaagaaaaacaagggacctcctggggggataccaccaccccccaaacgtaacaatacccgggcacagagtggagaaacataaagggaaccgttccccttga

SEQ ID NO: 27944 - DNA, 642 bp, Zea mays
  misc_feature: Ceres CLONE 1401506-F
  misc_feature: Encodes the peptide sequence at SEQ ID NO. 27945
gctctagaactagtggatcccccgggctgcaggaattcgcacgagaccattacctagaacatcctaatcaaaagaaatcaatcctcttctcgtctagatctgagcctccgcgtggcttccagatcagatgcttggtccgatcaacgacggtgagtcttgctctgttagttgattgttcgaaatgcatggttttgtttttgtgatgatgtgcaggttccgatcagtttcgtttgattgatgagttgacgcatcggttcgaagcgagacgaggctgcatggtttttgtgcctggaggtttctgatcagcgtgtttaaggaaactggatgctacaatttgttatctgcggaccggtcggagctgcgacgttccggcttccgggggatctggatcttggctgactggacaattgcgaggcgttggacgggcttctaaagcgtggctggattgctggatctcctttctgccccggcgactcgatgatatctctttggattggaaattattggatgagatttcgataattattagatcggagagatggtagtcgccgcgggtccgtgcctaactgaagggaagggtaaggtcccgaaacaaaagaaggggaaaaggatacatggaaaaagaagtggagatgtgacatc

SEQ ID NO: 27945 - protein, 66 aa, Zea mays
  misc_feature: Ceres CLONE 1401506-F
SRTSGSPGLQEFARDHYLEHPNQKKSILFSSRSEPPRGFQIRCLVRSTTVSLALLVDCSKCMVLFL

SEQ ID NO: 27946 - DNA, 762 bp, Zea mays
  misc_feature: Ceres CLONE 1401508-F
  misc_feature: Encodes the peptide sequence at SEQ ID NO. 27947
aaagctggagctccccgcggtggcggccgctctataactagtggatcccccgggctgcaggaattcgcacgagaccattacctagaacatcctaatcgaaaaagagaagtgacaacagcagcacgatggcaagcccgctgctgtgcctggccgccgcggcgctggtcgtagccgtcctcgtctccgcgacagaggcgtggcgcgcgactccaccgccgctgccggtgctgccgatcccgtcggcgccgcatgtgagatggcagcgccgcgaggtgatcatgttcttccacttcggcatgaacaccttcacggactccgagtggggcacggggtcggaggacccctccctgttccgccccgcggggctcaacgccacccattggatggacgcggcgcggtcggtatggtcctcgctcggcatcctcgtcggcaagcaccacgacgggttctgcctctgggcgtccgactacacggcccactccgtgcgcgccagcccctggaacgggggacgctgcgacgtgatagagcagctcgtgggcgctgcccgcgcgcgcgggcttgatgcctgtcctgcacctctctccatggagacggcacgaccacaggtacggcgtggaggtattgaacaaccagtactacgagggccaagctcacgagactcctcccggctacggtaccatcgtggaagattttggttttacggcgacaaagggtaatgacctgacgcatatgacgtaacaccttccaagagagggttccaga

SEQ ID NO: 27947 - protein, 196 aa, Zea mays
  misc_feature: Ceres CLONE 1401508-F
  misc_feature: SWISSPROT Homolog: EC 3.2.1.51 Alpha-L-fucosidase
MASPLLCLAAAALVVAVLVSATEAWRATPPPLPVLPIPSAPHVRWQRREVIMFFHFGMNTFTDSEWGTGSEDPSLFRPAGLNATHWMDAARSVWSSLGILVGKHHDGFCLWASDYTAHSVRASPWNGGRCDVIEQLVGAARARGLDACPAPLSMETARPQVRRGGIEQPVLRGPSSRDSSRLRYHRGRFWFYGDKG

SEQ ID NO: 27948 - DNA, 729 bp, Zea mays
  misc_feature: Ceres CLONE 1401512-F
  misc_feature: Encodes the peptide sequence at SEQ ID NO. 27949
  misc_feature (597)..(597): n is a, c, t, g, unknown, or other
  misc_feature (606)..(606): n is a, c, t, g, unknown, or other
  misc_feature (661)..(661): n is a, c, t, g, unknown, or other
  misc_feature (694)..(694): n is a, c, t, g, unknown, or other
aaagctggagctccccgcggtggcggccgctctagaactagtggatcccccgggctgcaggaattcgcacgagaccattacctagaacatcctaatcaaaaaatgcatcccggcgcatagatagagagagagaagagagagccccgactcgagagccaagaacgccgtgtgctgtgtttgtgtgcatctttctccgtacacgcacgcacgcacgcaccagctagcacgaccgccatggccgccaccaggagagcattcttccacagcgccgtcgacggcattgcgcgcgccgggccgggggaggccgagctgctgccggcgccgccgcaggtcgggcgaccggtggaaggcgccagcagcatggtcttcggcttccccgtgccgcggcccacgatgccggacagccggccggccgccgtcacccagcagttctttccgcccactactacggcggcgcagcaggcgacgatggaggagcaatgccacgtgcccgccggtagcgcggcggagcagtgggtccggtcgtcggcgtccaggaagagccggcgcggcccgcggtcacggagctcgcagtaccgtggcgtcaccttctaccgncgcaccggncgctgggagtcccacatctgggactgtgggaaacagtgtacttgggtggattcgnacacgcgcaggccgctgcgagggcctacgaccnagccgcgatcagttccgcggcctgaacggcgactc

SEQ ID NO: 27949 - protein, 165 aa, Zea mays
  misc_feature: Ceres CLONE 1401512-F
  misc_feature (143)..(143): Xaa is any aa, unknown, or other
  misc_feature (154)..(154): Xaa is any aa, unknown, or other
MAATRRAFFHSAVDGIARAGPGEAELLPAPPQVGRPVEGASSMVFGFPVPRPTMPDSRPAAVTQQFFPPTTTAAQQATMEEQCHVPAGSAAEQWVRSSASRKSRRGPRSRSSQYRGVTFYRRTGRWESHIWDCGKQCTWVDSXTRRPLRGPTTXPRSVPRPERRL

SEQ ID NO: 27950 - DNA, 1035 bp, Zea mays
  misc_feature: Ceres CLONE 1401516-R
caattgggtaccgggccccccctcgaggtcgacggtatcgataagcttttttttttttttttttgcagcacacactgtcacacacacacacaatgcagtttggtcatctacagattttgacaatgctgtgaaagagcacgcaaaactttattgttgtgtgacccagacttggaaccacaggattgattaccttgtccgtcatcactacatgatctcaaccacagctcgtcctacgatcttgccctgattgagatcctcataggcgccattaacctcctcgaatttgcatttccttgatatggtgttctggagattgaaggaaccactctccgcgagcttcactatctgaagaaagtcttgccctgccccttgcggcatatgagccaatgattttcacctggtcgtcccacaacacgggttatattaaacctctatcattacgcttcgttggcacaaggcccaaacattaaaaccttttgcccccattaccgcacacctctttgggcgcactggggaaaaaatggttaaaccccctttaaccaaagtggccttctttttggcccaccatctttccaccccccctacccactccaggtaaaaatgttccttttatattcccttttttaaaacttggtaattctagaatcttttttgggttggggaacttttattccaacacttgttggggggttctggcctccccacaaagtggggtctgggttagaatggtgttctttgggaaacccttcttttcctgccaatgagagaacaatcccaccgtcggcacatatcaaccctttggtggaaaggcctccacaaagggcccttttttgcccgcaatgccgggaaaaagaagcagttggatacaccaataccccgttgcattatatgtcggtaatataacgggggttcggcgaatatccccccagagggcctctcttttctaaacaaataatgccctctttaggggcacccactttagcggtgtaaaaaaacctgccacccccccgaaaaaatggcgtgagatctcgtggt

SEQ ID NO: 27951 - DNA, 1017 bp, Zea mays
  misc_feature: Ceres CLONE 1401516-R2
ttgtctcactacaacaatgcagtttggtcatctacagattttgacaatgctgtgaaagagcacgcaaaactttattgttgtgtgacccagacttggaaccacaggattgattaccttgtccgtcatcactacatgatctcaaccacagctcgtcctacgatcttgccctgattgagatcctcataggcgccattcgcctcctcgaatttgcatttccttgatatggtgttctggagattgaaggcaccactctccgcaagcttcactatctgaggaaggtcttgcctggcccttgcgccatatgagccaatgattttcacctgtcgtcggacaagacgggttatatcaacctctcccattacgttcgtttgcaggaaggcccgaatataacaggctttgcccccccttacggagactttttggccgcacttggggaaaaatggtaacgcccttaccaaagggcctcttataagccaccatcgtaaacccccctaccatccggagaaattacccctttatccctttttcaactgggcattcagacctttttgggctggcaatttaaccgggggtgggggggttggcctcccaaaagtgtttttgtagggccgggttcttcggggaagagctttctcttgtctcaaagggagaacatttcccaaccgtgggcaaatgagaacacttgcggggaaaagactcgcccaaaaggggacgtttattggcctttatctctgtggaaataaacacgcctttggtaaccccatacaccccccctcctcgacatatccgccaatatctgcccgccctttccccccgagaatctctccaagggtctccccttattctttactaccagcgaatagtccctcccccgggggcgacctcttataatgccgggagaaaacatactggtggacaattcgcgagaaaaatgtggctgccattaccgccgggatcttggggcccgcggagatcccgggggaaaaaaacatgccgtgacgggcatttgggtccggg

SEQ ID NO: 27952 - DNA, 589 bp, Zea mays
  misc_feature: Ceres CLONE 1401517-F
  misc_feature: Encodes the peptide sequence at SEQ ID NO. 27953
  misc_feature (203)..(203): n is a, c, t, g, unknown, or other
  misc_feature (234)..(234): n is a, c, t, g, unknown, or other
  misc_feature (237)..(237): n is a, c, t, g, unknown, or other
  misc_feature (265)..(265): n is a, c, t, g, unknown, or other
  misc_feature (269)..(269): n is a, c, t, g, unknown, or other
  misc_feature (367)..(367): n is a, c, t, g, unknown, or other
aaagctggagctccccgcggtggcggccgctctagaactagtggatcccccgggctgcagtaattcgcacgagaccattacctagaacatcctaatcgaaaagaggaggcagtgcggagacgggagccagtggccagtgacagtgagcggcgacgttccagtgtccactgtcccagtagcgagcgaggaggtggtccattggnccggcatggctcgtctccgctgcgtcttcgncgncttcgtcctggtctcgtctgccctccgncttncaggggacgccattggcctccggggggaccatgggcccgccgaaacgactacggggaaggggtcgcgcaaggccatcctcttttccaagggcaagggncgggcaaactggcggcgtccaaacgcgtgttctgggaaaaggaatccggatcttccaaggggacctcccccagggggccccgggggggggaccccccaagtttgggaaacacccaaaattgggttccccaagggggtcaaaataaaaaaatttggggggaggggggggagatttttggcccccctaaaaaagggggtttgcaccacccccgggggccccccc

SEQ ID NO: 27953 - protein, 127 aa, Zea mays
  misc_feature: Ceres CLONE 1401517-F
  misc_feature (9)..(9): Xaa is any aa, unknown, or other
  misc_feature (10)..(10): Xaa is any aa, unknown, or other
  misc_feature (21)..(21): Xaa is any aa, unknown, or other
MARLRCVFXXFVLVSSALRLXGDAIGLRGDHGPAETTTGKGSRKAILFSKGKGRANWRRPNACSGKRNPDLPRGPPPGGPGGGTPQVWETPKIGFPKGVKIKKFGGRGGRFLAPLKKGVCTTPGGPP

SEQ ID NO: 27954 - DNA, 665 bp, Zea mays
  misc_feature: Ceres CLONE 1401518-F
  misc_feature: Translation starting site: 230
aaagctggagctccccgcggtggcggccgctctagaactagtggatcccccgggctgcaggaattcgcacgagaccattacctagaacatcctaatcgaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccggggttggccggtggtggggaacctgttcccagtgatcctgcagcgacggcccttcatgtacgtggtggcgcgaccctccgggaaaaaataacgggccccctccttccccactgggttgggggaggcccccccccggggccccccgggggaccctccaccaaggcttggaaaaaaggcccccttttccaagcgcgccaaaaaaacccccccccccccctttagggggggagggggggccaaatatgggcccccaccaccccccggggggggtttttgcccccaattttttttgaaaaagtaggtcccccccccccccgaggagggt

SEQ ID NO: 27955 - DNA, 678 bp, Zea mays
  misc_feature: Ceres CLONE 1401520-F
  misc_feature: Encodes the peptide sequence at SEQ ID NO. 27956
aaagctggagctccccgcggtggcggccgctctagaactagtggatcccccgggctgcaggaattcgcacgagaccattacctagaacatcctaatcgaaaaatccagaaccactcatgtcattttcctccactgccgtctctctccatcttctccatcctcggctcgtctccgtgtaccgcgtaaaatgccacctcccatgcctcctcctccgaggcaattagtacacctccgactccccggacttcaaaatcaagttgggggagctcgcgccgatcaaaaaggacccgtacgagtagcaggaggactcgtcgatcgtccgtgcataaaacagaaagccccgactcagaacctccccgtcgacgaaactaatctagggagtcgcgatctcggatgtatagctcaataaggacgccgagaatgaaactctcactgcccaaaatgaggcagatgacgccgcctctgagtctgctaccaatggcagcgtcaaaggcaaggaaaataaacccgcccatagcgtgccgtccatgtcctccaaggcagacatcaagttttaaaacgacaatatcttggagcggtaactccaacatttcgtcctggatcttgccaacgttgtagtggtatccagaaccaccaacgaggtactcatcttcgcaagcaatgtgactgacaccggcg

SEQ ID NO: 27956 - protein, 35 aa, Zea mays
  misc_feature: Ceres CLONE 1401520-F
MSFSSTAVSLHLLHPRLVSVYRVKCHLPCLLLRGN

SEQ ID NO: 27957 - DNA, 806 bp, Zea mays
  misc_feature: Ceres CLONE 1401521-F
  misc_feature: Encodes the peptide sequence at SEQ ID NO. 27958
  misc_feature (1)..(1): n is a, c, t, g, unknown, or other
  misc_feature (2)..(2): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (19)..(19): n is a, c, t, g, unknown, or other
  misc_feature (30)..(30): n is a, c, t, g, unknown, or other
  misc_feature (38)..(38): n is a, c, t, g, unknown, or other
  misc_feature (45)..(45): n is a, c, t, g, unknown, or other
nnccccccccnnnnnnttncccgcgcggtnggggtttntgggggncgttcagagctggagctccccgcgggggcggccgctctagaactagtggatcccccgggctgcaggaattcgcacgagaccattacctagaacatcctaatgaaaagaatcgggtcagatcgggccatcggggaagcgagggagctcacgcggcgccatggacgatgaggagcacgaggcttacggccaggaaatcccggaggacggggacatggacggcgctgacgttgatatggctgcctccggggatgacgcggcgaagctggaggagctcgaggagatgaagcgcgcgctgaagggagatggaggaggaagccgccgccctccgcgatatgcaggacaaggtcgccaaggagatcggggaggatcgagcccaccagtcggggggggggcatggcaaccttggccccgggtcccccgaaaggggcccgccatggcccttttccgtggggggacgtggggatggtgttggggcgaagcccgggggatccggcggaatccgcgggggctggcacaagtgcgggcggcgaaatcccgccgcccgggggagggccttcctttcggatgggcggacgaaagcgcggggggggcgagggggggggagggagcgggggccttttggtgggggagggactcccgggttaaaagggaggggggttctacccccgggagcgtgcttctttatctccggagcccagggaagggcagttccatttgggagtcggagtcccaaggggttttccccccccccggggggaggg

SEQ ID NO: 27958 - protein, 201 aa, Zea mays
  misc_feature: Ceres CLONE 1401521-F
MDDEEHEAYGQEIPEDGDMDGADVDMAASGDDAAKLEELEEMKRALKGDGGGSRRPPRYAGQGRQGDRGGSSPPVGGGAWQPWPRVPRKGPAMALFRGGTWGWCWGEARGIRRNPRGLAQVRAAKSRRPGEGLPFGWADESAGGARGGEGAGAFWWGRDSRVKREGGSTPGSVLLYLRSPGKGSSIWESESQGVFPPPGGR

SEQ ID NO: 27959 - DNA, 669 bp, Zea mays
  misc_feature: Ceres CLONE 1401523-F
  misc_feature: Encodes the peptide sequence at SEQ ID NO. 27960
  misc_feature (547)..(547): n is a, c, t, g, unknown, or other
  misc_feature (568)..(568): n is a, c, t, g, unknown, or other
  misc_feature (583)..(583): n is a, c, t, g, unknown, or other
  misc_feature (587)..(587): n is a, c, t, g, unknown, or other
  misc_feature (588)..(588): n is a, c, t, g, unknown, or other
  misc_feature (605)..(605): n is a, c, t, g, unknown, or other
caaagctggagctccccgcggtggcggccgctctataactagtggatcccccgggctgcaggaattcgcacgagaccattacctagaacatcctaatcgaaaaacctaccgctgacttgtcaattcctgtctgtgcgcgcgcgcgcgcgtggcgccggccgagcggccgttgacccgatgaccggcgcggcggccgtcgatcccccggcgcctcggccgcggcggctgacggtcctcccgctcatcgcgctcatcttctacgacgtctcgggaggccccttcggcatcgaggactcggtccgcacgggcggcggcgcgctgctcccgatcctcggcttcatcgtcctcccagtcctctggtcgctcccggaggcgctggtcacggccgagctcgcatcggctttccccaccaacgccgggtacgtggcctgggtgtccgccgccttcggccccgccgtggcgttcctcgtcgggttctccaagtgggcgtcggggacgctcgacaacgcgctctacccggtgctgttcctcgactacctccgctccngcggcgggctggcgctgccgncgccggcccgctcgntggnnggtctcgggttcacggncggggttcacctacctcaactaccgggggtttcaaatcggggggcttttggggtttggggcttc

SEQ ID NO: 27960 - protein, 164 aa, Zea mays
  misc_feature: Ceres CLONE 1401523-F
  misc_feature (124)..(124): Xaa is any aa, unknown, or other
  misc_feature (131)..(131): Xaa is any aa, unknown, or other
  misc_feature (136)..(136): Xaa is any aa, unknown, or other
  misc_feature (137)..(137): Xaa is any aa, unknown, or other
  misc_feature (143)..(143): Xaa is any aa, unknown, or other
MTGAAAVDPPAPRPRRLTVLPLIALIFYDVSGGPFGIEDSVRTGGGALLPILGFIVLPVLWSLPEALVTAELASAFPTNAGYVAWVSAAFGPAVAFLVGFSKWASGTLDNALYPVLFLDYLRSXGGLALPXPARSXXGLGFTXGVHLPQLPGVSNRGAFGVWGF

SEQ ID NO: 27961 - DNA, 729 bp, Zea mays
  misc_feature: Ceres CLONE 1401530-F
  misc_feature: Encodes the peptide sequence at SEQ ID NO. 27962
agagctggagctccccgcggtggcggccgctctataactagtggatcccccgggctgcaggaattcgcacgagaccattacctagaacatcctaatcaaaaaaaaacctagctagatttagaggaaaaaaaaaactgtccccaaccgtgagatggctgagtacggcgagcgctaccagggcaacggcgacccggccacgcccgagggtggctacgcgcagaccgagtacgccgccgccggtggctcgccgcccgccgaccgcaagccctccgtgttctccgaccacgctgacggtcgctcctcccagccccagcatgagactcaatcacatggcagtggttcctccaaatctcgagaaagggaccgagaacgtgataaggaaaaggacagggagcgaggcagagaccgtgtccgcgaaaaggagagggaccgagacagggacaaggatcgtgaaagaggtgacagagacagggatcgtgatcgccaccacatggatcgtcgcgagcgcagcgagataagggaacaccgtgatcgttctgatgatcgtgaccgtcaccgcgatgatcgtgaccgtcgcaggagtcatgattctgagaggagaagagatcgtgacagagatggccatcgtaggcatcgctcccgttccccttctaagagtcgtgaccgtgaccgcagatctagatctcgttcacgctctagatcgaagagcaagcgcgtgagtggttttga

SEQ ID NO: 27962 - protein, 192 aa, Zea mays
  misc_feature: Ceres CLONE 1401530-F
MAEYGERYQGNGDPATPEGGYAQTEYAAAGGSPPADRKPSVFSDHADGRSSQPQHETQSHGSGSSKSRERDRERDKEKDRERGRDRVREKERDRDRDKDRERGDRDRDRDRHHMDRRERSEIREHRDRSDDRDRHRDDRDRRRSHDSERRRDRDRDGHRRHRSRSPSKSRDRDRRSRSRSRSRSKSKRVSGF

SEQ ID NO: 27963 - DNA, 823 bp, Zea mays
  misc_feature: Ceres CLONE 1401531-F
  misc_feature: Encodes the peptide sequence at SEQ ID NO. 27964
  misc_feature (11)..(11): n is a, c, t, g, unknown, or other
  misc_feature (17)..(17): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (45)..(45): n is a, c, t, g, unknown, or other
  misc_feature (470)..(470): n is a, c, t, g, unknown, or other
gcccccccccncccccncccccaactcccaccnnnnggggggccngaacaaagctggagctccaccgcggtgggggccgctctagaatagtggatcccccgggctgcaggaattcgcacgagaccattacctagaacatcctaatcgaaaaaacgcaaaccatactccactccagcactgaagccttgattgattcagtgggtagttagctagctgaatcaccatggatcctaccaagttccgtccgtccagaagccacaacacaacgttgacgaccacgaacgctggcgctcctgtgtggaactacacagaggggctgactgtggtgcctcgcggaaccatcctgctgcaggactaccacctgatctagaaggtggcgcatttcgcgcgggagtgcaatccccggagtgcgtggggcacccgcgcgggggccctccgccaaaggcctttcttcgaagtgccccccaccncaccggacgacccctggacggtgcgccgacttttcttggcggcggcgaccgggtggtgagggaccccccgggggaatccgggcggcttttctccggagggtggatacccacggagggggggtttccccccgggaaaaagtattccccccgaaaccctgtgccggggtttcccacctgagaaattttccacaccccccccaaggggcaacactggggaaccgtgggtggggagcaacaaattttccccggtgctttcttcctcccccgcggacggtgatgcaagttccgccaaagggggaatccctggggtttccaagccccaacccccgcgtgccccccggggcaaagagatt

SEQ ID NO: 27964 - protein, 48 aa, Zea mays
  misc_feature: Ceres CLONE 1401531-F
  misc_feature: SWISSPROT Homolog: EC 1.11.1.6 Catalase
MDPTKFRPSRSHNTTLTTTNAGAPVWNYTEGLTVVPRGTILLQDYHLI

SEQ ID NO: 27965 - DNA, 711 bp, Zea mays
  misc_feature: Ceres CLONE 1401542-F
  misc_feature: Encodes the peptide sequence at SEQ ID NO. 27966
aaagctggagctccccgcggtggcggccgctctagaactagtggatcccccgggctgcaggaattcgcacgagaccattacctagaacatcctaaaaaaaaaatcacacacccacagagcagagagggggagaggctccaaatcctagccacacacgacgcaacgcaacgcaacgcaacgccgatggggtgctcgcagggtaagtgctgcctaccgcggcacccgaggaggggctccgactctgacgccgatggcggcggggccacgctcggtcgcgccggggtgcccggggccggcctgttgctggataccccgcgctgggtgtgctggggtttgacccggagtctacagtcggtagtcccaggacccgcaccttgtggcaggcgtttctggggggacccgtacctccacatcttctctgcttcaagggttctgacacctccggcaccgcgttccctgggttcgcccgggaagcggacccccccctccctttgggggttttttttgacagcggttgcaaaacccttgggggggttcccgggaggcccctgctgggcgcccacgccccttagtgcccaaattctcccgaggttcggaacctcctttaaggggaaccacccgctgggccccccctcttccttcgggggccctttttccagatacccccaccagcggataatttccgccgttccacacaaggggggtgtgggg

SEQ ID NO: 27966 - protein, 176 aa, Zea mays
  misc_feature: Ceres CLONE 1401542-F
MGCSQGKCCLPRHPRRGSDSDADGGGATLGRAGVPGAGLLLDTPRWVCWGLTRSLQSVVPGPAPCGRRFWGDPYLHIFSASRVLTPPAPRSLGSPGKRTPPSLWGFFLTAVAKPLGGFPGGPCWAPTPLSAQILPRFGTSFKGNHPLGPPSSFGGPFSRYPHQRIISAVPHKGGVG

SEQ ID NO: 27967 - DNA, 681 bp, Zea mays
  misc_feature: Ceres CLONE 1401549-F
  misc_feature: Encodes the peptide sequence at SEQ ID NO. 27968
  misc_feature (392)..(392): n is a, c, t, g, unknown, or other
  misc_feature (393)..(393): n is a, c, t, g, unknown, or other
  misc_feature (397)..(397): n is a, c, t, g, unknown, or other
agagctggagctccccgcggtggcggccgctctagaactagtggatcccccgggctgcaggaattcgcacgagaccattacctagaacatcctaatcgaaaattctcttgatcgctttgtcacttgaatccgtgcctgctctaacagagagcggatcagcggagacacgacgacgacgacgaagccaggctcaggctctgcaatggagcaggagccgcaccggcccatggagctgcccccgggcttccgcttccacccgaccgacgaggagctcatcacgcactacctggcccgcaaggccgccgacgcccgcttcgccgcgctcgccgtcgccgaggccgacctcaacaagtgcgagccctgggacctgccatcgtgggggggaggatggnngganaaggagtggtacttcttctgcctcaaggaccgcaagtacccgacggggctgaggaccaaccgggccacggaggccgggtactggaaggccacgggcaaggacagggacgtcttcaggggcagggcgctcgtcggctccaagaggacgctcgtcttctacacggggagggcgcctaggggcgagaagtcgggatgggtcatgcacgagtaccgcctcccacgcaagctccatgggcacggccacgggcaggggcagccgtcgtcgtcgtccccaagcagggcgcc

SEQ ID NO: 27968 - protein, 159 aa, Zea mays
  misc_feature: Ceres CLONE 1401549-F
  misc_feature (11)..(138): Pfam Name: NAM Pfam Description: No apical meristem (NAM) protein
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature (64)..(64): Xaa is any aa, unknown, or other
  misc_feature (65)..(65): Xaa is any aa, unknown, or other
MEQEPHRPMELPPGFRFHPTDEELITHYLARKAADARFAALAVAEADLNKCEPWDLPSWGGGWXXKEWYFFCLKDRKYPTGLRTNRATEAGYWKATGKDRDVFRGRALVGSKRTLVFYTGRAPRGEKSGWVMHEYRLPRKLHGHGHGQGQPSSSSPSRA

SEQ ID NO: 27969 - DNA, 746 bp, Zea mays
  misc_feature: Ceres CLONE 1401551-F
  misc_feature: Encodes the peptide sequence at SEQ ID NO. 27970
  misc_feature (19)..(19): n is a, c, t, g, unknown, or other
  misc_feature (37)..(37): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (591)..(591): n is a, c, t, g, unknown, or other
  misc_feature (746)..(746): n is a, c, t, g, unknown, or other
atgattcccccaaataaantaaaaccccaaccgcccncccnnnnnnnnnnnnnccaagctggagctccccgcggtggcggccgctctagaatagtggatcccccgggctgcaggaattcgcacgagaccattacctagaacatcctaatcgaaaacccaagggtcggctaggtctaggtggtctccaagctttccgcctttccacgccaccattctccccacccgcgcgcctcagcaatccccatccagcatcgccgtttcgccgcggcaccgacacctcgccggccatgggcgcgtcctcctcgactggcaacccgtccccagaggcgcacgagcagcgggagcaggagactctcgcctccgccgccctctccctcccgctcctccgcgccgccttctcccgctccgccgccaacgcgctgccggatgccgtcggggcgccggccgcctcctttcgtctgcccgggatcccgggcgccgccgccgccgcacttccacggaattcctcggggggggtcgggccccgcccatcgcctcccaattcttcggccacggaagctgccgcgggggacggacggggggcccccgggnggggtccaggttccctccaggggggttccaacggcttgctggcgccccccgttgaacgggccttcccggttcgttcggaactgggttcctctccggcggtggaaccgcggccgcccggggcgccccggggggcggggggcccccccctggggggn

SEQ ID NO: 27970 - protein, 153 aa, Zea mays
  misc_feature: Ceres CLONE 1401551-F
  misc_feature (102)..(102): Xaa is any aa, unknown, or other
MGASSSTGNPSPEAHEQREQETLASAALSLPLLRAAFSRSAANALPDAVGAPAASFRLPGIPGAAAAALPRNSSGGVGPRPSPPNSSATEAAAGDGRGAPGXGPGSLQGGSNGLLAPPVERAFPVRSELGSSPAVEPRPPGAPRGAGGPPLGG

SEQ ID NO: 27971 - DNA, 748 bp, Zea mays
  misc_feature: Ceres CLONE 1401555-F
  misc_feature: Encodes the peptide sequence at SEQ ID NO. 27972
  misc_feature (9)..(9): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (47)..(47): n is a, c, t, g, unknown, or other
  misc_feature (439)..(439): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (748)..(748): n is a, c, t, g, unknown, or other
ttttccccnggggnnnnnnnnnccccacccctccgccnnnngggcgntggcacatagctggagctccccgcggtggcggccgctctagaactagtggatcccccgggctgcaggaattcgcacgagaccattacctagaacatcctaatcgaaaagatccgatggcccgcgccgccgctcgcctcctccccatcttcctcccatggcggcgtcctcccccgccctgcctcctccgccggggcttcctaaaccctagcagccccagaacctccgcgcgcgtcgacaccctcgttctccctggagacgagcgcttgcccttcccctcgcccccacgcctcccgaaccagctgcgtcctgactacgggagtggcggcggaggcggcgctccctcgaccatcgcggccatcgtcacctcactcggcggaggggggtgcagcgntgnnnatcgtgcggatctccggccccgatgccgtcgccgtcgccgaccgcgttttccgcccagccgggaccaggagggcgtcgacgccgtggcaaccgcgcagccactttggtgagtacggactcgcgctcgacgcggacggcagcgttattgacgaggttttgggtggtgccaatgctctccgccgaggtcctacacggcaagaggatggtgggggagcttcagtggccatggcaacaatctctggcttgcgcccgcgggctccaggggcttggcttgggaagcttggagccaagacttggcttgatn

SEQ ID NO: 27972 - protein, 130 aa, Zea mays
  misc_feature: Ceres CLONE 1401555-F
  misc_feature (93)..(93): Xaa is any aa, unknown, or other
  misc_feature (94)..(94): Xaa is any aa, unknown, or other
  misc_feature (95)..(95): Xaa is any aa, unknown, or other
MARAAARLLPIFLPWRRPPPPCLLRRGFLNPSSPRTSARVDTLVLPGDERLPFPSPPRLPNQLRPDYGSGGGGGAPSTIAAIVTSLGGGGCSXXXRADLRPRCRRRRRPRFPPSRDQEGVDAVATAQPLW

SEQ ID NO: 27973 - DNA, 795 bp, Zea mays
  misc_feature: Ceres CLONE 1401564-F
  misc_feature: Encodes the peptide sequence at SEQ ID NO. 27974
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (19)..(19): n is a, c, t, g, unknown, or other
  misc_feature (20)..(20): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (38)..(38): n is a, c, t, g, unknown, or other
  misc_feature (39)..(39): n is a, c, t, g, unknown, or other
nnnnnnnccccccgccccnnccctcccccnnngccccnnaaagagatttccccacaactggggctccccgcggtggcggccgctctagaactagtggatcccccgggctgcaggaattcgcacgagaccattacctacaacatcctaatcgaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacccggcgctggcgcccagcgtgtcgtactacgactacatcatcgtgggcggcgtaacggacgggtgcccgctggccgccaccctgtcggagcgcttccgcgtgctgctgcgtggaggcgcggcgcctcgcccctacgacgaccaccgcatccggggacatggccccgctccccagacaacgctgtcggacacctccccggtctcgtccggggagcgattttgtgccggcagaaccgtcgtcatcaatccccgcccgcgggctgttgggcggccgccaaccggcctccaatgtcgggcttccaacccgccccccccaataaagaactatcgggccgaagcgggtcacagctggcgcacccgggagcaccacccccggggaccgtgtacaaccgtatcgtcttggaaggaaccgcggttccgcccttctccacaccccggaagtatggggcgcccccctggcgcgaaggcccacacctt

SEQ ID NO: 27974 - protein, 197 aa, Zea mays
  misc_feature: Ceres CLONE 1401564-F
  misc_feature: SWISSPROT Homolog: EC 4.1.2.10 Mandelonitrile lyase
MSGRSRHFTMSTLLATSFFFVLLCSSLQVRGVNYTFVKDPALAPSVSYYDYIIVGGVTDGCPLAATLSERFRVLLRGGAAPRPYDDHRIRGHGPAPQTTLSDTSPVSSGERFCAGRTVVINPRPRAVGRPPTGLQCRASNPPPPIKNYRAEAGHSWRTREHHPRGPCTTVSSWKEPRFRPSPHPGSMGRPPGAKAHT

SEQ ID NO: 27975 - DNA, 531 bp, Zea mays
  misc_feature: Ceres CLONE 1401609-F
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (410)..(410): n is a, c, t, g, unknown, or other
  misc_feature (411)..(411): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (419)..(419): n is a, c, t, g, unknown, or other
  misc_feature (432)..(432): n is a, c, t, g, unknown, or other
  misc_feature (433)..(433): n is a, c, t, g, unknown, or other
  misc_feature (461)..(461): n is a, c, t, g, unknown, or other
  misc_feature (462)..(462): n is a, c, t, g, unknown, or other
  misc_feature (510)..(510): n is a, c, t, g, unknown, or other
aagtggagtccacgcggggcggcgctctagaactagtggatcccccgggctgcaggaatcgcacgagaccattacctagaacatcctaatgaaaattacccacctccgccagccactccaaacacttgcgccgccgctgcctcacaggtaaggccgccatggtctccggttcggcgtgtgcgcgaagcgcatcgtgacgatcgcgcgtacaccacatgctgggccgtctctcctcgatcatagtcaaggagctgctcatgcgcagaagggatcgcgccgctgcgagagatctgatgtcgggcgcctcgtccgtcgaagatgaagtaccctccgactttccttccccgcaaaggggcgggtttttgggaaaacccccccccccnnnnnnnnnnnnnnnnnnnnnnnnnccnnccnnntcnccgccccccctcnngcgcccggcccgctggtccgccggcgcnntcgggcgcggcgcgcgggcgcgggcccccggttcgcggcggcgggcgntgggcccccgtcgcggcgccg

SEQ ID NO: 27976 - DNA, 725 bp, Zea mays
  misc_feature: Ceres CLONE 1401616-F
  misc_feature: Encodes the peptide sequence at SEQ ID NO. 27977
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (55)..(55): n is a, c, t, g, unknown, or other
  misc_feature (56)..(56): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
ggggggggcggnnncgcccccaccccccccccccagaagaggnnncattcccacnnttnnnnnnnnggggggnnngccaaaagctggactccaccgcggtggcggccggctctttcctacaggatcccccgggctgcaggaattcgcacgagaccattacctagaacatcctaatcgaaaacctcgcgcgcacgttctgccgcgcgcatacgcccgcatcccgcagccgcggcagcgccgcagccgctccttccatcctccgccctccttccatcctccgcggatcccagctctccctcccgcgcccgcccgcagccgcaccgcatcccgcagccggcgtcggcgcaacggctgatgctcaaggggtgtgagtcgctgctacagcggcagtgccggccgcgcacccccgcggggtacatggagcccacgccgctaccgtttgtcggtgaagagcaaggggacagataagcccaaaagcagcaaggggaacgtcgacaaggaccccaacaagcctgactcccaacacttttttgttcgctggtgctgcggcgacggtgctggcgagctctcccggggctgggctctgggatgctcccaggcaccgggttccggcgagaggtggagtcaccacacggccggatgcgccgcccgctgctgccctggcagtttcctccaatcggattcaggggaaaaattgccagtgggaaggaaacctggtggactca

SEQ ID NO: 27977 - protein, 37 aa, Zea mays
  misc_feature: Ceres CLONE 1401616-F
MLKGCESLLQRQCRPRTPAGYMEPTPLPFVGEEQGDR

SEQ ID NO: 27978 - DNA, 623 bp, Zea mays
  misc_feature: Ceres CLONE 1401621-F
  misc_feature (619)..(619): n is a, c, t, g, unknown, or other
aaagctggagctccccgcggtggcggccgctctagaactagtggatcccccgggctgcaggaattcgcacgagaccattacctagaacatcctaatcgaaaaaaaacttgccctcttctctgcttgaaccgcggagcaagaccgctcttgttctcttctctgcttgaactgcggagaaagaccgaatccgaagggacgttgggactttctggctgggaagactacataccatttctctaattcgggcgtggtttgtgctgggagggaaggaatccatggggctgcagctcgatccgcgctgagagttgaaggaaccggccttgttgtgtgctccacccaatcgaggaaaaggggcaaggattgctgctttgttgtctttggatccgttacgccattgaagattcaccatcagcagggcgaagtgacggttctgcaccacttttccccttatcctaattcgattttatttgaacactggatgtgattataatctcggttgctggtctgtgcggctctatctgagggtttcctccgtcctggatcggggaaggaggcgcctttggatttccgcctcatggcgcccgcctgtaaccacggagtctactttttaaattagggnaata

SEQ ID NO: 27979 - DNA, 634 bp, Zea mays
  misc_feature: Ceres CLONE 1401628-F
  misc_feature: Encodes the peptide sequence at SEQ ID NO. 27980
aagctggagctccccgcggtggcggccgctctagaactagtggatcccccgggctgcaggaattcgcacgagaccattacctagaacatcctaatcgaaaaaacctcctctgcctgccgcttctcgtgttgcgggcggttacggctgactagtactagaggaggacatccgcttccattactgcgcctgcgtaggatcggaggaatcataagcgtaggcttcaattttcggggggcgcaataaatttcccgcatggctcgtagggtcgcgtcctcgctcgtctcccgctgcctcctgtcgaggacccctgccggcgcgccgtccgctgccccctctgcgctgcgcaggacagtgcctgcagatggcatgcacaggctgttgccggggtgtccttcacacgttcaccactgcagcagtcagtatagcatgccatcacgacatcagtccatgtgaactacacaaagctcctcattaatggcaactttggtgattcagcatcggagagtacttcccaactcgagaccctcgtacaggggagaagatgctcatgtgggtgagagtgacgcagaggacattaacggtgtagtagctgctgctcgcaaggcttttgatgagggccatgcccgacgagact

SEQ ID NO: 27980 - protein, 66 aa, Zea mays
  misc_feature: Ceres CLONE 1401628-F
MARRVASSLVSRCLLSRTPAGAPSAAPSALRRTVPADGMHRLLPGCPSHVHHCSSQYSMPSRHQSM

SEQ ID NO: 27981 - DNA, 634 bp, Zea mays
  misc_feature: Ceres CLONE 1401634-F
  misc_feature: Encodes the peptide sequence at SEQ ID NO. 27982
tggagctccccgcggtggcggccgctctagaactagtggatcccccgggctgcaggaattcgcacgagaccattacctagaacatcctaatcgaaaactctctgtgtcatcaccctcattccgacagttccgctagaaggaaaagaagaaaaaaaaactctctttctctctctttcccagccctctctctccctctccacccggccgccaccatgtcaggcctctacagccagggcttctcccctgcaagaaccctctccccccagattaggagcaaccccgacgctgacagccagtacttggccgagcttctcgcggagcatcagaagctggggcccttcatgcaggtgctgccgatatgcagccggctgctcaatcaagaaatcatgcgggtatcaagcatgggtcatgaccatggatttagtgatcttgacaggcgccggtttagaaagcctagccttatgtcttccccaatggccggcctaatctacatggaaatggatttgggccctgggatgggatggcccagaaaagaatgggctttcctcctccctggaaaaaaaatggactgggaaaggaacccccccaaggcctgggttttaaattggcaagaaaatcgttccctttggaagac

SEQ ID NO: 27982 - protein, 140 aa, Zea mays
  misc_feature: Ceres CLONE 1401634-F
MSGLYSQGFSPARTLSPQIRSNPDADSQYLAELLAEHQKLGPFMQVLPICSRLLNQEIMRVSSMGHDHGFSDLDRRRFRKPSLMSSPMAGLIYMEMDLGPGMGWPRKEWAFLLPGKKMDWERNPPKAWVLNWQENRSLWK

SEQ ID NO: 27983 - DNA, 650 bp, Zea mays
  misc_feature: Ceres CLONE 1401647-F
  misc_feature: Encodes the peptide sequence at SEQ ID NO. 27984
  misc_feature (621)..(621): n is a, c, t, g, unknown, or other
  misc_feature (622)..(622): n is a, c, t, g, unknown, or other
aaagctggagctccccgcggtggcggccgctctagaactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtcgctaaggagccggagccggtggaggccgagactgagactgagaccaaggaggccgaggccgttgctgagccgaccgaggcagagcccaaggaagcagagccggaggccgccgcgccggcagcagagacggaggtcaaggaagcagagacggaggccgccgcgccggcagcagagacggaggctgctgctgccccggtcgaggctgctgagccggagatagccgccgagacccaaagagtggcggctggnnaaggctaacgaggagggaggagggagca

SEQ ID NO: 27984 - protein, 129 aa, Zea mays
  misc_feature: Ceres CLONE 1401647-F
  misc_feature (128)..(128): Xaa is any aa, unknown, or other
MAAVEVQVPTAAPVEEAAQLAAASAVETPNEETAAPAVETEVVVAKEPEPVEAETETETKEAEAVAEPTEAEPKEAEPEAAAPAAETEVKEAETEAAAPAAETEAAAAPVEAAEPEIAAETQRVAAGXG

SEQ ID NO: 27985 - DNA, 666 bp, Zea mays
  misc_feature: Ceres CLONE 1401652-F
  misc_feature: Encodes the peptide sequence at SEQ ID NO. 27986
aagctggagctccccgcggtggcggccgctctattactagtggatcccccgggctgcaggaattcgcacgagaccattacctagaacatcctaatcgaaaaacccacccacccccgcgtcccccacctcatggcgccggcgatggggctgaagcggcctgcggcgggagcgggggcggcagcagcgcagaccgtcacactgttcgcgccggccgtgcgggacgcggtgcgcaccgccgtaagggaggccgaggccacggcgaaggctaccgccccggccgccagggtcccggcgacggcggcagtgccggcggagatccgctagggatgtggtgctgtgcctggaggaggtcgacggaaggcggtggagctatgtgttcgacgccgctggcgccgcgctaaaggccaagggaagggcgtccgtcgggggcgccttcaaggccgtcccgctccagtccccgatggccgccggcgaagaaattcatgtcccttataaaatcatatggttgtgcccgaaagctttcccagataagtgtcccccccttcctatggttccctaacctggacatgggagaactattgaaaccatttcctttggtgggaacaaagggtcggggttttacaacacagggaccctggcctccaccccctgttggaaggccccccc

SEQ ID NO: 27986 - protein, 64 aa, Zea mays
  misc_feature: Ceres CLONE 1401652-F
MAPAMGLKRPAAGAGAAAAQTVTLFAPAVRDAVRTAVREAEATAKATAPAARVPATAAVPAEIR

SEQ ID NO: 27987 - DNA, 665 bp, Zea mays
  misc_feature: Ceres CLONE 1401666-F
  misc_feature: Encodes the peptide sequence at SEQ ID NO. 27988
  misc_feature (487)..(487): n is a, c, t, g, unknown, or other
  misc_feature (493)..(493): n is a, c, t, g, unknown, or other
tggagctccccgcggtggcggccgctctataactagtggatcccccgggctgcaggaattcgcacgagaccattacctagaacatcctaatcgaaaaaccgattcggcaaccgtgctaatcgatatccgtgcaattccacctcccgaaccgaatccctccaccgacccaaaccctagcgcgcacccttctccgtcgtcctttcctggcgcgcgggccggtgtcggagatgcgggcgctgctcgcggacggcgggatggcactggcggtgtcgccggaggccaacgagtcgtcgggtggcgctgcggtgtcgctagggccgttatcgtgggcgtcggagtgccacggggtactgtacaacctggccttgatgctgccatcgctggtctttgtggggttcctggcgtggcaggcgcggcggagcttccgtaggctcagctacggccgctctcacgtcgttgtcgtcgcgtactacgcgctcctctgggncgtcgncgtactcagcctcctctggtgcttcctgcaggcatggcaatgtatgcctgacagacaattctcttggaatgtactgtcactggttaccaaatcaggaatcgtatcctgggaagaaatctcatagcctttctacctcaagaaatgatgccagcgggtttgaatctttgccacg

SEQ ID NO: 27988 - protein, 129 aa, Zea mays
  misc_feature: Ceres CLONE 1401666-F
  misc_feature (87)..(87): Xaa is any aa, unknown, or other
  misc_feature (89)..(89): Xaa is any aa, unknown, or other
MRALLADGGMALAVSPEANESSGGAAVSLGPLSWASECHGVLYNLALMLPSLVFVGFLAWQARRSFRRLSYGRSHVVVVAYYALLWXVXVLSLLWCFLQAWQCMPDRQFSWNVLSLVTKSGIVSWEEIS

SEQ ID NO: 27989 - DNA, 623 bp, Zea mays
  misc_feature: Ceres CLONE 1401679-F
  misc_feature: Encodes the peptide sequence at SEQ ID NO. 27990
aaagctggagctccccgcggtggcggccgctctagaactagtggatcccccgggctgcaggaattcgcacgagaccattacctagaacatcctaatcgaaaaacctttctttccctcttccgtcttccccaacccaaccacccgcaccaagccgacccagagagaggagagcctgcttgcctgcctgggctggactcccccttcgcctcctcctcgtccgatcggccccgccccgcctagctgctgctgctgctgctgctgctgctgcgcgcgcgccgcggcgggacccgggaggagcgccggtggtggtggccgggcccgatggagtgggcgtcggcggcgtacacggctgcggcgctggtgtgcgccgcggcggcgagcgtggtcgcgctcgcgcacatctaccgccacctcctccactacgccgagcccatctaccagcggttcatcgtccgcatcatattcatggtcccggtatatgctgtgatgtcattcctttcccttatcctccctgacaacgcgatatattttaattctattcgagagatatatgatgcttgggtcatctacaattttctctcactctgcttggcatgggtgggaggtcctggtgctgtggtgga

SEQ ID NO: 27990 - protein, 100 aa, Zea mays
  misc_feature: Ceres CLONE 1401679-F
  misc_feature (5)..(100): Pfam Name: DUF300 Pfam Description: Domain of unknown function
MEWASAAYTAAALVCAAAASVVALAHIYRHLLHYAEPIYQRFIVRIIFMVPVYAVMSFLSLILPDNAIYFNSIREIYDAWVIYNFLSLCLAWVGGPGAVV

SEQ ID NO: 27991 - DNA, 628 bp, Zea mays
  misc_feature: Ceres CLONE 1401681-F
aagctggagctccccgcggtggcggccgctctatactaatgcgacctccggatctggatgattttcacaatatcattacctaaataatcctaattcaaagatcccattggagtcggttccgccgccccggtctactacatcaccaccgataccgatgtcgctgccactgcagagacaccccttgagtccttgacgccctaccccagagggtgcggtatgcgcgccgcgcagtgccatcaaatcataccgattgagtatgctcaccttagaagacgagatggatggcacacatcgctgaacgcttccgatgtagatgtacttcccgccctcctgccggcttcttcatcagtcgagggccatcctgctcctatagaatacagcacgcattcgctccatgcaagattgcgtgcgactatacagcatgtagcaggatgtctcctccagagtgtgactcgtgtattctctctgctggaacatacatgactgcatccaatcatactccgccacttgcaggtggggagatcaaactgctatacgacacagtagatccatcaacgactaggatgacgcacatctctagatctacggggtcacagtcgaacatcgagggtggtgactccacaagaga

SEQ ID NO: 27992 - DNA, 641 bp, Zea mays
  misc_feature: Ceres CLONE 1401700-F
  misc_feature: Encodes the peptide sequence at SEQ ID NO. 27993
tggagctccccgcggtggcggccgctctagaactagtggatcccccgggctgcaggaattcgcacgagaccattacctagaacatcctaatcgaaaacactcgctttccggcgggcgactggcctaaaatcgcctcttgtttgtttgcttccgtcgtcccctctccacgtagagcacgcccccggaccaccttttataagcaccaaccatctggccttgccgcgccgattcgccacgaagccgcactgtgagagagggacgcggcctgttgtcccggcttttagacgcaacttccatcgctgcgaagctatccattcgtgttcgtcatggccgccagcgtcaccgtggaaaacctcaaccccaaggtcttaaaatgtgagtatgcagtccgtggggagattgtcatccatgctcagcgcctgcagcaacaactacaaacacaaccagggtctcttccttttgatgagatcctctattgcaacattgggaatccccaatctcttggtcagcaacctgtgacattcttcagggaggttcttgctctttgtgatcatccgtgcctcttggaaaaagaggaaccaaatcattgttcagtgctgatgcaatttctcgagcaaagcagattcttgcaactattcctg

SEQ ID NO: 27993 - protein, 105 aa, Zea mays
  misc_feature: Ceres CLONE 1401700-F
  misc_feature: SWISSPROT Homolog: EC 2.6.1.2 Alanine transaminase
MAASVTVENLNPKVLKCEYAVRGEIVIHAQRLQQQLQTQPGSLPFDEILYCNIGNPQSLGQQPVTFFREVLALCDHPCLLEKEEPNHCSVLMQFLEQSRFLQLFL

SEQ ID NO: 27994 - DNA, 643 bp, Zea mays
  misc_feature: Ceres CLONE 1401707-F
  misc_feature (217)..(217): n is a, c, t, g, unknown, or other
  misc_feature (315)..(315): n is a, c, t, g, unknown, or other
  misc_feature (391)..(391): n is a, c, t, g, unknown, or other
  misc_feature (431)..(431): n is a, c, t, g, unknown, or other
aaagctggagctccccgcggtggcggccgctctataactagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggancgccatgcacatgggtgatcgatcggtctatatagaaagacaggcggtactagagagttgtgtggtgtccaagctacacacgggatgctactaactangctgcaggcaagggcgaggaatggcagcctttcatgtgctcggcggacggtgttgtccgtcccgcgctctgcccgnccaagctgtgctgtgcgcagctgctgcttccctacggggnttcagtcccgaacgaaaggtgaggtgtttgcttgccccaaaatccccccgttgtgcaaggggtaggaatatccgtgccaaggcccgggccgtggccattctcagttggggggctcccccagaaacccggaaaagggggctttttaatttgtacaggccccgtcaccccctgggggcgggggtttcaaaaggggcccccctgaaccccccccc

SEQ ID NO: 27995 - DNA, 620 bp, Zea mays
  misc_feature: Ceres CLONE 1401725-F
  misc_feature: Encodes the peptide sequence at SEQ ID NO. 27996
  misc_feature (360)..(360): n is a, c, t, g, unknown, or other
aaagctggagctccccgcggtggcggccgctctataactagtggatcccccgggctgcaggaattcgcacgagaccattacctagaacatcctaatcgaaaaacccatctctactcgagtctctgcgaatccgttgccggtagcctctctgcggtgagagttctgctgccgcctgctggagatgatggacgacggaggaggaggggtgcagtcgcagggcgtcaacccggactgccccaacgccgccaaccccttccaccgctgcgccgcgtactgccccgtccccgccccggcccccaccaaagccgccgccgccgccgtgcgcagcaagccgtctccgcctcgtccgagggcgacgtngttggccccgccacacgggagggtcaagcacggagacggcgctgcgcgtgtcgctcccgcctccgacgcggaggacgacgacgacgacggaggcgacagggaggaatccccggctgtcaactcgggctacccggcgtctccggctcgtccggtgcccgaggccgacccccgcggcggaataacgggacccccgccccccgacaaggttgcaggaaggatggccacataccccgtccttcgacgaagtcgcgaggagcccg

SEQ ID NO: 27996 - protein, 146 aa, Zea mays
  misc_feature: Ceres CLONE 1401725-F
  misc_feature (60)..(60): Xaa is any aa, unknown, or other
MMDDGGGGVQSQGVNPDCPNAANPFHRCAAYCPVPAPAPTKAAAAAVRSKPSPPRPRATXLAPPHGRVKHGDGAARVAPASDAEDDDDDGGDREESPAVNSGYPASPARPVPEADPRGGITGPPPPDKVAGRMATYPVLRRSREEP

SEQ ID NO: 27997 - DNA, 644 bp, Zea mays
  misc_feature: Ceres CLONE 1401727-F
tggagctccccgcggtggcggccgctctagaactagtggatcccccgggctgcaggaattcgcacgagaccattacctagaacatcctaatcgaaaaattggggcaggatcccgcgatggctcccagctcggtggcgtggaacccgtccgtggcgcccgcgaggccgaggtcgagctcggtgagcgccgcggctgctgccgggtgcgctgcgagcgccggcccgatgtcctccgtccagcagtagaactcggagaggtcgagcgccctgagcgctgggcagtccccgaggagcggctcgagatccgcgccggcgtcgaggcccggcgggcgctggtgccagcgcacgagcttgacgctgcggaggcgggacctccagtgcggggtgaggctgacgagcgtggtggggtcgcggcagtagacggcgagcgaggacacggcggggaagcagtaggcgaggcgcgccgcgaccagctcgttctgctccgcgacctgctgcggcgtcacggacggcgcgacggcgtcggccgacggcgccgcggaggagaggaacgggtggccccacggggacgccagcgagaggtcgagccgctccagcgccgggaagcagaacgccggcctgaggaagaggaacgcgggcgaccgt

SEQ ID NO: 27998 - DNA, 752 bp, Zea mays
  misc_feature: Ceres CLONE 1401734-F
  misc_feature: Encodes the peptide sequence at SEQ ID NO. 27999
  misc_feature (1)..(1): n is a, c, t, g, unknown, or other
  misc_feature (13)..(13): n is a, c, t, g, unknown, or other
  misc_feature (15)..(15): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (67)..(67): n is a, c, t, g, unknown, or other
  misc_feature (78)..(78): n is a, c, t, g, unknown, or other
  misc_feature (80)..(80): n is a, c, t, g, unknown, or other
  misc_feature (91)..(91): n is a, c, t, g, unknown, or other
  misc_feature (109)..(109): n is a, c, t, g, unknown, or other
  misc_feature (439)..(439): n is a, c, t, g, unknown, or other
  misc_feature (687)..(687): n is a, c, t, g, unknown, or other
  misc_feature (689)..(689): n is a, c, t, g, unknown, or other
  misc_feature (694)..(694): n is a, c, t, g, unknown, or other
ngggggcggggcncnccccccccccccgggnnnnnnnnnnnggggnnntatannnnnntttnnnttnggggggggggngncccaaactggnactccccgcggtggcggncgctctagtctaaagacacccccgggctgcaggaattcccacgagaccattacctagaacatcctaatggaaaaaaggctttgctggtagttgtagcacacacggcacaccacacggtttcgtcctcgtccaccatgctatcgtcctcgcacctcgttaagctgcccctcctgccgcgcggcctcctctcgtacctccccgcatccatcctcccgagcgggcgcgagagcaccgcggacgcagcaccctccacgccgccttcttccaagaagatgtcgtcgtccgcgcagcagcagcagcagcagcaagcgggcagcagcaaggcggagncggtggatctggcgcgcgtgctcgagctgttcgacaaggacggcgacgggcgcatcacgcgggaggagctggcggagtcgctgcgcaagctgggcatgggcgtgccgggcgaacaacgagctgggggccatggagggggcgggtgggaggccaagcgcggggggggggggggggcgcccaggggggttccggggggcttctaacggcgccattcttgggcgggccccccccgggggggagggaggaananagaanaaaaaacccaccacccacaacaaaggcggggaagggggggtcccccccgggggtccaa

SEQ ID NO: 27999 - protein, 86 aa, Zea mays
  misc_feature: Ceres CLONE 1401734-F
  misc_feature (22)..(50): Pfam Name: efhand Pfam Description: EF hand
  misc_feature (20)..(20): Xaa is any aa, unknown, or other
MSSSAQQQQQQQAGSSKAEXVDLARVLELFDKDGDGRITREELAESLRKLGMGVPGEQRAGGHGGGGWEAKRGGGGGAPRGVPGGF

SEQ ID NO: 28000 - DNA, 651 bp, Zea mays
  misc_feature: Ceres CLONE 1401736-F
  misc_feature: Encodes the peptide sequence at SEQ ID NO. 28001
  misc_feature (19)..(19): n is a, c, t, g, unknown, or other
  misc_feature (22)..(22): n is a, c, t, g, unknown, or other
  misc_feature (50)..(50): n is a, c, t, g, unknown, or other
  misc_feature (51)..(51): n is a, c, t, g, unknown, or other
  misc_feature (99)..(99): n is a, c, t, g, unknown, or other
  misc_feature (452)..(452): n is a, c, t, g, unknown, or other
  misc_feature (563)..(563): n is a, c, t, g, unknown, or other
  misc_feature (593)..(593): n is a, c, t, g, unknown, or other
tggagctccccgcggtggnggncggtttttacctcacccatcccccgggnntgaggtttttctacaagaccattacctccacacatcctaatcgaaaanccaaccccaccttctctccccccgctcggaacgacacaccggccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcnaccctcgaggtggagtcttctgacaccatcgacaacgtcaaggccaagatcccaggacaaggagggcatccctccggaccagcagcgggctcatttttgctggcaagcagnctcgaggacgggcgcacgctggccgactancaacattcagaaggagagcaccctcccacttggtggttgcgtctcaggggcggcatgc

SEQ ID NO: 28001 - protein, 96 aa, Zea mays
  misc_feature: Ceres CLONE 1401736-F
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature (90)..(90): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTIXPRGGVF

SEQ ID NO: 28002 - DNA, 606 bp, Zea mays
  misc_feature: Ceres CLONE 1401747-F
  misc_feature: Encodes the peptide sequence at SEQ ID NO. 28003
aaagctggagctccccgcggtggcggccgctctagaactagtggatcccccgggctgcaggaattcgcacgagaccattacctagaacatcctaatcgaaaaaagagaggattttgctaggtttttgcccccaaccgcccaactgcgcgtgctcctgccgacctcccacccctccactcccctgcggttggcggctgtctcgccgaagcgacccagccggcgcagccgatatggcgaagggcgacgacgcgctggcgcggaagcgcaaccgtgtgcgccgcaagcgcctccgtagcagcgagaacgctgtttccgcgcgtgtcgcggcgatcatcgcctccaagcaccgccgcaagtcggggaagcgccgcgcctgcgagggcatgtgcttctcgctccccacgcccgacgactcgttcaacgagcgtcatgtcaggaagcacaagctcgattgaagagccggtccgacaaaaaaagcggcccgacgcccctttaagaaaaaggggaaaccccaaagaaaaagagggggggaaaaacacaacaaaaaaacccccccccggggggggaaaaaaaaaatgggccccccccgaagagaaaaaataaaag

SEQ ID NO: 28003 - protein, 74 aa, Zea mays
  misc_feature: Ceres CLONE 1401747-F
MAKGDDALARKRNRVRRKRLRSSENAVSARVAAIIASKHRRKSGKRRACEGMCFSLPTPDDSFNERHVRKHKLD

SEQ ID NO: 28004 - DNA, 702 bp, Zea mays
  misc_feature: Ceres CLONE 1401750-F
  misc_feature: Encodes the peptide sequence at SEQ ID NO. 28005
  misc_feature (143)..(143): n is a, c, t, g, unknown, or other
gctctagaactagtggatcccccgggctgcaggaattcgcacgagaccattacctagaacatcctaatcgaaaaatcacacatattattgagaccaactagcaacatagaaagcacaatagtgtaccaacaatggcagctaanatattttgcctccttatgctccttggtctttctgcaagtgctgctacggcgaccattttcccacaatgctcacaagctcctatagcttcccttcttcccccgtacctctcaccaacggtgtcttcggtatgtgaaaacccaattcttcaaccctaccggatccaacaggcaatcgcaggctggcatcttacccttatcacccttgttcctcccacaatcatcagcccctattacagaagttaccttttgggggcatttattgggaacaaaaacttccggggcccaacacttaccaacaacttggggttaacaaaaccttggttgcctaatctccgaaaaaagaagtttttttcatttcaaccaaataacggggattaaaaccctgctttctttatgtggaaaaaaaaaaaaaataacattttccccccgtttttttctgggccccacccccccgaaattttttttccttttcacaccaagggggaagcttttgaaactccccccgtgtttttttttccgccgggaaaaaatatcatcaactttttccccccgggtgggg

SEQ ID NO: 28005 - protein, 129 aa, Zea mays
  misc_feature: Ceres CLONE 1401750-F
  misc_feature (4)..(4): Xaa is any aa, unknown, or other
MAAXIFCLLMLLGLSASAATATIFPQCSQAPIASLLPPYLSPTVSSVCENPILQPYRIQQAIAGWHLTLITLVPPTIISPYYRSYLLGAFIGNKNFRGPTLTNNLGLTKPWLPNLRKKKFFSFQPNNGD

SEQ ID NO: 28006 - DNA, 610 bp, Zea mays
  misc_feature: Ceres CLONE 1401753-F
  misc_feature: Encodes the peptide sequence at SEQ ID NO. 28007
  misc_feature (536)..(536): n is a, c, t, g, unknown, or other
aagctggagctccccgcggtggcggccgctctagaactagtgatcccccgggctgcaggaattcgcacgagaccattacctagaacatcctaatcgaaaaatattctcccaaaaaacccaacactccagtggcggcaaagacctaacatttcaaaatcaatggccaagaaccccaaggcgcccgacacccgcagtggccgttctcccaccagaaggccccgaccacgccgcgccaaggcggtgccagaagcctcctccgcagctgatatcgaagacctggctccctcagtgcctggggccgctgcccctggcgctgccgcacccacggccctgcgcgcacagctgctccggtggtatgacgcgcaccgtagggacctgccgtggcgatgcgtaagcggcagcgaggaagagagggcgtacgcggtgtgggtgtccgaggtgatgctgcagcagacgcgggtgcccgtggtcgtcgcttactacgagcggtggatggcgcggtggccgaccgtacgaagcctcgccgccgctacgcnagaggaggtgaacgagatgtgggcgggtcttggctactaccgtagggctcgatttctgctggagggagcaaagc

SEQ ID NO: 28007 - protein, 150 aa, Zea mays
  misc_feature: Ceres CLONE 1401753-F
  misc_feature (126)..(126): Xaa is any aa, unknown, or other
MAKNPKAPDTRSGRSPTRRPRPRRAKAVPEASSAADIEDLAPSVPGAAAPGAAAPTALRAQLLRWYDAHRRDLPWRCVSGSEEERAYAVWVSEVMLQQTRVPVVVAYYERWMARWPTVRSLAAATXEEVNEMWAGLGYYRRARFLLEGAK

SEQ ID NO: 28008 - DNA, 616 bp, Zea mays
  misc_feature: Ceres CLONE 1401754-F
  misc_feature (521)..(521): n is a, c, t, g, unknown, or other
tggagctccccgcggtggcggccgctctagaactagtggatcccccgggctgcaggaattcgcacgagaccattacctagaacatcctaatcgaaaagccgcaacccctctctcattttcttcctcgtctacacctccttctctcctcctcgatacattcgagcacgcccggacgcggtcagaagggagaaagcagcaagcggcgccgggttccccctcccttcgtcgcccccgatcgacgccgatcggggccgactgctcgtgggggacgccgaccgaagcccgggcggcgctgcttcaatatacggaagcagtttctagttttcttcagttcgccgctgcagtttctagtttccagcggttcccaccagttgtctaataacttattgttgttgtacgtgaggttgcttttgtcgtatttggcaggttgcttttgttgtatttgccaggttgacacacttggtggttgtaaatcattgctatttttgggtcatgacttgtttttattgaaatcaattggntgccaagggtcactaaattcttgatggcacataataggatcaccatgctgccttcttcaaagaattgccagtttgggtcagttctagcaacctgg

SEQ ID NO: 28009 - DNA, 679 bp, Zea mays
  misc_feature: Ceres CLONE 1401761-F
  misc_feature: Encodes the peptide sequence at SEQ ID NO. 28010
  misc_feature (559)..(559): n is a, c, t, g, unknown, or other
  misc_feature (612)..(612): n is a, c, t, g, unknown, or other
  misc_feature (654)..(654): n is a, c, t, g, unknown, or other
  misc_feature (655)..(655): n is a, c, t, g, unknown, or other
aaagctggagctccccgcggtggcggccgctctagaactagtggatcccccgggctgcaggaattcgcacgagaccattacctagaacatcctaatcgaaaaattttttcgactttcgagcgcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctggctgctgcaggtgctccacctgctgagaaaccacctgctgcaaagcctgatggcaccagtcagattggctgctggggttaccagccaaaccaataactaccacaggggccgacggtcagaacaccggaaacttccttacggaccgtccttcgaccaaggtcacgctggtttcctggcggtggctcttccctggatacccctggttggtggaaactgatgccgctcnacaagctatcaccccccactgtcgccgcatgctttttctgaatgtgaaacagncgttggcatttcatgggtaccaaactcccggtcccgcgtggnnccgtaaagctgcgcctaaaattca

SEQ ID NO: 28010 - protein, 44 aa, Zea mays
  misc_feature: Ceres CLONE 1401761-F
MSRGGSAGGGQSSLGYLFGSGEPPKPAVAPAVSAPPGCCRCSTC

SEQ ID NO: 28011 - DNA, 708 bp, Zea mays
  misc_feature: Ceres CLONE 1401764-F
  misc_feature: Encodes the peptide sequence at SEQ ID NO. 28012
tccccgcggtggcggccgctctagaactagtggatcccccgggctgcaggaattcgcacgagaccattacctagaacatcctaatcgaaaagtctgtctgtctgcctccctccgctcacctcctctgcttcttctcgctttcttccatcttggtccagcctccactcttcctgctgagccatggcggctgccgaagaagggccagagccactcaggtatcagactctggccctgagggtgagcatccactgcgagggttgcaagaagaaggtgaagaaggtgctccacagcatagaaggggtgtacaagacggacatagacccgcagcagcagaagggtggtgttcataggcaaccgcccctgcagaagcgctcgggcagaaacttcctcaagtccgggaaaccccccggagcccgtggccggaaaccggctccagcccccaccggcccgccaaagcccccccgggccccgacggattttccgggggggggcggggcaaaaaaaaaaaaaaagaaaaaggctcaccaaaaacccccaaggggggaaaaaaccaccccccggcaaaccggggccgaaggcaccggccccgtattctgctgcatcctctaacggtgacaccccaccccccccggaaaacacaccaaagagcgggcaggcgcgccccccctggggaagaagaactcaccccacacggcgcccccctactcc

SEQ ID NO: 28012 - protein, 142 aa, Zea mays
  misc_feature: Ceres CLONE 1401764-F
MAAAEEGPEPLRYQTLALRVSIHCEGCKKKVKKVLHSIEGVYKTDIDPQQQKGGVHRQPPLQKRSGRNFLKSGKPPGARGRKPAPAPTGPPKPPRAPTDFPGGGGAKKKKKKKAHQKPPRGEKTTPRQTGAEGTGPVFCCIL

SEQ ID NO: 28013 - DNA, 688 bp, Zea mays
  misc_feature: Ceres CLONE 1401766-F
  misc_feature: Translation starting site: 167
  misc_feature: Pfam Name: RRS1 Pfam Description: Ribosome biogenesis regulatory protein (RRS1)
  misc_feature (577)..(577): n is a, c, t, g, unknown, or other
  misc_feature (578)..(578): n is a, c, t, g, unknown, or other
  misc_feature (580)..(580): n is a, c, t, g, unknown, or other
  misc_feature (620)..(620): n is a, c, t, g, unknown, or other
  misc_feature (621)..(621): n is a, c, t, g, unknown, or other
aaagctggagctccccgcggtggcggccgctctagaactagtggatcccccgggctgcaggaattcgcacgagaccattacctagaacatcctaatcgaaaactcgatttctttccctttccctttcccttccccagtcagccgcgagcctcgtaccggcgcagccatggcggaggagcccgccatcgtcgtcgccgcctcctccagctgcgaggtcgacctcggcaacctcatggcgtacgacccgtgtcaccacgtcgcagccgccgcctccgcctccagggaggagctgaggcaggagtgcctgcggaaggggacggaagctggcgcaggcggtggccgacgccctcttcgcgctgccgcccaccgagggaccgcgacggccccatcgtccacctcccgccacacaccgttcgactcccgcgcgagaagcatctacccaagcccaagcaccgaccaaggtggggagctgtttgcaaaggcgaaaggaattaccaagcgcaagaagaacaagcgtggagtgggacgagcaaactcaatcctggaagcggatttatggctatgaccgtgtaatggnngnaataaagacgtttccgattcttgaagccaaactgatgacnnaggcccctggtggttgatccctttggcacggagaaggggatgagaaaaaaaaaaagaagggttgaaa

SEQ ID NO: 28014 - DNA, 695 bp, Zea mays
  misc_feature: Ceres CLONE 1401774-F
aaagctggagctccccgcggtggcggccgctctagaactagtggatcccccgggctgcaggaattcgcacgagaccattacctagaacatcctaatcgaaaactcgaaaccctagcgccggcgcctccacttcgttttcctcactctctccctcagctcagggtccggcggcgaagggaaagcaagatgtacaccgcgaggaagaagatcaggaggagaagggcttgaggccctcgaggttgaggactcccgtggccaggttttctttggttggggaaaggggacccggggtccaggagggacccccagggactggtaattaacaagggtttcccaaagggggggtcccgggagaaaaaaagcgctcttgttaccggggggggaaaaaacgctgtggaaagggcttttcggaaaaacactgttgggaaaacctccggggggggggggggaaaaaaaattctcggggggaggggaggggggaaaatggtggggaaaaggggagcggggggggggggggcccccacaaaagagggggcggcaggggtggggggaccgcgccaaaggggagaaaagacgggggggtggccgcacgaagagacttgtgagaagggagggcggggcaccccgaattcgcggggccgggggcataccgacagtacgcccgatgcgcgcaagagaccccagcggcgggcggg

SEQ ID NO: 28015 - DNA, 698 bp, Zea mays
  misc_feature: Ceres CLONE 1401787-F
  misc_feature: Encodes the peptide sequence at SEQ ID NO. 28016
  misc_feature (453)..(453): n is a, c, t, g, unknown, or other
  misc_feature (570)..(570): n is a, c, t, g, unknown, or other
tggagctccccgcggtggcggccgctctagaactagtggatcccccgggctgcaggaattcgcacgagaccattacctagaacatcctaatcgaaaacatttgtcctccaactatttcgccgcacaggcctctagaagcaatcaggcgagcggcggctgcggcgcgatgggagagcaggtcgtgacgcatcgtatcccgcggaagctggaggaggccaacgctaccgtccaacagcacctcgccggcatccaggaccacgtcaacttcaccatgcagcatgcatacttcaagtgcgcatatgattgcttcgatcggcgccgcactcaggaagcgatcaacaattgtgtggagaattgtggtatgcctgtccttgctgtcagcaatgtttttgagagtgagatgtacaagtgtcgcgaacgtttgaacgggtcatttgatggtctgtcgaaganaagtttgaaggtgtcatgctgccagaagatgaaaactgatgcaactctggaactcgtaatcctgtgacaacagaatctatcgatgacagcatctggcactcccgatacgtggctgcnttaatatgcagcccaccctactactcttttaacggcattatactgtttactctatgacccaaaaattgtttttgaatttgacccataggccgtcctgaggctcgctgcttatatttgcagcagcaaaa

SEQ ID NO: 28016 - protein, 117 aa, Zea mays
  misc_feature: Ceres CLONE 1401787-F
  misc_feature (10)..(112): Pfam Name: DUF842 Pfam Description: Eukaryotic protein of unknown function (DUF842)
  misc_feature (96)..(96): Xaa is any aa, unknown, or other
MGEQVVTHRIPRKLEEANATVQQHLAGIQDHVNFTMQHAYFKCAYDCFDRRRTQEAINNCVENCGMPVLAVSNVFESEMYKCRERLNGSFDGLSKXSLKVSCCQKMKTDATLELVIL

SEQ ID NO: 28017 - DNA, 617 bp, Zea mays
  misc_feature: Ceres CLONE 1401790-F
  misc_feature: Translation starting site: 346
aaagctggagctccccgcggtggcggccgctctagaactagtggatcccccgggctgcaggaattcgcacgagaccattacctagaacatcctaatcgaaaaacgggtgcccagccgccgcacagtctttcgaactgaggaaccctaggcccagcactcggcgacggcggcgcgccaccggcgacgggatcagcggcatcactcccctccttccccggcgcggcggcgccctgcacctaggccctagcactgcagcactcgacaacaggatcagcggtcgcgcccccctcctccttccccggcgcggcggcgccctgcagatctgccactgtccgcctgccggtcatggagcacctccggtggcgccccacagtgaacgagcgcgacttcattgagtgtgcgctccagtctgacctccgtgttgacggccgccactcctttgacttccgcaaggctcagatcacccttcggcagggaggatggctcgtcagaggtgcagctcggggagacacacgtgatgggctacgtgaccgggcagctggtgcagccattacgtgacaggccgaaaggaggggacgctggtctaattcaccgagttctcacccatggcgaccctt

SEQ ID NO: 28018 - DNA, 652 bp, Zea mays
  misc_feature: Ceres CLONE 1401803-F
  misc_feature: Encodes the peptide sequence at SEQ ID NO. 28019
tggagctcaccgcggtggcggccgctctagaactagtggatcccccgggctgcaggaattcgcacgagaccattacctagaacatcctaatcgaaaaaacccaacgcggccgtccccgtcccgagtcaccaactcaccaccgaccctaccaaaaccgcacgcaccctgccagcggccccccaactcccaacccaacccctactccagctagcgcggcggctgcgatcatggcgttccggctgagcaacaacctgatcggggtcctcaacttcgtcaccttcctgctctccgtcccgatcctgggcgcgggcatctggctgggccaccgcgccgacggcaccgagtgcgagcgctacctctcggcgcccgtcatcgcgctgggggcgcttcctcctcgccgtctccctggcgggcctcgtcggagcatgctgccgcgtcacctggctgctctgggcctacctcctcgccatgtacgtcctcatcctcgtcctcttctgcttcaccgtcttcgccttcgtcgtcaccaacaggggcgccggcgaggacgtctccggccgcggatacgaggagtaccgcctcggggactactccaactggctgcagaagcgcgtcgagaacaccaggaactgtcaccgtatcaggagctgcctcc

SEQ ID NO: 28019 - protein, 61 aa, Zea mays
  misc_feature: Ceres CLONE 1401803-F
MYVLILVLFCFTVFAFVVTNRGAGEDVSGRGYEEYRLGDYSNWLQKRVENTRNCHRIRSCL

SEQ ID NO: 28020 - DNA, 725 bp, Zea mays
  misc_feature: Ceres CLONE 1401808-F
  misc_feature: Encodes the peptide sequence at SEQ ID NO. 28021
tccccgcggtggcggccgctctagaactagtggatcccccgggctgcaggaattcgcacgagaccattacctagaacatcctaatcgaaaaacacaagcaaagcagcagcaacagccaacacctaaactaaagaacactagtccctgtgtacgtctagcaacgatccgcaccgagctcgccagttttgctcgttagtttggggacggcgatggcgtccggtcaggaaagcagggaggagctggcgcgcatggccgaggaggggcagaccgtcgtccccggcggcaccggcggcaagaccctcgaggcgcaggagcacctcgccgaagggcgcagccacggcgggcagacccggagtgagcagctaggccatgaggggtacagcgagatggacagcaagggcgggcagacgcgcaaagagcagcctgggccacgagggttaccagcggagatgggtgtgggaaagactgactgaaattaatcccataagcagacaaagtcgtccccaagaagttacttgttgaggtaaagtaggggcggccccgaccacgctcgaggcagctccggcgcgcgcgggggccgggcgacgcccggtggcgcgggccgtggcggcgagtggggaggcgcgtgactcccgtcgctcggcgtttcaggtcccggtcacaccgtcgccggacggcttataatactttggaatcgccgtgggcgagagtcccagcacggggcg

SEQ ID NO: 28021 - protein, 87 aa, Zea mays
  misc_feature: Ceres CLONE 1401808-F
  misc_feature (1)..(88): Pfam Name: LEA_5 Pfam Description: Small hydrophilic plant seed protein
MASGQESREELARMAEEGQTVVPGGTGGKTLEAQEHLAEGRSHGGQTRSEQLGHEGYSEMDSKGGQTRKEQPGPRGLPAEMGVGKTD

SEQ ID NO: 28022 - DNA, 679 bp, Zea mays
  misc_feature: Ceres CLONE 1401813-F
  misc_feature: Encodes the peptide sequence at SEQ ID NO. 28023
  misc_feature (16)..(16): n is a, c, t, g, unknown, or other
  misc_feature (20)..(20): n is a, c, t, g, unknown, or other
ccagctggagcttctngcgntggcggccgctctagaactagtggatcccccgggctgcaggaattcgcacgagaccattacctagaacatcctaatcgaaaagatcaaactttagtctactcgtcctcggtcctcctcttctcgcagcagccagcagaccaatcgggacaagcaaactcccccgattagtttaagcagcccgggcccggcgacgaccagctccgttccgcgcggggatttaaacgcgcgaagcgagaaggcacgcagcaggcggcagcggcaagcaacgaacgcgatcgcgcgccgacgacgacgggcggtgccgggcccctggtggtgccttgttccccaaccccgctgcttgttgtccccccccccgggggggggggggggggcccctctcccccctatatgtccaaatttcacccctccctcccccctctggctccttctcagctttcgtgccttcgcgatcccccccccgctcccccacctcccccgccctccccacggcgcccacccgcgctcttccctcatcgcgcgtctccgcccgtccgcgcctccccgcccgtccctctggtcgtcggccccgcccctgcctctccatcccttaggcgcgctcacgcagcacgcattcgccatttgtccccctgctatttctctcccccccctcctggcg

SEQ ID NO: 28023 - protein, 62 aa, Zea mays
  misc_feature: Ceres CLONE 1401813-F
  misc_feature (6)..(6): Xaa is any aa, unknown, or other
  misc_feature (7)..(7): Xaa is any aa, unknown, or other
PAGASXXGGRSRTSGSPGLQEFARDHYLEHPNRKDQTLVYSSSVLLFSQQPADQSGQANSPD

SEQ ID NO: 28024 - DNA, 698 bp, Zea mays
  misc_feature: Ceres CLONE 1401814-F
  misc_feature: Translation starting site: 196
  misc_feature (337)..(337): n is a, c, t, g, unknown, or other
  misc_feature (355)..(355): n is a, c, t, g, unknown, or other
  misc_feature (451)..(451): n is a, c, t, g, unknown, or other
  misc_feature (531)..(531): n is a, c, t, g, unknown, or other
  misc_feature (532)..(532): n is a, c, t, g, unknown, or other
  misc_feature (583)..(583): n is a, c, t, g, unknown, or other
  misc_feature (587)..(587): n is a, c, t, g, unknown, or other
  misc_feature (619)..(619): n is a, c, t, g, unknown, or other
  misc_feature (629)..(629): n is a, c, t, g, unknown, or other
  misc_feature (636)..(636): n is a, c, t, g, unknown, or other
  misc_feature (647)..(647): n is a, c, t, g, unknown, or other
  misc_feature (648)..(648): n is a, c, t, g, unknown, or other
  misc_feature (698)..(698): n is a, c, t, g, unknown, or other
tggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagcggnaccggcggcggcccacgnaccccggcgggcctggatcgcggcggcggtggcgcacgcgttcgcgctgtttcgtggcgggtgtctgtgggcgcgaacatctccggcgggcacggnaaccctgccgtgaccttcggcggccttcgtgggcggaacatccccttggttccgggggctcctggaactgggtggcgaannttgctggggtccaaccgtgggcgtgcttcctgctcccgcttctcgacgggncggncaggccacgggcaccttccggcctgagggggncgggtgcccntggtggnaagcccccttnntcctttgaaaaacttgaaagaccctccgggctggggggaacacggggaan

SEQ ID NO: 28025 - DNA, 672 bp, Zea mays
  misc_feature: Ceres CLONE 1401818-F
  misc_feature: Encodes the peptide sequence at SEQ ID NO. 28026
  misc_feature (309)..(309): n is a, c, t, g, unknown, or other
  misc_feature (367)..(367): n is a, c, t, g, unknown, or other
  misc_feature (368)..(368): n is a, c, t, g, unknown, or other
  misc_feature (409)..(409): n is a, c, t, g, unknown, or other
  misc_feature (472)..(472): n is a, c, t, g, unknown, or other
  misc_feature (473)..(473): n is a, c, t, g, unknown, or other
  misc_feature (475)..(475): n is a, c, t, g, unknown, or other
  misc_feature (476)..(476): n is a, c, t, g, unknown, or other
  misc_feature (491)..(491): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (551)..(551): n is a, c, t, g, unknown, or other
  misc_feature (554)..(554): n is a, c, t, g, unknown, or other
  misc_feature (573)..(573): n is a, c, t, g, unknown, or other
  misc_feature (574)..(574): n is a, c, t, g, unknown, or other
  misc_feature (592)..(592): n is a, c, t, g, unknown, or other
  misc_feature (599)..(599): n is a, c, t, g, unknown, or other
  misc_feature (627)..(627): n is a, c, t, g, unknown, or other
  misc_feature (630)..(630): n is a, c, t, g, unknown, or other
  misc_feature (631)..(631): n is a, c, t, g, unknown, or other
  misc_feature (640)..(640): n is a, c, t, g, unknown, or other
  misc_feature (665)..(665): n is a, c, t, g, unknown, or other
  misc_feature (668)..(668): n is a, c, t, g, unknown, or other
tggagctccccgcggtggcggccgctctagaactagtggatcccccgggctgcaggaattcgcacgagaccattacctagaacatcctaatcgaaaaaacacgcgggcgcgctagctagtgagagtcggagatgtcgtcgccgcggccacacttcctcgtgctcaccttccctttccagggccacatcgccccggctctccgcctcgccaggcagctgctcgcggcggcgcccgacgcgctcgtgaccttctccaccaccgaggtcgcgcacaggcgcatgttcccggcaaagcccaacgacggcgccnaggactccgacgaagacggccgcctcgagttcctcccgttctccgacggcacggaggnnccgggtaacgtccggagcgccgaccctgggctcgttcacgncctacatgacgtcttccaccgggcggcgggggcgcgcagcggcccgcgggagatcgtggaggnncnnccggggggggggggncnnnccccgggggccccggggcgggggacccggctggcccctcccggggggcggggcggnggncggggggggcaccgggggnnccccggcccgcggccccnccggggncccggccggggcccccgggggccgcccnccnnccccccccngcttccccgggccgggggggggggnggncccg

SEQ ID NO: 28026 - protein, 180 aa, Zea mays
  misc_feature: Ceres CLONE 1401818-F
  misc_feature (60)..(60): Xaa is any aa, unknown, or other
  misc_feature (79)..(79): Xaa is any aa, unknown, or other
  misc_feature (93)..(93): Xaa is any aa, unknown, or other
  misc_feature (114)..(114): Xaa is any aa, unknown, or other
  misc_feature (115)..(115): Xaa is any aa, unknown, or other
  misc_feature (121)..(121): Xaa is any aa, unknown, or other
  misc_feature (122)..(122): Xaa is any aa, unknown, or other
  misc_feature (148)..(148): Xaa is any aa, unknown, or other
  misc_feature (154)..(154): Xaa is any aa, unknown, or other
  misc_feature (166)..(166): Xaa is any aa, unknown, or other
  misc_feature (167)..(167): Xaa is any aa, unknown, or other
  misc_feature (170)..(170): Xaa is any aa, unknown, or other
MSSPRPHFLVLTFPFQGHIAPALRLARQLLAAAPDALVTFSTTEVAHRRMFPAKPNDGAXDSDEDGRLEFLPFSDGTEXPGNVRSADPGLVHXLHDVFHRAAGARSGPREIVEXXPGGGGXXPGAPGRGTRLAPPGGRGGGRGGHRGXPGPRPXRGPGRGPRGPPXXPPXLPRAGGGGGP

SEQ ID NO: 28027 - DNA, 640 bp, Zea mays
  misc_feature: Ceres CLONE 1401826-F
  misc_feature: Encodes the peptide sequence at SEQ ID NO. 28028
  misc_feature (294)..(294): n is a, c, t, g, unknown, or other
  misc_feature (325)..(325): n is a, c, t, g, unknown, or other
  misc_feature (361)..(361): n is a, c, t, g, unknown, or other
  misc_feature (384)..(384): n is a, c, t, g, unknown, or other
  misc_feature (390)..(390): n is a, c, t, g, unknown, or other
  misc_feature (395)..(395): n is a, c, t, g, unknown, or other
  misc_feature (409)..(409): n is a, c, t, g, unknown, or other
  misc_feature (416)..(416): n is a, c, t, g, unknown, or other
  misc_feature (438)..(438): n is a, c, t, g, unknown, or other
  misc_feature (526)..(526): n is a, c, t, g, unknown, or other
  misc_feature (527)..(527): n is a, c, t, g, unknown, or other
  misc_feature (545)..(545): n is a, c, t, g, unknown, or other
  misc_feature (546)..(546): n is a, c, t, g, unknown, or other
  misc_feature (550)..(550): n is a, c, t, g, unknown, or other
  misc_feature (558)..(558): n is a, c, t, g, unknown, or other
  misc_feature (559)..(559): n is a, c, t, g, unknown, or other
  misc_feature (569)..(569): n is a, c, t, g, unknown, or other
  misc_feature (590)..(590): n is a, c, t, g, unknown, or other
aaagctggagctccccgcggtggcggccgctctagaactagtggatcccccgggctgcaggaattcgcacgagaccattacctagaacatcctaatcgaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtggncatgctcccgttcgtgctcgcgaacctcggncgcctctacgacgccatcaccgacgccctccacggntccgggtgcacgtcattgttccngcgggncgtgncttcgcccgcgcgnacttccntgctgacgtgcgaccccggcgnccgtccagcacttgcctggcgtccaaccacggggggctacgacaggggccgagacttttgcggagatgttcgacctccctggcgacgnnctgctggttgcgacgccnncggncgtgggcnnccccagcggnacgtcgccgccacgtctcggnacccccggggtccgggcccttcgcctggggcacatggcgcgcacaaaggg

SEQ ID NO: 28028 - protein, 161 aa, Zea mays
  misc_feature: Ceres CLONE 1401826-F
  misc_feature (46)..(46): Xaa is any aa, unknown, or other
  misc_feature (76)..(76): Xaa is any aa, unknown, or other
  misc_feature (78)..(78): Xaa is any aa, unknown, or other
  misc_feature (80)..(80): Xaa is any aa, unknown, or other
  misc_feature (87)..(87): Xaa is any aa, unknown, or other
  misc_feature (94)..(94): Xaa is any aa, unknown, or other
  misc_feature (124)..(124): Xaa is any aa, unknown, or other
  misc_feature (130)..(130): Xaa is any aa, unknown, or other
  misc_feature (134)..(134): Xaa is any aa, unknown, or other
  misc_feature (138)..(138): Xaa is any aa, unknown, or other
  misc_feature (145)..(145): Xaa is any aa, unknown, or other
MGALRSLAISYPEFLVAGLCFVSLSALRHAMRERRQRAPLSWPVVXMLPFVLANLGRLYDAITDALHGSGCTSLFXRXVXSPARTSXLTCDPGXRPALAWRPTTGGYDRGRDFCGDVRPPWRRXAGCDAXGRGXPQRXVAATSRXPRGPGPSPGAHGAHKG

SEQ ID NO: 28029 - DNA, 628 bp, Zea mays
  misc_feature: Ceres CLONE 1401828-F
  misc_feature: Encodes the peptide sequence at SEQ ID NO. 28030
  misc_feature (608)..(608): n is a, c, t, g, unknown, or other
aagctggagctccccgcggtggcggccgctctagaactagtggatcccccgggctgcaggaattcgcacgagaccattacctagaacatcctaatcgaaaaatcttcgccgccgctaaacgttccccccacgccccaacctatccacgcgaaaccttctttcccccgggagacgattcgtcagggagaggaaagaggcaagaggggccatggacgctgccaagttggtgacgccggtcgctgtgtctcacattctggcgcacccgtcggcgggctccgacggcgcagtgaccgatctcgtcgttcaggtcctcgacctgaagtccgtcggcacgggcagccggttcagtttcacagcaactgacgggaaggataagatcagggcgatgcttcccaccacttcggggtcggaggtccgctctggcaacctgaagaaactcgggctcatccgcatcatcgactacacttgcaacgtcgtcaaaggcaagatgacaaagttcttggtgtcatcaaatgcgagcttgtgtgccagcgcttgacgccgagatcacggcggaggccaaaaagaggagcctcctattgtgctgaacctaaagacgaatggatggncgtgacatccccactcggta

SEQ ID NO: 28030 - protein, 109 aa, Zea mays
  misc_feature: Ceres CLONE 1401828-F
  misc_feature (6)..(108): Pfam Name: Rep-A_N Pfam Description: Replication factor-A protein 1, N-terminal domain
MDAAKLVTPVAVSHILAHPSAGSDGAVTDLVVQVLDLKSVGTGSRFSFTATDGKDKIRAMLPTTSGSEVRSGNLKKLGLIRIIDYTCNVVKGKMTKFLVSSNASLCASA

SEQ ID NO: 28031 - DNA, 661 bp, Zea mays
  misc_feature: Ceres CLONE 1401829-F
  misc_feature: Translation starting site: 148
atagctggagctccccgcggtggcggccgctctagaactagtggatcccccgggctgcaggaattcgcacgagaccattacctagaacatcctaatcgaaaaacgcagtttctcgcgccatctgaagtcagctggggcgacgaagaaatgtcctctagcgatcaaaacccagctgccacacccgcgtcgtcgggccccgccgagccctcgccgccgggcaggccaacggcggtgtcctcgcgtgtcctcgacatgggcgcgcagctggcgcaggcgctgaagccggtgcggcagatgaagcagcacgcgtgcagcttcgcgctgtacgcccacgacttgcaccgcccaggtggaggtccaccacttcgtcgcccggtgcaaccaggacgtcctccagtgcgccgtctacgactccgacaagccctcggcccggcctcatcggcgtggagtacatcgtctccgacaccatcttcgagggcctggccccggacgagcagaggctgtggcactcgcacgcgtacgaggtgaaggccgggctgtggaccgacgtcggcgtgccggaagcgctgcagagctccgaagatggcgagcctcccaaggacgaacggccaggtttggggttaccttggcaggcgtaccgagtttgtgtttattttccttc

SEQ ID NO: 28032 - DNA, 890 bp, Zea mays
  misc_feature: Ceres CLONE 1401835-F
cctccaccccacttccggcggcgatgaggtcttgggccccccccacaaacctggaactccccgcggaggcggccgctcatgcactagtggatcccccgggctgcaggtttttcgcacgagaccattacctagaacatcctaatcgaaaaataccatccctcgaccggccacctcttcccaattggatcgcatccccaggacttgccggacggtccagagacggcgataatggggggttctgaggcgagagcaccggtgacggcctggctggcgatcgccgtcggcttgcccgccgtggtttcctcgtgacaggctcaagtcttctacgccggtggccgggacggttgggtgcttgaccccaccgagagctacaaccattgggcgcggccgcagccggttccaggtgaacgacaccatcccgcctcgcgcacgagggagggcctatcacactggtgctcccgccgaacggagccaggactgtcggaaacatgggaaaacggcggaaacccgggtccccggcggactccaaggcccgtctggcatgccccccggagagtactgggaagcggggccgggggtgccacggtttcggaccggcgtcacgggaccggcggtactgtgggccacccacccaagtcgagcgctagcaacgggccgccccaaaaggggcccgggcagggtcggggaaagtgaatagggggatggggcgggttccctcccggttggaacgcaacacccggagcgggcactcggaaatccacacaaaaacgggggttcctccgcccgggggaatttcgacaccgtaacgccacgatatcccgggtctccccccgccggggaaggccttcacccaggagcgggggcagccagggaggaccaagaaacacctc

SEQ ID NO: 28033 - DNA, 621 bp, Zea mays
  misc_feature: Ceres CLONE 1401841-F
  misc_feature: Encodes the peptide sequence at SEQ ID NO. 28034
  misc_feature (330)..(330): n is a, c, t, g, unknown, or other
  misc_feature (621)..(621): n is a, c, t, g, unknown, or other
tggagctccccgcggtggcggccgctctataactagtggatcccccgggctgcaggaattcgcacgaaccattacctaaaacatcctaatcgaaaaaatcagtgctcgctagcccaccacgccctgaacctagcccggacaccagccagaacaggccatgtccatgggctccccggtgcagctcaggcggatgaagcctctgtaccagttcgtggtgaacaacatcctgcccatcgtggccgtgccgctcgccaccgcggtcctgctcaaggcgtcgtcgctcgggcccgaggagatcctggcgctccggccgacgcacctgttcctggncgcgttcctgcctgccgcgaccacggtgctgtacctgatgctccggccgcgcacgttgtacctgccgaactacgcgtgcttccgcaccagccccaactgccgcgtcccgttcgcgacgttcctgtagcactcccgcgtggggccgggcttcgacgagcgcagcgtccggttcatgacgcccttgctggaacggaccgccctcgaagaggaaacgggcctgcccgaagggcaatacacctccccgcgggcgcgacctggagtcctcccgcgccgagggcgaattcgtaattn

SEQ ID NO: 28034 - protein, 99 aa, Zea mays
  misc_feature: Ceres CLONE 1401841-F
  misc_feature: SWISSPROT Homolog: EC 2.3.1.119 Icosanoyl-CoA synthase
  misc_feature (58)..(58): Xaa is any aa, unknown, or other
MSMGSPVQLRRMKPLYQFVVNNILPIVAVPLATAVLLKASSLGPEEILALRPTHLFLXAFLPAATTVLYLMLRPRTLYLPNYACFRTSPNCRVPFATFL

SEQ ID NO: 28035 - DNA, 699 bp, Zea mays
  misc_feature: Ceres CLONE 1401846-F
  misc_feature: Encodes the peptide sequence at SEQ ID NO. 28036
  misc_feature (623)..(623): n is a, c, t, g, unknown, or other
aaagctggagctccccgcggtggcggccgctctagaactagtggatcccccgggctgcaggaattcgcacgagaccattacctagaacatcctaatcgaaaaaaaccaaaaccccggccatctctctactcactcttcctgtctcctcgtcttgctggagccagtattaacagatccgggttcgagcgtccagtctcgccggacctccgactggcggtcgctgctatctctctggtaccgcggtctcttgcgcgcttctctccattcgctcccactcaccggcttgggagaatgaaggatgtgctagggagcccggcgacctgtagtggcatgctgctgcggttgtcgcaatgcgtgtccgctgctgcatgcatgggagctagggccacagcgtacggcttctccgactacactgctttctgctacttgattgcttcaatgcgactacatcttactctggagtctgggcctcggtttgacgtgatgtctactctatgaggactaacagagatcttcgctgccctgtgctggtaagacttttatggtgtagggtgactgggacactgcatattctgctcgttgctgaacgaggatctgctctgctgcgttgctcatcccgtggnaatagggagatgcacgttcttatgtatgaaacgcgcaaggtggagggctgtgcacgatgaaaatactcacggtctg

SEQ ID NO: 28036 - protein, 68 aa, Zea mays
  misc_feature: Ceres CLONE 1401846-F
MKDVLGSPATCSGMLLRLSQCVSAAACMGARATAYGFSDYTAFCYLIASMRLHLTLESGPRFDVMSTL

SEQ ID NO: 28037 - DNA, 623 bp, Zea mays
  misc_feature: Ceres CLONE 1401849-F
  misc_feature: Encodes the peptide sequence at SEQ ID NO. 28038
  misc_feature (528)..(528): n is a, c, t, g, unknown, or other
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtggtggggctggccgtggccacgccggtgttcctgatcttcagccccgtgctggtccccgccgcgctgctcatcgggacggccgtcatggggtccctcacgtcggncgggctgggggctcgggggcctggccctccctcacgggccccgccaaacggggggggaaggggttccagggccccccggaaaaacgggggggggc

SEQ ID NO: 28038 - protein, 139 aa, Zea mays
  misc_feature: Ceres CLONE 1401849-F
  misc_feature (44)..(132): Pfam Name: Oleosin Pfam Description: Oleosin
  misc_feature (108)..(108): Xaa is any aa, unknown, or other
MADRDRSGIYGGAHATYGQQQQQGGGGRPMGEQVKGMLHDKGPTASQALTVATLFPLGGLLLVLSGLALTASVVGLAVATPVFLIFSPVLVPAALLIGTAVMGSLTSXGLGARGPGPPSRAPPNGGGRGSRAPRKNGGG

SEQ ID NO: 28039 - DNA, 706 bp, Zea mays
  misc_feature: Ceres CLONE 1401851-F
  misc_feature: Translation starting site: 210
  misc_feature: SWISSPROT Homolog: EC 1.1.1.1 Alcohol dehydrogenase
  misc_feature (424)..(424): n is a, c, t, g, unknown, or other
  misc_feature (434)..(434): n is a, c, t, g, unknown, or other
  misc_feature (444)..(444): n is a, c, t, g, unknown, or other
  misc_feature (464)..(464): n is a, c, t, g, unknown, or other
aaagctggagctccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaagggcagactcccgtgttccctcggatctttggccacgaggctggnagtatcatanagagtgttgnagagggtgtgactgacgtanctccgggcgacatgtccttcctgtgtcactggggagtgcagggagtgtgccactgcaagtcggcagagagcacatgtgtgatctgctcaggatcaacaccgaccgcgtgtgatgattgcccatgggcagtccggttttcaatcattggaaggctatctcccctttgggtggacttcccccctcacggagaacccccttgcttttgggtttggttgaaaaaataaacctcgggtccccttgaa

SEQ ID NO: 28040 - DNA, 700 bp, Zea mays
  misc_feature: Ceres CLONE 1401859-F
  misc_feature (494)..(494): n is a, c, t, g, unknown, or other
  misc_feature (506)..(506): n is a, c, t, g, unknown, or other
  misc_feature (509)..(509): n is a, c, t, g, unknown, or other
  misc_feature (513)..(513): n is a, c, t, g, unknown, or other
  misc_feature (679)..(679): n is a, c, t, g, unknown, or other
ctggagctccccgcggtggcggccgctctagaactagtggatcccccgggctgcaggaattcgcacgagaccattacctagaacatcctaatcgaaaactgtgtcttgtccagtccgggtctccagggctccggcaccggcaggcagagagctaccaaaccccaccaccacgaacggccgccgccgacgagacgggggcgcatggcgactgcatcctccttcaccgccatcttcttcagcagcgccttcgcggcctgcttcgcggagccaaagtgcggctccagctgcaaaggaaggcaccactaccgtcgccaccagtggctgcagcagctgctgctggaggcacgctagccacaatcagtgcatcggcccggggaggggaaaggggttgccgcgctctgggaagggcgtcatccccggcctccaccgtcagttccttctatggcggcctcccgcatcggcttgtatggagcctgtgaaggctttcttcgtcngaggcgcttgtngtngggnttggatgtccagtttaactaagcaagatcccttgctgcactttaccacaggtgtggaatagccgattggttgtggcaaatccaactgatctttgtcaaaagttagggttgcaagcttgatgggaaaagctaacactattcaaggaggaatttattctgggagcccnttaatgcatacgctacaatat

SEQ ID NO: 28041 - DNA, 718 bp, Zea mays
  misc_feature: Ceres CLONE 1401860-F
  misc_feature: Translation starting site: 410
  misc_feature (351)..(351): n is a, c, t, g, unknown, or other
  misc_feature (394)..(394): n is a, c, t, g, unknown, or other
  misc_feature (397)..(397): n is a, c, t, g, unknown, or other
  misc_feature (399)..(399): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (419)..(419): n is a, c, t, g, unknown, or other
  misc_feature (425)..(425): n is a, c, t, g, unknown, or other
  misc_feature (426)..(426): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (452)..(452): n is a, c, t, g, unknown, or other
  misc_feature (455)..(455): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (569)..(569): n is a, c, t, g, unknown, or other
  misc_feature (597)..(597): n is a, c, t, g, unknown, or other
  misc_feature (613)..(613): n is a, c, t, g, unknown, or other
  misc_feature (657)..(657): n is a, c, t, g, unknown, or other
gctctagaactagtggatcccccgggctgcaggaattcgcacgagaccattacctagaacatcctaatcaaaaaacaacgcacatgcggaagcggagacgctgacgcacctctgagcctggcggcgatttttctatataaccagcgccgctaattccgggtgcttcgctgtagagatgcggcaaaagcgaaagaagaatccgatccgcttctccacgccgaacccggtaaggccgccgccgcttctcgaatggcctccaactcctcctcctcgcctcagccgccgcccggcggcgggcggcagccgtccccccggtggccagcttcccttcgcccgaaggatttcagcccncagcagatgggaagggcccaagacagagcaaacccccccgcgnggncncccnnnntgcatgggtcggnaaactnncctnnnnnnnnggggtagnnnnnngnggnggcgaccccacaagagggaaccgactcgagtggtcggccnnntataagacctctccaaaacagaaaggggagtatgtagcgcgacaccaccccggcggctccgatccactgcgngcgcccacctgacctttattggatggancaaattctattcgcgncgactctacgaccagtgcgccactccctcgacccaacgacaccnagctgctaaccgtgcgggagagttagtacctaccacgcgggccgtattcgttgtcataaga

SEQ ID NO: 28042 - DNA, 680 bp, Zea mays
  misc_feature: Ceres CLONE 1401861-F
  misc_feature: Translation starting site: 348
  misc_feature (276)..(276): n is a, c, t, g, unknown, or other
  misc_feature (680)..(680): n is a, c, t, g, unknown, or other
aaagctggagctccccgcggtggcggccgctctacaataccgtctcccgcgggatgccggattatctcgtctacatcaccgtagacgtccgactctaagacgttcctggcactcaccttcttcctttcctaacaattagtcccttctgctaacccccccggcaccacgacgagatctcaccccgagagtagctgaccgacctaccggcatggagatgaagctgaccatcacgagagtgccctctcgtcgtctccaactaccatcaggacgcctacnagccgcgcgagacctgcattaggaactgactcgtcgagtgctgcctgactgcttccaagcttcccctctacatgttcaagttgactccgaacaaggtctcgcaggaggatgctgcttcatcaagttacttgtcgatattctccttagtgagtgggaggacaggatgactcgcagattattccgctacgatgccactgactgtgagaccaaggtcattcctggcaggctttgggattgttgcacaactcactgagcggcgccatctgaagaatgccctactgtgttacgtgtggaccgggtgatccagccgttagaccctgacaacatcagtttcacagaagtggcccaggcattaggatctcttcagatagaaaaaagggctggggatgatacctatctcctgn

SEQ ID NO: 28043 - DNA, 689 bp, Zea mays
  misc_feature: Ceres CLONE 1401862-F
aaagctggagctccccgcggtggcggccgctctagaactagtggatcccccgggctgcaggaattcgcacgagaccattacctagaacatcctaatcgaaaaattgctacatcctcgagtgtgctccctctgcggctctctcatctcgtggaacgctcgacctcatctatcgatatgattctggcaaatgagaaccgtggagtagaactagcagtcccttctccaagatggcgctgtgatggcgaacacggacttctcccgccttaatactccttagattgagcctccagcgtgcctgcacggccgcagtctgatgcaagcgcattcacgaccaccgagcatcgctacgggggacggctgtcatgactgcattcaatgatcgccctctcaccatgccaacgctctgcgtacctgaggacatacgatgcgcttcgttctagaagaggatcccgctaccttgagagaagcttggacagcctattggacgcccgtatggagagtgggccgccagcattcctgacgcgacgtactacatcacgatttacttgaccacctacgtaccgaggacagatgctcaaccgtcgtggacacgacagcaacatattgtgacgaccgaaagaaatgtatcgttccaagacaggtccatgctgccttgctgcaccccaagtgcgagcaggcgccagcttggg

SEQ ID NO: 28044 - DNA, 809 bp, Zea mays
  misc_feature: Ceres CLONE 1401865-F
  misc_feature: Encodes the peptide sequence at SEQ ID NO. 28045
  misc_feature (48)..(48): n is a, c, t, g, unknown, or other
gtccccccccccctcccctcctcctttgctgttgtagtgcggcggctntcacaagtggagctccccgcggtggcggccgctctagaactagtggatcccccgggctgcaggaattcgcacgagaccattacctagaacatcctaatcgaaaaaacaacccaaagcagccacaggagcctccttcctcctctcactctcgctcgcgctgcgctcgctacctcgcttcgcattccattcgaaaagaggggaggaaaggcaagatgttcatcgagagctgccgcgtcgagagcccccacgtgcggtacggtccgatggagatcgagtcggagcaccggcacgacacgacggatctggtacacgagggcaaggacggcccctcacgctgggtcgtccgccccaaagtccgtcaagtaccacttggggaccagaaccgccgtccccaagctccgggttgatgcttgtggggtggggaacgaaacaacgggtccacgctggacggctgggcctcattgtccaacaggggaggggatctcatgggcggacccaagggaaaaaggggcagcaaggcaaactactacggggtgccccatcaccccagggcctcccaacaatcagaagccgggacgctacccaccgggggaggaagatcctaatggctccggggtcaaaggaggctaccttttccccatagggggaccgccagacacgaacgatttggggagccgcgaggggggggggcaccattgggccacggtgggagacctgggggcggagcgtgccgtggaccggaaggggggccaaagcggggc

SEQ ID NO: 28045 - protein, 64 aa, Zea mays
  misc_feature: Ceres CLONE 1401865-F
  misc_feature: SWISSPROT Homolog: EC 5.5.1.4 Inositol-3-phosphate synthase
MFIESCRVESPHVRYGPMEIESEHRHDTTDLVHEGKDGPSRWVVRPKVRQVPLGDQNRRPQAPG

SEQ ID NO: 28046 - DNA, 723 bp, Zea mays
  misc_feature: Ceres CLONE 1401875-F
  misc_feature: Encodes the peptide sequence at SEQ ID NO. 28047
tcttaactagtggatcccccgggctgcagtaattcgcacgagaccattacctagaacatcctaatcgaaaaagatctttcccccgtcctccctcgccttcgccttcgccggtaggacatttcaccaccaccgccggaccgccccgaccctcctcccctctcgcgctatggcccagactgttgtgctcaaggttggcatgtcctgtgagggctgtgttggagctgtcaaacgagtcctgggcaagatggaaggcgtcgagtcctacgacgtatacatcatggaacagaaggtcaccgtgaaagggcaatgtgacacctgacgccgtcctgcaaactgtttccaagactgcgaagaagacttcgttctgggaggctgaggccgtgacaagtgagtccgccacacctgccggtgccaccgtctgacggctccatgatcttgaagtgcccaccaaaaaaatgtgaatgtatttagtttggatctgttacaaataattggaaattgctatgtcggcctgtaaattaaacactcgccatttgagtactgggatgttcctcccatgctctgtggcggccaataaactcaaattctgaagaactaaacgcgtcgttggtccctaaaaaaagagaaaagaaatagcttaataaataacccccccacctataaggggggatcccagttaccccagaatacgccctaaatcgggaactcctatcaaaccccccc

SEQ ID NO: 28047 - protein, 50 aa, Zea mays
  misc_feature: Ceres CLONE 1401875-F
  misc_feature: SWISSPROT Homolog: EC 3.6.3.4 Copper-exporting ATPase
MAQTVVLKVGMSCEGCVGAVKRVLGKMEGVESYDVYIMEQKVTVKGQCDT

SEQ ID NO: 28048 - DNA, 745 bp, Zea mays
  misc_feature: Ceres CLONE 1401885-F
  misc_feature: Translation starting site: 188
  misc_feature (639)..(639): n is a, c, t, g, unknown, or other
  misc_feature (664)..(664): n is a, c, t, g, unknown, or other
aagctggagctccccgcggtggcggccgctctagaactagtggatcccccgggctgcaggaattcgcacgagaccattacctagaacatcctaatcgaaaaccaccaaattaaaccgccggcgcctccacttcgcgttctcgcctcatctcctcccgctcaggatccggcggcgaaggtaaggcaagatgtacaccgcgaggaagaagatccagaaggataagggccttgagccctccgagttcgaggactccgtcgcccaggctttcttcgacctggagaacggtaaccaggagctcaagagcgacctcaaggacctttacatcaacggtgctatccagctggatgttgccgggagcaggaaggctgttgtgatccacgtcccataccgcttgcgtaaggccttcaggaagatccatgtcaggatcgtcagagagctggagaagaaattcagcggcaaggatgtggtaattgttgccacaagggagatcgtgaggccgcccaagaagggtcagctgttcagcgccctcgcaccaggactctgactgctgtccatgatggcatcctggagggatgtgtcttcccagctgagattgtggggagcgtgtcaggtaccgtctggatggtgccagatcatcangatcttctttgaccaaaggagaggnacacacagaaatacagctggacactacactacggtctacccgcagctgtgtgggaaagaatgtgtctttgagtacctatgc

SEQ ID NO: 28049 - DNA, 639 bp, Zea mays
  misc_feature: Ceres CLONE 1401886-F
  misc_feature: Encodes the peptide sequence at SEQ ID NO. 28050
  misc_feature (428)..(428): n is a, c, t, g, unknown, or other
  misc_feature (435)..(435): n is a, c, t, g, unknown, or other
  misc_feature (514)..(514): n is a, c, t, g, unknown, or other
  misc_feature (563)..(563): n is a, c, t, g, unknown, or other
aaagctggagctccccgcggtggcggccgctctagaactagtggatcccccgggctgcaggaattcgcacgagaccattacctagaacatcctaatcgaaaagaaagtttcgaacaaaagtccacaaatccccttcgccgtctccggcgagccccgcccctcatcgccgccgcgccaaagagacagtgagaggggggatggatcagtccatcagaaccgcatgcgagttcctctcgtcggtgctaaaccacgctgagtcctcgtcccgcgagctcgccgacgccgtctcccaacgccccgtccacctcgagatggcgaggacctcgttcctgcagaagctggagcacagggtggaggcgtcggtcgccgacttgcagcacatcgagtccatcgccctcgacaccgtctcctttcgagagctccctcgncactgcngcgaggcgctcaaagtctacgcgcggcacgccgacgcccctcagtcgcacctcgcttcctttggctacgagccccccgnacgcacacaccccgagatcgatgtggatggtgaaaatgaagatgtcggnaaggttgcgaccctggagaagatgcctccgcgtgcccgttcagtgctcaggtcggaaggcggcggtttgaaaccac

SEQ ID NO: 28050 - protein, 147 aa, Zea mays
  misc_feature: Ceres CLONE 1401886-F
  misc_feature (80)..(80): Xaa is any aa, unknown, or other
  misc_feature (106)..(106): Xaa is any aa, unknown, or other
MDQSIRTACEFLSSVLNHAESSSRELADAVSQRPVHLEMARTSFLQKLEHRVEASVADLQHIESIALDTVSFRELPRHCXEALKVYARHADAPQSHLASFGYEPPXRTHPEIDVDGENEDVGKVATLEKMPPRARSVLRSEGGGLKP

SEQ ID NO: 28051 - DNA, 666 bp, Zea mays
  misc_feature: Ceres CLONE 1401900-F
  misc_feature: Encodes the peptide sequence at SEQ ID NO. 28052
  misc_feature (286)..(286): n is a, c, t, g, unknown, or other
  misc_feature (301)..(301): n is a, c, t, g, unknown, or other
  misc_feature (343)..(343): n is a, c, t, g, unknown, or other
aaagctggagctccccgcggtggcggccgctctagaactagtggatcccccgggctgcaggaattcgcacgagaccattacctagaacatcctaatcgaaaaactggataattcgctcgctccgctcgatgcccgcttgtttgcggtgaagcctccggcgaacagccgtagcggaaacgccgcccgagatgtctgctccctccgccccaccccgcacggtgatctgtgtgggcgacgtccacggctacatcacgaagctggagagcctctggtccaacctccaggnctggcacttccccgncgaacgcctttcgcacgcgctggtcatcttcctcgggatacnacgatgcggcccgaacccgaagggtctcgattccctctcgggttccggaggggtaccccgggagggccaggtttctctggggaaacccgaactccccctcccggggttccccgggggttccccccccccccaaaagttcccctttttggcccctgggggggaatttccccaaaggggacccggggggtgtccccggggcgcttttttaggttttccccccagggagagggggggggggggcctcccgggggggggggcccccaaaaaggggcccccccaaaagggggtctctttttaagggggggcccccttttttatatttg

SEQ ID NO: 28052 - protein, 150 aa, Zea mays
  misc_feature: Ceres CLONE 1401900-F
  misc_feature (33)..(33): Xaa is any aa, unknown, or other
  misc_feature (38)..(38): Xaa is any aa, unknown, or other
  misc_feature (52)..(52): Xaa is any aa, unknown, or other
MSAPSAPPRTVICVGDVHGYITKLESLWSNLQXWHFPXERLSHALVIFLGIXRCGPNPKGLDSLSGSGGVPREGQVSLGKPELPLPGFPGGSPPPQKFPFLAPGGEFPQRGPGGCPRGAFLGFPPRERGGGGLPGGGAPKKGPPQKGVSF

SEQ ID NO: 28053 - DNA, 659 bp, Zea mays
  misc_feature: Ceres CLONE 1401913-F
  misc_feature (659)..(659): n is a, c, t, g, unknown, or other
aagctggagctccccgcggtggcggccgctctatcctagtggatcccccgggctgcaggaattcgcacgagaccattacctagaacatcctaatcgaaaatctctatgacacgtgccccttcccccctcttaagctaagggacccttgggcagcccggcatcttctccaatctccaccctctgcccctctcgatttcttcttcccatctcccgatccatcgcaacccaaaccctactccaggcagatctccgtctccgccgacgctgccggcgtgagcacagcatcagatccgctgtgatggcgttccgccgcatcctatccaccgcggtgcgccgacggtcggccgtggaagccggggagccccccccacgcgcgcgaggggtgggagggcgactatgtatagccagtggtgctcccccccgatgctaccgcccagggcgctcccgtgatgccgaatgaacgcttatccgcggcccgccaccgccagcctacaggggttcgatcaccccaaacccaggtgttgctcggatacagcaagaccggggccgcccaaagaggaaccaattggataatcccttgccccctccccaaggacccggctccaccacacctggccagggggccctggcgcattcgccacgggagagtccttcccatn

SEQ ID NO: 28054 - DNA, 714 bp, Zea mays
  misc_feature: Ceres CLONE 1401920-F
  misc_feature: Encodes the peptide sequence at SEQ ID NO. 28055
  misc_feature (388)..(388): n is a, c, t, g, unknown, or other
caaagctggagctccccgcggtggcggccgctctatatctagtggatcccccgggctgcaggaattcgcacgagaccattacctagaacatcctaatcgaaaaatttcgagtggtcgagtccgtccgtgtctgtcctccgctgtccgctggctgctgctctaacccaatccaaggaggatgccgaggagcccgcagctgagcctgagcggctgcagctctctcttctccctgtccagcaccagtacgagccgcgacagcgccgccctgaaggcgccggtgccagcgccaccggcaggcgcggtgcccccacggcgcacccctctcctgtcgctcagcgtcggcgaggaagaagaggacgagggtgaggacgaggaggagtacctgctngggggccggcgccctggatctgcagctgacggggcccggtgggcgcagcaacagcagcggcggctacgacgaccagcggaagaacatccggatgatgaggaaccagggagtctgcgctgcgctcccagggcaaggaaaagggcctatgggcaggaactgaaaaaaggaggttcctccccctggggaatggaaaaccctcaggcttcaaagagggagggcaaaacaactggaaaacaaaatttgggtggccctgggcccccgcaaaaacccccccccaaaaagcacttcccccaattaaaaaagaaaccccccttcatcccatttta

SEQ ID NO: 28055 - protein, 178 aa, Zea mays
  misc_feature: Ceres CLONE 1401920-F
MPRSPQLSLSGCSSLFSLSSTSTSRDSAALKAPVPAPPAGAVPPRRTPLLSLSVGEEEEDEGEDEEEYLLGGRRPGSAADGARWAQQQQRRLRRPAEEHPDDEEPGSLRCAPRARKRAYGQELKKGGSSPWGMENPQASKREGKTTGKQNLGGPGPPQKPPPKKHFPQLKKKPPFIPF

SEQ ID NO: 28056 - DNA, 735 bp, Zea mays
  misc_feature: Ceres CLONE 1401923-F
  misc_feature: Encodes the peptide sequence at SEQ ID NO. 28057
  misc_feature (489)..(489): n is a, c, t, g, unknown, or other
  misc_feature (582)..(582): n is a, c, t, g, unknown, or other
  misc_feature (649)..(649): n is a, c, t, g, unknown, or other
  misc_feature (675)..(675): n is a, c, t, g, unknown, or other
  misc_feature (676)..(676): n is a, c, t, g, unknown, or other
  misc_feature (713)..(713): n is a, c, t, g, unknown, or other
  misc_feature (719)..(719): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctcggnaaaggggcgaagtgccggcgccagtgcctgcgccgccacgagggcccagccgtgggaaacccaggagggcattgaggcggtgccgccgccgcnggactggccgtcgacatggagccaagagtacggtcgcggcagcgagagcgcggcaagtggccccggnaagaggtgcgagcgcaccaccgcggnngacttgggtgggagaggcagcgctgcctgatgatggnaaaaancccgggagcgggaaaa

SEQ ID NO: 28057 - protein, 163 aa, Zea mays
  misc_feature: Ceres CLONE 1401923-F
  misc_feature (92)..(92): Xaa is any aa, unknown, or other
  misc_feature (123)..(123): Xaa is any aa, unknown, or other
  misc_feature (154)..(154): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSXKGRSAGASACAATRAQPWETQEGIEAVPPPXDWPSTWSQEYGRGSESAASGPGKRCERTTAXDLGGRGSAA

SEQ ID NO: 28058 - DNA, 683 bp, Zea mays
  misc_feature: Ceres CLONE 1401927-F
  misc_feature: Encodes the peptide sequence at SEQ ID NO. 28059
  misc_feature (480)..(480): n is a, c, t, g, unknown, or other
  misc_feature (523)..(523): n is a, c, t, g, unknown, or other
  misc_feature (524)..(524): n is a, c, t, g, unknown, or other
  misc_feature (560)..(560): n is a, c, t, g, unknown, or other
  misc_feature (610)..(610): n is a, c, t, g, unknown, or other
gctctataactagtggatcccccgggctgcaggaattcgcacgagaccattacctagaacatcctaatcgaaaagtccacctcagctcccatatccgctcccctacctctccagcatctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcgccctcaaggactcgaagacgcttctcttcggcgagaagccggtcaccgtctttggcatcaggaaccccgaggagatcccgtggggtgaggctggtgctgagtatgtcgtggagtccaccggtgtcttcactgacnagggacaggctgctgcacatctgaagggtggtgcccagaaggnntgtatctctgccccaagcaagatgcacccatgtttnggtgtgggtgtcatgaggaccagtacacctccgatgtaacatttgttccnatgctagctgcaccacaaactgccttgctccccttgctaggccattcatgaacactttggcattattggaggt

SEQ ID NO: 28059 - protein, 145 aa, Zea mays
  misc_feature: Ceres CLONE 1401927-F
  misc_feature (4)..(132): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (107)..(107): Xaa is any aa, unknown, or other
  misc_feature (121)..(121): Xaa is any aa, unknown, or other
  misc_feature (133)..(133): Xaa is any aa, unknown, or other
MGKIKIGINGFGRIGRLVARVALQSEDVELVAVNDPFITTDYMTYMFKYDTVHGQWKHSDIALKDSKTLLFGEKPVTVFGIRNPEEIPWGEAGAEYVVESTGVFTDXGQAAAHLKGGAQKXCISAPSKMHPCXGVGVMRTSTPPM

SEQ ID NO: 28060 - DNA, 630 bp, Zea mays
  misc_feature: Ceres CLONE 1401929-F
tggagctccccgcggtggcggccgctctagaactagtggatcccccgggctgcaggaattcgcacgagaccattacctagaacatcctaatcgaaaactagtttcatttcctcctgttccagccgctcacccaagaaccggtcgtcaggagcttgggccgaccgagctattctattctccttgttccttttggccgttcgcccctttactccttctttgtttctttgtttctttttttttcctttcttgcatctggccgctagttactctttctctctttctgtttttttttgttctagcagctggccgctagtttctcttggctgacctctcttttctctctttttttttcgaaatctgttccggtttctgttcgtgtgcttagggttcacagaaccctaaactgttcttagttttcttatacctgatctgatcggttgtagtgatttctggcgagctctcagggataaaatccctttcattattttactgtttttttttaaaaaaatgaactcggttcatcagggtttctggaactcgaatcgagttggggattctgtactaactcgtactccgagatcctcctttctgtttggaactacaggagaaacgacccccttctcaattcgg

SEQ ID NO: 28061 - DNA, 714 bp, Zea mays
  misc_feature: Ceres CLONE 1401932-F
  misc_feature: Encodes the peptide sequence at SEQ ID NO. 28062
  misc_feature (258)..(258): n is a, c, t, g, unknown, or other
  misc_feature (395)..(395): n is a, c, t, g, unknown, or other
aaagctggagctccccgcggtggcggccgctctagaactagtggatcccccgggctgcaggaattcgcacgagaccattacctagaacatcctaatcgaaaacttccgaaatctcgtgcggcggccggcaagttcgcacttcgcagcgcattcaccaccagcttcactcccaactaccgctgatctcactcacgctcaccccagccggccagccccgtccccatccggctagaggttcacatcacctgcgtgacgatnaacatcctcttccaaatcgtagtctagcccgtgcccaaaaccctagcgaccgccggagagctcgtccgaatcgaggccaccgaggggaaattagatcgcggcggacgatggagagccctgcgaaagaggaggccggnggagagctggcaatggagatcgagtcgtcggtcacggcggaggactggcgccgcgcgctttctcgcgtcgtgccgtccgtcgtcgtcctccgaccactgggcgcgcgcgctttgacacgaggtcgcggcggcagctacgccacgggtttcgtcgttgacaggtcccgcggattatcctccactaacggcatgtcgtcaagccggaacctggggtccgggagccaatgtccggaacaaggaaaaaaatccctggggaccccgggaacgaaaacccgaaacggattttgggttttttcccaagggaccaggggccataaat

SEQ ID NO: 28062 - protein, 116 aa, Zea mays
  misc_feature: Ceres CLONE 1401932-F
MESPAKEEAGGELAMEIESSVTAEDWRRALSRVVPSVVVLRPLGARALTRGRGGSYATGFVVDRSRGLSSTNGMSSSRNLGSGSQCPEQGKKSLGTPGTKTRNGFWVFSQGTRGHK

SEQ ID NO: 28063 - DNA, 645 bp, Zea mays
  misc_feature: Ceres CLONE 1401935-F
  misc_feature: Encodes the peptide sequence at SEQ ID NO. 28064
aagctggagctccccgcggtggcggccgctctataactagtggatcccccgggctgcaggaattcgcacgagaccattacctagaacatcctaatcgaaaaataaataacacacaaaggtgtccgatcatagtttgagcgttgacaatgtctgccactatcaacgcagttcacaatgaccacacctctcgctacgagctacttctttgcactcctatgtaactagctacaagtacgcgacgagaactacacgttcgtgaaggatccgacgactggccaccagtgtgtcgtactacgactacatcatcgtggtggccgacaaggtcgtctgccagatggacgacacgatgtcggagcgcttccgtgcgctgctggtggagcgcggggcctcgccttacgacgacgacgcatccttgacatggaccggtttctcggacactctgttgcacacctccctggtctcgtcccgcgcagtgcttcatgatgcacgacggggtcatcaactccccgccgcggatgatgaagggcgggaagcttcatttgcgcccgctatctacacggttccctatgactactaattatgtgggggtggggtggctaccagagggccctccggaaggggggtaccgctttattcgccgatggg

SEQ ID NO: 28064 - protein, 80 aa, Zea mays
  misc_feature: Ceres CLONE 1401935-F
MDDTMSERFRALLVERGASPYDDDASLTWTGFSDTLLHTSLVSSRAVLHDARRGHQLPAADDEGREASFAPAIYTVPYDY

SEQ ID NO: 28065 - DNA, 730 bp, Zea mays
  misc_feature: Ceres CLONE 1401938-F
  misc_feature: Encodes the peptide sequence at SEQ ID NO. 28066
  misc_feature (691)..(691): n is a, c, t, g, unknown, or other
  misc_feature (692)..(692): n is a, c, t, g, unknown, or other
  misc_feature (728)..(728): n is a, c, t, g, unknown, or other
aagctggagctccaccgcggtggcggccgctctttactagtggatcccccgggctgcaggaattcgcacgagaccattacctagaacatcctaatcgaaaaatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaataaggcgcccaaggagaagaaggcgcctaaggagaagaagctttccgcggcgaataagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgagggtgaagaactccttcaagctgccggccaccgacgccaagcccatagccgacaagctctaggcacccaaggccgcgcccaagcccaagccctcgccgaaaggcgaggctcagaccgctgcgaagcccaaggcgtcgtcgcccatacccaggtcaggnncagggccagtctgtcgctcctgccgcgcgtcgcccnaa

SEQ ID NO: 28066 - protein, 134 aa, Zea mays
  misc_feature: Ceres CLONE 1401938-F
  misc_feature (54)..(124): Pfam Name: Linker_histone Pfam Description: linker histone H1 and H5 family
MSTEEAVVAEVPVTEVPAEVPAAQVAEAPKANKAPKEKKAPKEKKLSAANKPAAHPPYAEMIVEAIAALKERKGSSSVAISKYVEGKHGGKLPTNFRKQLTVQLKKLAAAGKLTRVKNSFKLPATDAKPIADKL

SEQ ID NO: 28067 - DNA, 635 bp, Zea mays
  misc_feature: Ceres CLONE 1401939-F
  misc_feature: Encodes the peptide sequence at SEQ ID NO. 28068
  misc_feature (271)..(271): n is a, c, t, g, unknown, or other
  misc_feature (301)..(301): n is a, c, t, g, unknown, or other
  misc_feature (308)..(308): n is a, c, t, g, unknown, or other
  misc_feature (334)..(334): n is a, c, t, g, unknown, or other
  misc_feature (451)..(451): n is a, c, t, g, unknown, or other
cgctcttaactagtggatcccccgggctgcaggaattcgcacgagaccattacctagaacatcctaatcgaaaaacactgggtgaccatcatcatcagtaactaataattactttagattagaagcaaagggaagcgaagcaagaatcgatcgagtcgagaagatggtgcagttcggcaagtggctgaggaggcagatcgagcggagcctcccggagtggcaggaccagttcctgcgctacaaggagctgaagcggtgcgtcaaggcccgnctccggcggctgccccgccgttgcccgcgnaggaggncgagttcgtggccgagatcgacgcgnagaccgagaaagatcacgcctttctcccctcgacaggaggaggagtttcatcatccgccaccgggagctggcgaaccacaatcgcagcggcccctggggcccgcggaagagcccggnccccgggccccggggctttaaaaaaggggccgaagggccccccccccctccccgggggggagaattccacatttttccccgggggggggggggggggttcccccccaacccggggggttccaaaaaattgtggggggcatttttaggagggccctccctcccccaaaaggatttgtgggggggg

SEQ ID NO: 28068 - protein, 102 aa, Zea mays
  misc_feature: Ceres CLONE 1401939-F
  misc_feature (49)..(49): Xaa is any aa, unknown, or other
MVQFGKWLRRQIERSLPEWQDQFLRYKELKRCVKARLRRLPRRCPRRRXSSWPRSTRRPRKITPFSPRQEEEFHHPPPGAGEPQSQRPLGPAEEPGPRAPGL

SEQ ID NO: 28069 - DNA, 639 bp, Zea mays
  misc_feature: Ceres CLONE 1401940-F
aagctggagctccccgcggtggcggccgctctagtatactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcaggcggccgggacagctgactagctgagaggcatggggatggacgccggccgcccccaagctgccggacagctacccccggccatcaggacggcgggaagctggtgaaaagcgtcagccgcgtggagccgcgcaggttcggcctggccctcgtggcggccttcctcgtcgtcacctgcgcctacttctccaccgccaagttcgaagccatccagatcgccatgaccagccgaccccgcctccaccaatgcggcctggcgtccgaagccgcttccttgggaagggggtggccgccgccgccgaaacctccaaagccctcag

SEQ ID NO: 28070 - DNA, 735 bp, Zea mays
  misc_feature: Ceres CLONE 1401941-F
  misc_feature: Encodes the peptide sequence at SEQ ID NO. 28071
aaagctggagctccccgcggtggcggccgctctagaactagtggatcccccgggctgcaggaattcgcacgagaccattacctagaacatcctaatcgaaaaccgaggaaggaaccctagcctagccttgctccgaccggtcgccgcggcgactgcgacgatgatggactgcgctggaggccgagaccccgtggaggacttcctcctcggcggcgccggcgacgacggagatctcgtcgccgtcttctgcgacgacggaggacttgggattgagggtatccatggagatgcttgtggatttgagcaatctaatttggggaaaaggggtagagatgaaccatgttcatctggcccaacatccaaagcttgtcgtgaaaaaatgaggagggacaagctgaatgacaggttcctggaattaagttcagttatgagtcctggtaaggaagcaaagttagataaagtaaatatattgagtgatgcagcccgtatggtggcacaacttagaggtgaggcagaaaagcttaaggaatcaaatgagaagctgcgggagaatatcaaggatctgaaggaggagaagaacgagctccgtgaagagaaagtgagactaaaggtagaaaaggataggctggagcagcaagtcaaagctatgagtgtagctcctacaggatatgtaccccatctccctcatccagcttcataccatcctgctgcgttcactccatttgcgccgcctcc

SEQ ID NO: 28071 - protein, 191 aa, Zea mays
  misc_feature: Ceres CLONE 1401941-F
  misc_feature (64)..(115): Pfam Name: HLH Pfam Description: Helix-loop-helix DNA-binding domain
MMDCAGGRDPVEDFLLGGAGDDGDLVAVFCDDGGLGIEGIHGDACGFEQSNLGKRGRDEPCSSGPTSKACREKMRRDKLNDRFLELSSVMSPGKEAKLDKVNILSDAARMVAQLRGEAEKLKESNEKLRENIKDLKEEKNELREEKVRLKVEKDRLEQQVKAMSVAPTGYVPHLPHPASYHPAAFTPFAPP

SEQ ID NO: 28072 - DNA, 636 bp, Zea mays
  misc_feature: Ceres CLONE 1401942-F
  misc_feature: Encodes the peptide sequence at SEQ ID NO. 28073
  misc_feature (339)..(339): n is a, c, t, g, unknown, or other
  misc_feature (512)..(512): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
tggagctccccgcggtggcggccgctctagaactagtggatcccccgggctgcaggaattcgcacgagaccattacctagaacatcctaatcgaaaaagccagatccctcctattcccccacttcactcccaatccgaatccagatccgcgaatgctggggcgggcggcggcactgtccgcgccacggtggcgcggcggggtgccagaccttcgcgccgcgctgcggtcggggggcaacctcctcttcgcgctcttcgtggcggccgtgctcgcattcacgctcctcgcggcgttccacagccccgacgatccgctcctccacccgtcctctcaccagntcaccgatttcctcacctccgccacttccacctccaccttcctcactgacgactccgtgctgcgcaccggggaggacttcaactcctcgtccaccggcgccgccggcgaggtcgccgctgggggtgtcgaagtcgtcgcggaggccgtcccgttcatcaagctctcccgaagntgccgccgaggccgagaagacggagcccgagacggagcgggccgtcaccgtcgacactgatgcggccacgggcgagggtgacccnnngggcggaaagaaaccccccgttcccgagggcgtttcc

SEQ ID NO: 28073 - protein, 139 aa, Zea mays
  misc_feature: Ceres CLONE 1401942-F
  misc_feature (63)..(63): Xaa is any aa, unknown, or other
  misc_feature (120)..(120): Xaa is any aa, unknown, or other
MLGRAAALSAPRWRGGVPDLRAALRSGGNLLFALFVAAVLAFTLLAAFHSPDDPLLHPSSHQXTDFLTSATSTSTFLTDDSVLRTGEDFNSSSTGAAGEVAAGGVEVVAEAVPFIKLSRXCRRGREDGARDGAGRHRRH

SEQ ID NO: 28074 - DNA, 690 bp, Zea mays
  misc_feature: Ceres CLONE 1401947-F
  misc_feature: Encodes the peptide sequence at SEQ ID NO. 28075
  misc_feature (516)..(516): n is a, c, t, g, unknown, or other
  misc_feature (566)..(566): n is a, c, t, g, unknown, or other
  misc_feature (637)..(637): n is a, c, t, g, unknown, or other
aagctggagctcaccgcggtggcggccgctctatcctagtggatcccccgggctgcaggaattcgcacgagaccattacctagaatatcctaatcgaaaaatcgcaagaaaaaggaaatcaaaacaaagtaaagtggggggaaaagcatggcgatagctcttctcccatccgttcgtcttcttccacaaagtctctccagaaggccaccaccaacctcgtcgccattatccgttcgccgcccacggccaagagcccttcccctccctcgcgtccactgccgcgccggccggaccccggaccccctcaccgctgctagggaggctgctgccttttgggctgggaagctcgccggcgctgtgccatggaaggccgcggtctccggcgtggtcgccctcgccgtctccttcacctgccttgttggtttggccaatgccagaactggggtaaacaaaccagaattgcttcctaaagaatttactaccgtcatcgatgttgctggttttctctcgtcaggncaggaaaaccgtttgcgccaagagatagagacctggagaaagatacaggntacaaactgcgagttcttgcacaaaatatcctgatacacctggattggctatcaaagattttttggcaggntgatgagcggactattgttttttgttggctgatccaaccttttggaaacataa

SEQ ID NO: 28075 - protein, 150 aa, Zea mays
  misc_feature: Ceres CLONE 1401947-F
  misc_feature (140)..(140): Xaa is any aa, unknown, or other
MAIALLPSVRLLPQSLSRRPPPTSSPLSVRRPRPRALPLPRVHCRAGRTPDPLTAAREAAAFWAGKLAGAVPWKAAVSGVVALAVSFTCLVGLANARTGVNKPELLPKEFTTVIDVAGFLSSGQENRLRQEIETWRKIQXTNCEFLHKIS

SEQ ID NO: 28076 - DNA, 732 bp, Zea mays
  misc_feature: Ceres CLONE 1401950-F
  misc_feature: Encodes the peptide sequence at SEQ ID NO. 28077
  misc_feature (495)..(495): n is a, c, t, g, unknown, or other
  misc_feature (646)..(646): n is a, c, t, g, unknown, or other
tcaccgcggtggcggccgctctagaactagtggatcccccgggctgcaggaattcgcacgagaccattacctagaacatcctaatcgaaaagacgacactgcacacctctcaccagtccccacacggccacaccacacccagctgtccccatcgcgcgcacactctctcggtctctccctcccagtcccagcgtttgcggtccagtccagagagctcgagcagccatggcggctcccctgttcctcctcctcctgctgctggctatgttcacaggctcagcagacgcggcgttctgcgtgtgcaagacgggcgtgcccgaccaggcgatgcaggcggcgatcgactacgcctgcgccaagggggccgactgcgcctccgcctccaagggcgcgccctgctacggcaacggcaacaaggtggccgtctgctcctacatctgcaacagctactaccagagccgcagcgccacgggcgccacctgcgacttcaacggngtcgccacgctcaccggcaccgaccccagctccggcacctgcaagttcgcctccggccccagcagcgcaggcaccggcggtggcatgggcgctgccgcggttaccggcggtgccatggccgctggcaccggtcgccgggacaggggttgtnaccgggaccagcaccggcatggccaccgggaagggaaatcaacaccgccaaggtactcggcgcaagggacgcgatccccgggaaca

SEQ ID NO: 28077 - protein, 169 aa, Zea mays
  misc_feature: Ceres CLONE 1401950-F
  misc_feature (22)..(106): Pfam Name: X8 Pfam Description: X8 domain
  misc_feature: SWISSPROT Homolog: EC 3.2.1.39 Glucan endo-1,3-beta-D-glucosidase
  misc_feature (141)..(141): Xaa is any aa, unknown, or other
MAAPLFLLLLLLAMFTGSADAAFCVCKTGVPDQAMQAAIDYACAKGADCASASKGAPCYGNGNKVAVCSYICNSYYQSRSATGATCDFNGVATLTGTDPSSGTCKFASGPSSAGTGGGMGAAAVTGGAMAAGTGRRDRGCXRDQHRHGHREGKSTPPRYSAQGTRSPGT

SEQ ID NO: 28078 - DNA, 670 bp, Zea mays
  misc_feature: Ceres CLONE 1401954-F
  misc_feature: Encodes the peptide sequence at SEQ ID NO. 28079
  misc_feature (387)..(387): n is a, c, t, g, unknown, or other
  misc_feature (388)..(388): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (447)..(447): n is a, c, t, g, unknown, or other
aagctggagctccccgcggtggcggccgctctagaactagtggatcccccgggctgcaggaattcgcacgagaccattacctagaacatcctaatcgaaaaactcgacaggctcggtttccgccctcctctcccaccgccgcgcaccgagaagatggggaagcggtggatcccgctggaggccaacccggacgtcctgaaccagttcatatgggggctgggagtccacgaggaggatgtgcagttctgcgacgtctacggccttgacgatgagctgctcgctatggtgccccagcccgttctcgccgtcctcttcctctacccgctcacctccctggacgaggagaaagaagaatcaagttgtttctgctggcacatcgaacctcannggnnnagggaattgtgcccaaaaaaagttttttttttttaaaaaaaaaaatttgttttntaaatgtttggggaaaaaggggggtttttttgaaaaaaagaagccccccccccccccgcgtgggggggggggccttttttttggggttttcataaaacacgggggttgggtgccccccccggggggggtgcttttttttggggggggaggggggggggggaggaaaatttttttttttctcttttttggggggggaaaaaaaaaaaagtggggagataaaaaa

SEQ ID NO: 28079 - protein, 91 aa, Zea mays
  misc_feature: Ceres CLONE 1401954-F
  misc_feature (4)..(89): Pfam Name: Peptidase_C12 Pfam Description: Ubiquitin carboxyl-terminal hydrolase, family 1
  misc_feature: SWISSPROT Homolog: EC 3.4.19.12 Ubiquitinyl hydrolase 1
  misc_feature (78)..(78): Xaa is any aa, unknown, or other
  misc_feature (79)..(79): Xaa is any aa, unknown, or other
  misc_feature (80)..(80): Xaa is any aa, unknown, or other
MGKRWIPLEANPDVLNQFIWGLGVHEEDVQFCDVYGLDDELLAMVPQPVLAVLFLYPLTSLDEEKEESSCFCWHIEPXXXRELCPKKVFFF

SEQ ID NO: 28080 - DNA, 713 bp, Zea mays
  misc_feature: Ceres CLONE 1401955-F
ggagctccccgcggtggcggccgctctagaactagtggatcccccgggctgcaggaattcgcacgagaccattacctagaacatcctaatcgaaaactagttcccatccattggtgtggacgtgtcacgtgtggtggttgcgttgcggggccccgatttcgagcgggtgttcaattttggtgccggatttttaaggaggatccaatttaggaagaattttggttttggggacaatggttttggactgcctgatattcgattcataggttggtcaaacgctttggagtagagaatttttttcccggaaaagaagagccatttttctagttgtgctactcgtcaatcaatccagtgaagctgaactctggaagaagaaactttcctaattagacccggtatttcgtggttggccgttggcgtctaaagtctaatttatttgtcgcgttttagtttaaaaatgaacatatttttctgtttactccgcccaaaatctttccgctggatctacttgtgaatcgggtttgtttgttttttatctgagctattcttgttgatttaggatttcgattcggcagatccaagggaacgccgaattttgcctgatttcttcgcaatttttggtccgatcaagaggctccaagccttttttttttcactcgcgagaagcaagggggctcccttttcttctttcgccatgtccatggcgttgagcc

SEQ ID NO: 28081 - DNA, 754 bp, Zea mays
  misc_feature: Ceres CLONE 1401958-F
  misc_feature: Encodes the peptide sequence at SEQ ID NO. 28082
gctcaatactaaaggatcccccgggctgcaggaattcccacgagaccattacctagaacaccctaatcgaaaaaccgcatcccacaacttttgagctcatcttatctcctctccagctcctatcgtagtcgtgaccagagcgcgagagctagctagaggaccgtgaaaatgccgatcaataggatcgccctgcggagccaccacgaggtgtaccacccgggcgccctcaaggaggcgttcgctgatttcatctccaccctcatcttcttcttcttcggccagcgctccggcatggtcttcagcaagctgaccggcggcggcccgacgaccacttttgtcctgatcaccgcggcggtggcgcacgcgttcgcgctgttcgtggcggcgtctgtgggggggaacatctcccgcagggacgtgaaccctgccgtgaccttctgcggcttcttggggggcgacatcaccatgttcccgcggggtccctgttctggcttggcggcagttggttggtgtccccccgcggcggtgctttcctggctcccccttctcctacggatcggttaaaggcctccggcccacccttcctccctgaaccccccgtgtactgaccgtggtgaaggcacctggctggctggtagaacgccgaaggaccctcctctaattgggtgagcacccttgaacgccccccttgggggtgtgacccaccataaagggggtggcttggtggaacctattcgccccccttttttgtttg

SEQ ID NO: 28082 - protein, 131 aa, Zea mays
  misc_feature: Ceres CLONE 1401958-F
MPINRIALRSHHEVYHPGALKEAFADFISTLIFFFFGQRSGMVFSKLTGGGPTTTFVLITAAVAHAFALFVAASVGGNISRRDVNPAVTFCGFLGGDITMFPRGPCSGLAAVGWCPPAAVLSWLPLLLRIG

SEQ ID NO: 28083 - DNA, 727 bp, Zea mays
  misc_feature: Ceres CLONE 1401958-R
  misc_feature: Translation starting site: 126
tcgaggtcgacggtatcgataagcttttttttttttttttttacacaagaaaacgggtccggaattcgcggttactagcttctcaaccttacggcgacgactgctgatccaaggaaaagcatacgatgccagcggcgccggctcagcagcggcctgagacagtcgactatgcatgcacgtgcacgagagaaactaaccggcggcgagcggagagagagagctggatgctctagttgcgctgcgcacccctaggtcggtcggcttcggcttttagaagtctgtggaagggagctgctcgtgggtgtgggagaagaacatcagatcgtacatgacgccggagaaggagatgacaaaaaagggcccaatccaatacaccaactggtagccccccccccggtgctgacagggggggtcccaaacgacattcggggcttctggacgcagcctaccagggccctgccccccggaagtttttccctcccgatgaaaccaaagctatgggggcccaatggagccctactttccccttatttcgggaccacccctgtggtgcacaccaggggttcttttccctgaaggtaaatcctgtctccaaccaagttatttccccaacgagaaagcctgttttatccacaaatgcccctcggtttttctccccccctctataaacgttaaagggagcctctcctagagggggactcccttggtggggcggccccctttactg

SEQ ID NO: 28084 - DNA, 635 bp, Zea mays
  misc_feature: Ceres CLONE 1401962-F
  misc_feature: Encodes the peptide sequence at SEQ ID NO. 28085
  misc_feature (377)..(377): n is a, c, t, g, unknown, or other
  misc_feature (462)..(462): n is a, c, t, g, unknown, or other
aagctggagctccccgcggtggcggccgctctagaactagtggatcccccgggctgcaggaattcgcacgagaccattacctagaacatcctaatcaaaaacccgtatccccaattctaaatcgagtcttttcaactattgccgtgcgtgcgtgtctgatacaaccacccaaagatcccactccccgcccgccaccgccgggtctctctaagtctttgccgggatgtcgctcctttcgagcgagcggcagataatgcataactcttatacaatacgatcccggatgactaggagagacgacgtctctccgagtccgatatgtgcgacatccagaaggtcgagcgagaggaaagcctcaataataagtctcttgtgcncttgccgccggcggggccgtgccgccgatgggccactccaccgactccagcagaagctcgatggcttgccggcgatggtacaggncgttcactccaacgaccccactgtgcagcttgagcccacaacgcagttcaggaagctgctctccatagagcgtagtccccaaattgaagaagtgatcagcacaggagtcgtgcccgaattcattgagttccttacacgtgaggacatccacaactccagtttgaggctgcatg

SEQ ID NO: 28085 - protein, 61 aa, Zea mays
  misc_feature: Ceres CLONE 1401962-F
  misc_feature (4)..(4): Xaa is any aa, unknown, or other
MVQXVHSNDPTVQLEPTTQFRKLLSIERSPQIEEVISTGVVPEFIEFLTREDIHNSSLRLH

SEQ ID NO: 28086 - DNA, 657 bp, Zea mays
  misc_feature: Ceres CLONE 1401969-F
  misc_feature: Encodes the peptide sequence at SEQ ID NO. 28087
  misc_feature (327)..(327): n is a, c, t, g, unknown, or other
  misc_feature (331)..(331): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (348)..(348): n is a, c, t, g, unknown, or other
  misc_feature (408)..(408): n is a, c, t, g, unknown, or other
  misc_feature (418)..(418): n is a, c, t, g, unknown, or other
aagctggagctccccgcggtggcggccgctctagaactagtggatcccccgggctgcaggaattcgcacgagaccattacctagaacatcctaatcgaaaagtttaggttgtataaaacaaaacactgacactcttttatattttgaatataaggcaaaaattctgggccggccactgcccagatcccgccgacattctccaaaccaaccgtggcggcgatggaggaaggcgggggtgacctccgcctccagcggtggaggagaaggatggccgtgcggtggtggcctcaacctcggtgtgaagctgaacgtgctgctactgctggntggngnnnnncaaccatctgnggcccctgaactaccttttatccccccccccccggggagggggggggtcttttaaaaaanaaatttgccntcacctaagatcagctaatgatgtggtaggtggaaagctccccctccttttatgacaccccaacccacagccgaaagccgccccccccccggccgagaggcccatcgcacaaagcccctccaccacattgggtccctcccacggccgcggcgggttcctccccacgccccccccacatagaaagaccccacccaacaaccgggattaggccctggccacgcccgcccccgcgccccggg

SEQ ID NO: 28087 - protein, 45 aa, Zea mays
  misc_feature: Ceres CLONE 1401969-F
  misc_feature (38)..(38): Xaa is any aa, unknown, or other
  misc_feature (39)..(39): Xaa is any aa, unknown, or other
  misc_feature (40)..(40): Xaa is any aa, unknown, or other
  misc_feature (43)..(43): Xaa is any aa, unknown, or other
MEEGGGDLRLQRWRRRMAVRWWPQPRCEAERAATAGWXXXTIXGP

SEQ ID NO: 28088 - DNA, 615 bp, Zea mays
  misc_feature: Ceres CLONE 1401975-F
  misc_feature: Encodes the peptide sequence at SEQ ID NO. 28089
  misc_feature (99)..(99): n is a, c, t, g, unknown, or other
  misc_feature (178)..(178): n is a, c, t, g, unknown, or other
  misc_feature (226)..(226): n is a, c, t, g, unknown, or other
  misc_feature (276)..(276): n is a, c, t, g, unknown, or other
  misc_feature (279)..(279): n is a, c, t, g, unknown, or other
  misc_feature (285)..(285): n is a, c, t, g, unknown, or other
  misc_feature (288)..(288): n is a, c, t, g, unknown, or other
  misc_feature (290)..(290): n is a, c, t, g, unknown, or other
  misc_feature (291)..(291): n is a, c, t, g, unknown, or other
  misc_feature (311)..(311): n is a, c, t, g, unknown, or other
  misc_feature (312)..(312): n is a, c, t, g, unknown, or other
  misc_feature (322)..(322): n is a, c, t, g, unknown, or other
  misc_feature (323)..(323): n is a, c, t, g, unknown, or other
  misc_feature (339)..(339): n is a, c, t, g, unknown, or other
  misc_feature (398)..(398): n is a, c, t, g, unknown, or other
  misc_feature (491)..(491): n is a, c, t, g, unknown, or other
aagctggagctccccgcggtggcggccgctctagaatagtggatcccccgggctgcaggaattcgcacgagaccattacctagaacatcctaatcgaanaagatccattgttcacgacctcaccctattcagatcccaagcggccacgcccaagcccaaaccctacccacccatctcnaccagcgatgatggcagcggagccctccgccgtcgttccctcccacgncgctgaagactggaaaccctcgccctcgactcatcctcttcgtccggcgncgntacggnctncnngctcgacccccttcttcggnncactactccnncggacgccgcgggagngacgacccttcgtcatcgacgcttcctcgacggagacgacttccccgcccggccccaangggccccggccgccgccccgccgggtttgggatagcggggtccccgtgggtccccaagacacccgaatccattccaagaagacgcgagctaanggggggggggggttgttcggggggtaccccggaaaccgggagttatttttttttactcctccccccccgtttgggggggggggggggggaaaatccaggggggggggctttcccggggaggggg

SEQ ID NO: 28089 - protein, 143 aa, Zea mays
  misc_feature: Ceres CLONE 1401975-F
  misc_feature (14)..(14): Xaa is any aa, unknown, or other
  misc_feature (31)..(31): Xaa is any aa, unknown, or other
  misc_feature (32)..(32): Xaa is any aa, unknown, or other
  misc_feature (34)..(34): Xaa is any aa, unknown, or other
  misc_feature (35)..(35): Xaa is any aa, unknown, or other
  misc_feature (36)..(36): Xaa is any aa, unknown, or other
  misc_feature (43)..(43): Xaa is any aa, unknown, or other
  misc_feature (46)..(46): Xaa is any aa, unknown, or other
  misc_feature (52)..(52): Xaa is any aa, unknown, or other
  misc_feature (71)..(71): Xaa is any aa, unknown, or other
  misc_feature (102)..(102): Xaa is any aa, unknown, or other
MMAAEPSAVVPSHXAEDWKPSPSTHPLRPAXXRXXXSTPFFGXLLXRTPREXRPFVIDASSTETTSPPGPXGPRPPPRRVWDSGVPVGPQDTRIHSKKTRAXGGGGLFGGYPGNRELFFFTPPPPFGGGGGGKSRGGGFPGEG

SEQ ID NO: 28090 - DNA, 656 bp, Zea mays
  misc_feature: Ceres CLONE 1401977-F
  misc_feature: Encodes the peptide sequence at SEQ ID NO. 28091
  misc_feature (232)..(232): n is a, c, t, g, unknown, or other
  misc_feature (253)..(253): n is a, c, t, g, unknown, or other
  misc_feature (302)..(302): n is a, c, t, g, unknown, or other
  misc_feature (421)..(421): n is a, c, t, g, unknown, or other
  misc_feature (422)..(422): n is a, c, t, g, unknown, or other
  misc_feature (559)..(559): n is a, c, t, g, unknown, or other
aaagctggagctccccgcggtggcggccgctctagaactagtggatcccccgggctgcaggaattcgcacgagaccattacctagaacatcctaatctaaaaatccaacgacccacactgagacgtcccctccccgctccgtcctctctcctctgccgccgagacgacgcgatggcggggtccgccgccttgccgccgctcgccgccttcgcgtcgctccttaccgcgcggngcttcgccgccgccgggtccnggctccggtccctgctcgcgccgcgcctgctggcgggggcgttcccggncctccccgcctcggccgtcccgggcggggcgccgccgcccgccggggcggcgttccccgtcgtggccctccgcgggggggggggggggggctctccgtgccccgcggcgttcgccccgnncccccggggggcgtgcgctcccccgtctgtggccggtggcgctgtgtgggcccccccccccccgtgccgcgcgggcgggtcccccgcgggcccgccggggcccgccggcgggtgggcgtgcccgctcccgcccgggnccccggctgcgctgtggctccgcccgccggccccttgtctgccgcgttcggccgctcgccggttgcgcgtcccccgttcggcccgccgcctcgtgtt

SEQ ID NO: 28091 - protein, 161 aa, Zea mays
  misc_feature: Ceres CLONE 1401977-F
  misc_feature (21)..(21): Xaa is any aa, unknown, or other
  misc_feature (28)..(28): Xaa is any aa, unknown, or other
  misc_feature (44)..(44): Xaa is any aa, unknown, or other
  misc_feature (84)..(84): Xaa is any aa, unknown, or other
  misc_feature (130)..(130): Xaa is any aa, unknown, or other
MAGSAALPPLAAFASLLTARXFAAAGSXLRSLLAPRLLAGAFPXLPASAVPGGAPPPAGAAFPVVALRGGGGGGSPCPAAFAPXPRGACAPPSVAGGAVWAPPPPCRAGGSPAGPPGPAGGWACPLPPGXPAALWLRPPAPCLPRSAARRLRVPRSARRLV

SEQ ID NO: 28092 - DNA, 646 bp, Zea mays
  misc_feature: Ceres CLONE 1401982-F
  misc_feature: Translation starting site: 529
  misc_feature (467)..(467): n is a, c, t, g, unknown, or other
  misc_feature (564)..(564): n is a, c, t, g, unknown, or other
  misc_feature (565)..(565): n is a, c, t, g, unknown, or other
  misc_feature (577)..(577): n is a, c, t, g, unknown, or other
  misc_feature (587)..(587): n is a, c, t, g, unknown, or other
  misc_feature (606)..(606): n is a, c, t, g, unknown, or other
  misc_feature (624)..(624): n is a, c, t, g, unknown, or other
  misc_feature (639)..(639): n is a, c, t, g, unknown, or other
aaagctggagctccccgcggtggcggccgctctagaactagtggatcccccgggctgcaggaattcgcacgagaccattacctagaacatcctaatcaaaaaactctcgctttcttctgtctcgcctcgccctcgcctttgttgatcttttcctttctcgcgttcccctcgccttcctcttcctcccccacacccaccggtcgccgcccccgtcgccccggcctcctcggtccagagacgagggggtccgcgccgttccgacgccacaccgcaaccgcatcacatcaccgcctgctcccaccgtccatccgccctccctcgatcgcgctccccggatcgctggtacctccgcgcgcggctccgacctcatcttcctccatcgactggcatcgggcagcggcggcgtgttcccgggcaacccttcgaaagggtaatcaatcgccagacttttgggaagctgtgtgggnggggacccgggggggaagagccaagttactgcagagctaaccattttcggtttgtcgagtgatggcgcaaggcatcaacttccctgacttcatcggnngccgtgggtggncatggatggnggcgtggaactttggtggnaaacttctgtgacatggnccttctaccagaagnctagggg

SEQ ID NO: 28093 - DNA, 662 bp, Zea mays
  misc_feature: Ceres CLONE 1401987-F
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (558)..(558): n is a, c, t, g, unknown, or other
  misc_feature (563)..(563): n is a, c, t, g, unknown, or other
  misc_feature (622)..(622): n is a, c, t, g, unknown, or other
  misc_feature (623)..(623): n is a, c, t, g, unknown, or other
  misc_feature (662)..(662): n is a, c, t, g, unknown, or other
aaagctggagctccccgcggtggcggccgctctagaactagtggatcccccgggctgcaggaattcgcacgagaccattacctagaacatcctaatcgaaaaagaaaaatggttctttcttagtgtgacacggacacacttgctcgtccacatcccttcctccagccaccgacctcccaaggatgcgctcttgccgccggcctcccaaggatgcgctcttgccgcccctcttctcgcgccgccgctgccatcgccatgtcgaagcgcgctacgtacgctccgtcctccattcgctcccgacgatccgactcgttcgtttgttgctcctttcgcttactgccagacctagccggcttctgcgttgaaatggatgaaaactgccgcggtctcatacatttttctgggatccagaaattcgggacattgtgatcttctcggccccccaggacttccagccttgattttcgagccctgggtgcttgagtacatgtccaaatggaagcttggagatgctcttgcactctggagacagagnnncacatgggggttccaattccnatacnaggatggaccccaatgctagaacgtgtctatgggaaatggaatatctgcacatggcatnncccgggaggtgggtctgcactgtgacttgaagcaaagcn

SEQ ID NO: 28094 - DNA, 580 bp, Zea mays
  misc_feature: Ceres CLONE 1401991-F
  misc_feature: Encodes the peptide sequence at SEQ ID NO. 28095
  misc_feature (197)..(197): n is a, c, t, g, unknown, or other
  misc_feature (203)..(203): n is a, c, t, g, unknown, or other
  misc_feature (204)..(204): n is a, c, t, g, unknown, or other
  misc_feature (292)..(292): n is a, c, t, g, unknown, or other
aaagctggagctccccgcggtggcggccgctctagaactagtggatcccccgggctgcaggaattcgcacgagaccattacctagaacatcctaaccaaaaaaacgagaaggaagccaccgctccccaatcgcctgcttgccttcccatcctcctcgtagatctccggcaccgggcaccatgagctccctactcggngaccgnntctccctcctcttcttgggggcccaccaaacctccctcgactcccaaaagttcgacttccggattaaattcctcccggtcttcggggnttcggccccctcgggacaggggggggggggggggttacaaccctccaaaaaggccgcccccggggcccctgggatggaccaaaccggcaggggccaaaaggtgtgggacccacaggcttccccggcggggggggcggggccccaatggggggggggctttgttaaccggccaaccacccgtgggggggaagaaatttgggggggggggggggtggtccgcggggggtcccttggggggtgggggagccccccgggggaaaaaaaccccggcgctttttagggattctc

SEQ ID NO: 28095 - protein, 130 aa, Zea mays
  misc_feature: Ceres CLONE 1401991-F
  misc_feature (9)..(9): Xaa is any aa, unknown, or other
  misc_feature (38)..(38): Xaa is any aa, unknown, or other
MSSLLGDRXSLLFLGAHQTSLDSQKFDFRIKFLPVFGXSAPSGQGGGGGLQPSKKAAPGAPGMDQTGRGQKVWDPQASPAGGAGPQWGGGFVNRPTTRGGEEIWGGGGVVRGGSLGGWGSPPGEKNPGAF

SEQ ID NO: 28096 - DNA, 625 bp, Zea mays
  misc_feature: Ceres CLONE 1401992-F
  misc_feature: Encodes the peptide sequence at SEQ ID NO. 28097
  misc_feature (442)..(442): n is a, c, t, g, unknown, or other
aaagctggagctccccgcggtggcggccgctctagaactagtggatcccccgggctgcaggaattcgcacgagaccattacctagaacatcctaatcgaaaacactcgctttccggcgggcgactggcctaaaatcgcctcttgtttgtttgcttccgtcgtcccctctccacgtagagcacgcccccggaccaccttttataagcaccaaccatctggccttgccgcgccgattcgccacgaagccgcactgtgagagagggacgcggcctgttgtcccggcttttagacgcaacttccatcgctgcgaagctatccattcgtgttcgtcatggccgccagcgtcaccgtggaaaacctcaaccccaaggtcttaaaatgtgagtatgcagtccgtgggggagattgtcatccatgctcagcgcctgcagcaacaactacnaacacaaccagggtctcttccttttgatgagatcctctattgcaacattgggaatccccaatctcttggtcagcaacctgtgacatccttcagggaggttcttgctctttgtgatcatccgtgcctcttggaaaaagaggaacccaatcattgttcagtgctgatgcaatttctcgagcaaag

SEQ ID NO: 28097 - protein, 79 aa, Zea mays
  misc_feature: Ceres CLONE 1401992-F
  misc_feature: SWISSPROT Homolog: EC 2.6.1.2 Alanine transaminase
  misc_feature (19)..(19): Xaa is any aa, unknown, or other
MQSVGEIVIHAQRLQQQLXTQPGSLPFDEILYCNIGNPQSLGQQPVTSFREVLALCDHPCLLEKEEPNHCSVLMQFLEQ

SEQ ID NO: 28098 - DNA, 634 bp, Zea mays
  misc_feature: Ceres CLONE 1401996-F
  misc_feature (397)..(397): n is a, c, t, g, unknown, or other
  misc_feature (412)..(412): n is a, c, t, g, unknown, or other
  misc_feature (482)..(482): n is a, c, t, g, unknown, or other
  misc_feature (507)..(507): n is a, c, t, g, unknown, or other
  misc_feature (629)..(629): n is a, c, t, g, unknown, or other
aaagctggagctccccgcggtggcggccgctctagaactagtggatcccccgggctgcaggaattcgcacgagaccattacctagaacatcctaatcgaaaaaatagcctctcctcgcaccccctcaagaactgtacccatcacgcgccgccatcgattgaccttgaccgacccgaccacccatcacgcttcttgttgccgccgctgttgcttgccgatacgcggtggctgcgctcgccggcggggaagaggggtcgcgggctgcgcgcctccagtctttcttcgcctccgtgctctcgggcctcttcggccaggccgaccaggacgaggaccaagagatgtcctcgcgcaaccacaacgccgccgctccgcagcttcacatcacaagccgagccgntgttcccgctcttgnaaagacaaggccgtgcccgcccgacctgacgctctgaaccggcgaccccctctcggcgatatcggcaccntcgtcagcgtccgcccaccacaggnaaaccggcaggagcaggtcaaccgccccatcactagaagcttcggcgctcactcgtcaagaaagcgccaggcgaaagccgcaatcaagatgccgcatcctgccctgcaagcatgcgccaagnaaaaa

SEQ ID NO: 28099 - DNA, 645 bp, Zea mays
  misc_feature: Ceres CLONE 1401999-F
  misc_feature (445)..(445): n is a, c, t, g, unknown, or other
  misc_feature (527)..(527): n is a, c, t, g, unknown, or other
  misc_feature (632)..(632): n is a, c, t, g, unknown, or other
  misc_feature (645)..(645): n is a, c, t, g, unknown, or other
aagctggagctccccgcggtggcggccgctctagaactagtggatcccccgggctgcaggaattcgcacgagaccattacctagaacatcctaatcgaaaactcccagctcctcctccctgtctgctcccctccactgctgtggcgctctccctctcccgtctcccctcaccttctccacctcccccattccgccaccgcacaagccgacctccctcaccaagaggagaaaagaaagggagagcgaaggaggcaaaccaggtgggacagcaacgcgacgtgcttgctattctctcgagagagatgtcaattttataataaaaccccagcatgcgtcagctggcgaattatgacttgagctcatgcaaggtgtaagtcttactgcaagaagggcagctgtgcatgttaagacccatacatagcctctcttgattacacagcacggngggtgaaaacttgagatacagttgatctcctggttcagagtatggggttcaaggtttgcatcgcatcagctgagcattgggnctggaatgtttctggtcgacctgagcaccctaaaggagaaggccccaaccattttttccactgcgatgcataaaaaactggggggtgacatcaagaatccagagnagttgggggaaan

SEQ ID NO: 28100 - DNA, 614 bp, Zea mays
  misc_feature: Ceres CLONE 1402007-F
  misc_feature: Encodes the peptide sequence at SEQ ID NO. 28101
  misc_feature (335)..(335): n is a, c, t, g, unknown, or other
  misc_feature (537)..(537): n is a, c, t, g, unknown, or other
  misc_feature (590)..(590): n is a, c, t, g, unknown, or other
aaagctggagctccccgcggtggcggccgctctagaactagtggatcccccgggctgcaggaattcgcacgagaccattacctagaacatcctaatcgaaaaacccctgttcctctgcgatttgggctcgtcctgtgtccttcctgttgctcaaaagctcgctcattcgatgtccctgtctgaaaggcgacaaatcccactggaattcggagcacagagctttgaatccaggggccaaaactttttgctcatctcccttgcggaaaagcgcctcctctgcgtctgaaagtcggatcttttttcacagattcgatttgaagttcccgagcagctgnaggaccgcggtgtcggtaagacttgctttgaagatcttgatcaccacaagagatttgctgaatttccggtcactgtactttttccactggacatgtcctttcgcagcatagtccgtgatgttagggaaagctttggtagcttatcaagacggagccttgaggccaggatttctggtttgcctgctctggccaaaccggtggnatctggccggaccttgcccgaccgacctgaccagttggccagggcctgtgganggtattcgcccccgcttgctccga

SEQ ID NO: 28101 - protein, 62 aa, Zea mays
  misc_feature: Ceres CLONE 1402007-F
  misc_feature (37)..(37): Xaa is any aa, unknown, or other
  misc_feature (55)..(55): Xaa is any aa, unknown, or other
MSFRSIVRDVRESFGSLSRRSLEARISGLPALAKPVXSGRTLPDRPDQLARACGXYSPPLAP

SEQ ID NO: 28102 - DNA, 631 bp, Zea mays
  misc_feature: Ceres CLONE 1402010-F
  misc_feature (200)..(200): n is a, c, t, g, unknown, or other
  misc_feature (257)..(257): n is a, c, t, g, unknown, or other
  misc_feature (373)..(373): n is a, c, t, g, unknown, or other
tggagctccccgcggtggcggccgctctagaactagtggatcccccgggctgcaggaattcgcacgagaccattacctagaacatcctaatcgaaaagcgaccgcgactcggatcggatctctctcctgtgtagagccatgctgtgctgtgctggtagtagcagcagcagtagcaatgagtagtccagtccacagctccnagaacacgtggccgtcctttccttgcctctccctatcggattccggtaacgcagggnggagggcgccaccggctttaaccatggcctgtcgcttttgcctcgtctggtcggctggtccctctgctctatcccatcccccttgagcaggctgttgagcaagctgaactcatagnaacctcgatttcttccggtcccggcgtttttttttctctcagtttctgaggtatttctccccctttctttcttccctccctcccagtagattcttcactggctcggggatttgaacaaagggccgtggttcgaagctggtggtgttcgttcaattgggcggaaagaaagcccagggttattgtgtaaagtattgaaggctacaaagtaggctggctctcgcctcgccgaggatggatctcgaggtcggaaggggcctg

SEQ ID NO: 28103 - DNA, 626 bp, Zea mays
  misc_feature: Ceres CLONE 1402011-F
  misc_feature (232)..(232): n is a, c, t, g, unknown, or other
  misc_feature (290)..(290): n is a, c, t, g, unknown, or other
aagctggagctccccgcggtggcggccgctctagaactagtggatcccccgggctgcaggaattcgcacgagaccattacctagaacatcctaatcgaaaaatcagacatcaccaactcgtcgacggtagagagagcaagctcttcggcgatttgagaagaatcgaggagcgagcgagcccgagcgagcgagagaggaggaggaggagctggggcttgagcctgcgcccggnggccccgggtcacggaatcctacattaccaaccctagccttcgttgatcgccgtctcngttcatggcagggcccgcgccggatcgggccgccctgactgggtgggccgggcatggacatgccaatcatgcacgacagcgaccggtactctcgtgggcgatatcggctccggcaacttcggcggtggccggctcatgggcgaccgccgcaacagggaactcggcggcggcaaggacctcgaggggcggggaggaaaatgaaggagaagggcccggggggggataattaacccttagatctttggaaccaccctacctttattagggcttaaagggggttatttttacacccgacccatctggcttatggccatgaaatatggcctctgggcgggg

SEQ ID NO: 28104 - DNA, 569 bp, Zea mays
  misc_feature: Ceres CLONE 1402013-F
  misc_feature: Encodes the peptide sequence at SEQ ID NO. 28105
aaagctggagctccccgcggtggcggccgctctagaactagtggatcccccgggctgcaggaattcgcacgagaccattacctagaacatcctaatcgaaaaattccaccccacgcaacgcaccacgcgcgaaggaagctagctcccaccgtgagtgcagtgcaccgctagatccatggcggcagcggcggcaggaagctcccgccttctctccgcgctggccctcgccggcgtcgtttccttcctcctcgtcgctgaccctggcgtcgtcgccgcggaggcggcagccgcgccgccggggctggagttccgcgtgggcgggccgcgcgggtggcgcgtcccggacgccaacaccagctacggatggtgggccatgaacaacccgctttcacgtcgggcgaccggcctctattttcaaggtacgcgaaacgaccaactccgggggctgggggggggaaaccgccctgggccctttcaaaaccccttgaaaaaaccccaagggggggcccctttttccgcccgggttttctccccgcgggggggggcccccaccccaagaaaatttctcc

SEQ ID NO: 28105 - protein, 131 aa, Zea mays
  misc_feature: Ceres CLONE 1402013-F
MAAAAAGSSRLLSALALAGVVSFLLVADPGVVAAEAAAAPPGLEFRVGGPRGWRVPDANTSYGWWAMNNPLSRRATGLYFQGTRNDQLRGLGGGNRPGPFQNPLKKPQGGAPFSARVFSPRGGAPTPRKFL

SEQ ID NO: 28106 - DNA, 616 bp, Zea mays
  misc_feature: Ceres CLONE 1402018-F
  misc_feature: Encodes the peptide sequence at SEQ ID NO. 28107
  misc_feature (616)..(616): n is a, c, t, g, unknown, or other
tggagctccccgcggtggcggccgctctagaactagtggatcccccgggctgcaggaattcgcacgagaccattacctagaacatcctaatcaaaaaatctgccatcttcgtctatccctttcatctcagttttgcagcttctactgctggcttcgctccgaaatccaaccgaaatctcacaggaaagtaggaaacctcgttcgggaacctgctttgagtgagactccaatccttgggcgccattgccgcctgttttttgggctcggaaaggcgctgtctgattcctgtatatttattttggcaatgctttcagctgcaacaaaactaaccatggatggcactagctttgacctgacagagcacgaaggctcaaatttggctccttttctactcaaactttttaatgagtgggatgatcgcaagacaaggggcttggttcaccatgacatcagttcctgtgaaacaaaggtgctacctggagtacataattttgtggcaacattaattgaaggacgtgaccaaaagaagcggccaactgaggtcacaatgaagcaagttctccagccatttgttagtgagaaggtcaatttcacaaaagtcaggccgtctggaggn

SEQ ID NO: 28107 - protein, 95 aa, Zea mays
  misc_feature: Ceres CLONE 1402018-F
MDGTSFDLTEHEGSNLAPFLLKLFNEWDDRKTRGLVHHDISSCETKVLPGVHNFVATLIEGRDQKKRPTEVTMKQVLQPFVSEKVNFTKVRPSGG

SEQ ID NO: 28108 - DNA, 620 bp, Zea mays
  misc_feature: Ceres CLONE 1402020-F
  misc_feature: Encodes the peptide sequence at SEQ ID NO. 28109
  misc_feature (343)..(343): n is a, c, t, g, unknown, or other
  misc_feature (365)..(365): n is a, c, t, g, unknown, or other
  misc_feature (401)..(401): n is a, c, t, g, unknown, or other
  misc_feature (402)..(402): n is a, c, t, g, unknown, or other
  misc_feature (434)..(434): n is a, c, t, g, unknown, or other
  misc_feature (439)..(439): n is a, c, t, g, unknown, or other
  misc_feature (452)..(452): n is a, c, t, g, unknown, or other
  misc_feature (469)..(469): n is a, c, t, g, unknown, or other
tggagctccccgcggtggcggccgctctagaactagtggatcccccgggctgcaggaattcgcacgagaccattacctagaacatcctaatcgaaaaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccngcgccggtccacctgccaccgncggtccatgtgcccgccgcggttcatctgccgccgnncacatggcactaccctactcaaccgccccggnctcangctcatccccagncacacccatgccggtgncaacagccgcattcaagccccgtgccagctgcagggaacctggcggggttggcaagaaccccgatcctgggccaggggcgtccagtctcttgaggatcaggggaacccgagggggaagccctaatgctccccctcagggcagccgttgggg

SEQ ID NO: 28109 - protein, 133 aa, Zea mays
  misc_feature: Ceres CLONE 1402020-F
  misc_feature (69)..(69): Xaa is any aa, unknown, or other
  misc_feature (81)..(81): Xaa is any aa, unknown, or other
  misc_feature (92)..(92): Xaa is any aa, unknown, or other
  misc_feature (93)..(93): Xaa is any aa, unknown, or other
  misc_feature (98)..(98): Xaa is any aa, unknown, or other
  misc_feature (103)..(103): Xaa is any aa, unknown, or other
MRVLLVALALLALAASATSTHTSGGCGCQPPPPVHLPPPVHLPPPVHLPPPVHLPPPVHLPAPVHLPPXVHVPAAVHLPPXTWHYPTQPPRXXAHPQXHPCRXQQPHSSPVPAAGNLAGLARTPILGQGRPVS

SEQ ID NO: 28110 - DNA, 620 bp, Zea mays
  misc_feature: Ceres CLONE 1402021-F
  misc_feature: Encodes the peptide sequence at SEQ ID NO. 28111
tggagctccccgcggtggcggccgctctagaactagtggatcccccgggctgcaggaattcgcacgagaccattacctagaacatcctaatcgaaaaacactggttcttcagaccattacctttatctactccacagcggagaacaatccgatcgacaccatgagggagttgctcgttggcctcgctctcctggctctcgctgagagcgccacctccacgcatacaagcggcggatgcctgtgccagccaccgacgccggttcatctaccgccaacggtgcatctgtcacctccggttcacctgccacgtccggtgcatctcccaccgtcggtccacctgccgccgccgggccacctgccaccgccggtccatgtgtcgccggcgattcatctgccgacgccaccatgccactaccctactcaaccgccccggactcagcctcatcccacagccacacccatgcccgtgccaacagccgtatccaagtccgtggcaactgcagggaacctggggcgttggcagcaccccgatcctgagccagtgcaacgagtacctgaggcatcagtgcatgacgacggggacgccctactggtcaactcagcgacagccgttgctatag

SEQ ID NO: 28111 - protein, 153 aa, Zea mays
  misc_feature: Ceres CLONE 1402021-F
MRELLVGLALLALAESATSTHTSGGCLCQPPTPVHLPPTVHLSPPVHLPRPVHLPPSVHLPPPGHLPPPVHVSPAIHLPTPPCHYPTQPPRTQPHPTATPMPVPTAVSKSVATAGNLGRWQHPDPEPVQRVPEASVHDDGDALLVNSATAVAI

SEQ ID NO: 28112 - DNA, 597 bp, Zea mays
  misc_feature: Ceres CLONE 1402022-F
  misc_feature: Encodes the peptide sequence at SEQ ID NO. 28113
  misc_feature (537)..(537): n is a, c, t, g, unknown, or other
  misc_feature (576)..(576): n is a, c, t, g, unknown, or other
aagctggagctccccgcggtggcggccgctctagaactagtggatcccccgggctgcaggaattcgcacgagaccattacctagaacatcctaatcaaaaaatctgccatcttcggctatccctttcatctcagttttgcagtttctactgctgtcttcgctccgaaatccaaccgaaatctcagaggaaagtaggaaacctcgttcgggaacctgctttgagtgagactccaatccttgggcgccattgccgcctgttttttgtgctcggaaaggcgctgtctgattcctgtatatttattttggcaatgctttcagctgcaacaaaactaaccatggatggcactagctgttgacctgacagagcacgaaggttcaaatttgtctccttttctactcaaactttttaatgagtgggatgatcgcaagactaggggcttgtttcaccatgacatcagttcctgtgaaacaaaggtgctacctggagtacataattttgtgggcacattaattggaggacgtgaccaaagaagcggnccactgagctcacaatgaacccagttctccagcatttgntagtgagacgtcatttcacaa

SEQ ID NO: 28113 - protein, 71 aa, Zea mays
  misc_feature: Ceres CLONE 1402022-F
MALAVDLTEHEGSNLSPFLLKLFNEWDDRKTRGLFHHDISSCETKVLPGVHNFVGTLIGGRDQRSGPLSSQ

SEQ ID NO: 28114 - DNA, 606 bp, Zea mays
  misc_feature: Ceres CLONE 1402023-F
  misc_feature: Encodes the peptide sequence at SEQ ID NO. 28115
  misc_feature (582)..(582): n is a, c, t, g, unknown, or other
aagctggagctccccgcggtggcggccgctctagaactagtggatcccccgggctgcaggaattcgcacgagaccattacctagaacatcctaatcgaaaaacactgggtcttcagaccattagctttatctactccagagcgcaaaagaacccgatcgacaccatgagggtgttgctcgttgccctcgctctcctggctctcgctgcgagcgccacctccacgcatacaagcggcggctgcggctgccagccaccgccgccggttcatctaccgccgccggggcatctgccacctccggatcacctgccacctccggtgcatctcccaccgacggtccacctgccgccgccggtccacctgccaccgccggtccatgtgccgccgccggttcatctgccgccgccaccatgccactaccctactcaaccgccccggactcagcctcatccccagacacacccatgcccgtgtgcacagccgcatccaagcccgtgccagctgcagggaacctgcggcgttggcagcacaccgatcctgggccagtgcgtctagttcctgaggcatcagagcagcctgacgncgacgccctactgctcgactcagt

SEQ ID NO: 28115 - protein, 129 aa, Zea mays
  misc_feature: Ceres CLONE 1402023-F
MRVLLVALALLALAASATSTHTSGGCGCQPPPPVHLPPPGHLPPPDHLPPPVHLPPTVHLPPPVHLPPPVHVPPPVHLPPPPCHYPTQPPRTQPHPQTHPCPCAQPHPSPCQLQGTCGVGSTPILGQCV

SEQ ID NO: 28116 - DNA, 617 bp, Zea mays
  misc_feature: Ceres CLONE 1402028-F
  misc_feature (128)..(128): n is a, c, t, g, unknown, or other
  misc_feature (153)..(153): n is a, c, t, g, unknown, or other
  misc_feature (154)..(154): n is a, c, t, g, unknown, or other
  misc_feature (231)..(231): n is a, c, t, g, unknown, or other
aagctggagctcaccgcggtggcggccgctctagttctagtggatcccccgggctgcaggaattcgcacgagaccattacctagaacatcctaatcgaaaaatcaaccatattattgagatcaacaancaacataaaaaggggaatccagtannaactatagagcaacaatggggacctcgatattttccctccttatgctccttgctctaacaacatgaggtggtaaganaacaacttaccctcaaggctcacaaggtcctataggttcccttcttcccccataccttccatcaattatagcttcaatatgcgaaaacccagctcttcaaccatataggcttcaacaagcaatcgcagcaagcaacatacctttatcgcccttgatgtgtcaacaatcgacaggcctatctttggagcagtcattggtacaaacgcatcacggtacaacagctgaagcaaatcgtgctacctctgatcaaacaagtagatctggaaaacctttctccctactctcaacaacaacaatttcttccattcaaccaactggctacactgaaccctgctgcttatgtagcgcaacaactaataccatttagccaactagctactgcctaa

SEQ ID NO: 28117 - DNA, 636 bp, Zea mays
  misc_feature: Ceres CLONE 1402029-F
  misc_feature: Encodes the peptide sequence at SEQ ID NO. 28118
agagctggagctccccgcggtggcggccgctctagaactagtggatcccccgggctgcaggaattcgcacgagaccattacctagaacatcctaatcgaaaaatgatcctcctttcaaggtccactactccacacctacacttcacaatcctccgttggggaacctgatacacagaaccccgacgcctgtggatttgttcgccgcccgagatagaaacacagagacagacatagactcagactcggacacaatgatatgatctcgagggaccgacataacgcgcctgctcttcacgagaatgtgaagatcctccgctccatcactcactcccacgctctgatgaacacgtccatacatcatgtactcgtcgacgtacatcatggagctgaagcataaggcggagacgctgaaccataagattgcgtgcacgcatcacacgctgagacactagaatcatcctatccccagatgactgtgaaacgcctcaggaacgcaacctcgctcgttactgtggaacaccctctccagacaagactgcccggtgctgctctgccgccacgatgcaggtcttcgactaggtgggactcagcgtgctacagtgcaacgcgtgctagcgcgaatcctttcgactcgat

SEQ ID NO: 28118 - protein, 46 aa, Zea mays
  misc_feature: Ceres CLONE 1402029-F
MISRDRHNAPALHENVKILRSITHSHALMNTSIHHVLVDVHHGAEA

SEQ ID NO: 28119 - DNA, 673 bp, Zea mays
  misc_feature: Ceres CLONE 1402029-R
ccgattgggtaccgggccccccctcgaggtcgacggtatcgataagcttttttttttttttttttgagagtaaaacaaatcgaattatagatcgagagggggagctaactgagaaacggagctactgctactaccatacacagagagggcgccggccggtccacgattgatcgagtacatgcgcggttgtccagccagagctactgctactaccatacacatagagggcgccggccggtcgaccatcgatcggagtacatgcacggttgtccaggcagccatgcaccatcaccaaggacgacatcgaccgatgcaagtagcagaaagcgtgtgtgcttacgcacgctcagcctctatctatagctagctactactcctcgtcgacgtgctcgctaccgccctcggagcacctcctgacggactgcacgacggcctgcttcacgacgtgctcggccacgttgtccgccacgttctctccgcccacggcctcgatgcggaacgagtccgcgcaggacacggtggcctggaccacgctgagccccagctcgtcgaaggcctccaacacggagacgagcatccccggctagctcttgtcgaagaacacgatcaccaggaacgacgacccctgcactcctagggcttccacggtcaccgtgggataggatgatgcctt

SEQ ID NO: 28120 - DNA, 646 bp, Zea mays
  misc_feature: Ceres CLONE 1402030-F
  misc_feature: Encodes the peptide sequence at SEQ ID NO. 28121
  misc_feature (354)..(354): n is a, c, t, g, unknown, or other
  misc_feature (443)..(443): n is a, c, t, g, unknown, or other
aaagctggagctccccgcggtggcggccgctctagtttctagtggatcccccgggctgcaggaattcgcacgagaccattacctagaacatcctaatcgaaaatctaaatccataatacaggagctgggaccaaagctgcagtcaagggaaaaggcagttgatgaactatcaacaaaagttaaaatgctcgaggatttgtgccatgcacaactttctcagacagaacctagtaaagacagatcatttgaagcatcttcctcaacaattgggtcagatatatctgatattgaagatgcaggaccagtgagcaagacaacatcagtttcatctgtttctacagctgcacatgctanaacaatgcgcaaggcctcagcggatcatcgtgatgtcaacattggttcagagtcagaaccattgattgctgcacaagattcagatgacnaggggcgtataaaatcgctccatacatctggctgcattccagctcaggggaagcacatcgctgatagggtcgatgccttctgggtcacggagaggcaaattctgatgaaccggccacgagcaaggctagggcttatgttgtactggctgggtgtgcacctatggttgctgcgcagcatcttgtgacaccgcttctcaataccg

SEQ ID NO: 28121 - protein, 208 aa, Zea mays
  misc_feature: Ceres CLONE 1402030-F
  misc_feature (118)..(118): Xaa is any aa, unknown, or other
  misc_feature (148)..(148): Xaa is any aa, unknown, or other
KLELPAVAAALVSSGSPGLQEFARDHYLEHPNRKSKSIIQELGPKLQSREKAVDELSTKVKMLEDLCHAQLSQTEPSKDRSFEASSSTIGSDISDIEDAGPVSKTTSVSSVSTAAHAXTMRKASADHRDVNIGSESEPLIAAQDSDDXGRIKSLHTSGCIPAQGKHIADRVDAFWVTERQILMNRPRARLGLMLYWLGVHLWLLRSIL

SEQ ID NO: 28122 - DNA, 632 bp, Zea mays
  misc_feature: Ceres CLONE 1402037-F
  misc_feature: Translation starting site: 226
  misc_feature: SWISSPROT Homolog: EC 1.1.1.1 Alcohol dehydrogenase
  misc_feature: SWISSPROT Homolog: EC 1.1.1.14 L-iditol 2-dehydrogenase
aagctggagctccccgcggtggcggccgctctagaactagtggatcccccgggctgcaggaattcgcacgagaccattacctagaacatcctaatcgaaaactgaattcttttctactatagctagagccaggcagacagccaacgccaagcgggggaggttgactcttctgtctacagcacctacctcttcacaccaactgccgcccctgctccgagaaccagaatggccgccgccgatgcatcttcgttgcctccgtccgccatcacctgccgagcggcggtggcgtgtggaccgggccagccactggtgatggaggaggtggaggtcgccccgccggggcccatggagatccgtgtcaaggtcgtctccacctccgtctgccgcagcgacgtcactgcctggtaatccaagctgagagcctgagacaaacgatctctctgatcgaatttgctcatctgtgctctcttccaattccaacatgcaggcgcaacttgatctgttccccggagtcttcggccacgaggcatccggagtagtagagagtgtccgtgaagctgtgaccgatctccaagtcggtgaccacgttctcactgtctacattggggaatgcaagagctgtaagcactgcg

SEQ ID NO: 28123 - DNA, 641 bp, Zea mays
  misc_feature: Ceres CLONE 1402039-F
  misc_feature: Encodes the peptide sequence at SEQ ID NO. 28124
aaagctggagctccccgcggtggcggccgctctagtctagtggatcccccgggctgcaggaattcgcacgagaccattacctagaacatcctaatcgaaaaaaaatagaaaaagtctcctgcctccgcggccgtgccgagccggcatcccctcccgtcccccacccccagcagcgatcgcgacgacccgagccggcaagggtgacaggcggctgacgagccccatgggagacaacaagtctccgctgagcctgagcccgatgggcgggcgcgaccgggaccgggagctcctcatcccggtctcgggcggcggctcggcgcccggcgacggggtcgaggacggtgacaggtcctcctccgcctccgccgcgctatcctcctccggtcgcgaggttttccataaggctgtccgcagttgggctttcaagaagttcatgactggatgtgtaattctcttccccctagcaataacgttctacatcacctggtgggtcattcattttgttgatggagtcttctctgccatctatgctcaactggggatccacatatttggccttgactttgacacctctgctacttttcctatttttgtccgaggctttatgtcatcttggcttggggcatctgtcctttaccttg

SEQ ID NO: 28124 - protein, 139 aa, Zea mays
  misc_feature: Ceres CLONE 1402039-F
MGDNKSPLSLSPMGGRDRDRELLIPVSGGGSAPGDGVEDGDRSSSASAALSSSGREVFHKAVRSWAFKKFMTGCVILFPLAITFYITWWVIHFVDGVFSAIYAQLGIHIFGLDFDTSATFPIFVRGFMSSWLGASVLYL

SEQ ID NO: 28125 - DNA, 639 bp, Zea mays
  misc_feature: Ceres CLONE 1402042-F
  misc_feature: Translation starting site: 227
  misc_feature: SWISSPROT Homolog: EC 1.1.1.1 Alcohol dehydrogenase
  misc_feature (552)..(552): n is a, c, t, g, unknown, or other
  misc_feature (603)..(603): n is a, c, t, g, unknown, or other
aaagctggagctccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaagctgagagcctgagacaaacgatctctctgatcgaatttgctcatctgtgttctcttccaattccaacatgcaggcgcaacttgatctgttccccagagtcttcggccacgaggcatccggagtagtagagagtgtcnggtgaaggtgtgaccgagttccaagtcggtgaccacgttctcactgtcttncattggggaatgcaagagctgcaagcactgcgtctt

SEQ ID NO: 28126 - DNA, 643 bp, Zea mays
  misc_feature: Ceres CLONE 1402044-F
  misc_feature: Encodes the peptide sequence at SEQ ID NO. 28127
  misc_feature (501)..(501): n is a, c, t, g, unknown, or other
aagctggagctccccgcggtggcggccgctctagaactagtggatcccccgggctgcaggaattcgcacgagaccattacctagaacatcctaatcgaaaaatactcctccggatccgtgttccatcacggctacaaaaatactccgcctgcatctccaaagcacacggctccctctggtttcccgcctcctcttcacctccttcgcgtcccgacgctccctcatggccgccgctgccgcagcagcagcagcagtttcctccccgattgctccacgcgctgtggccgccgcggcctcccgccgggggttcgtcacgtttggtggaggcgccgcccgctcctcgcccacgctgcggtccggccgcgggttctctggtgtgcaaacccatgttgccgctgttgaacaagcagttgtaaaagatgctacgaagctggaagctccagttgttgttgttacaggtgcctctagagggattggaaaggcaactgctctagcccttgnaaaagcaggatgcaaggttctggtaaattatgctcggtcttcgaaagaggctgaagaggtctccaaagagattgaagcatctggtggtgaggctatcacctttggaggagatgtttcaaaagaagctgatgtagagtctatg

SEQ ID NO: 28127 - protein, 140 aa, Zea mays
  misc_feature: Ceres CLONE 1402044-F
  misc_feature: SWISSPROT Homolog: EC 1.1.1.100 3-oxoacyl-[acyl-carrier-protein] reductase
  misc_feature (93)..(93): Xaa is any aa, unknown, or other
MAAAAAAAAAVSSPIAPRAVAAAASRRGFVTFGGGAARSSPTLRSGRGFSGVQTHVAAVEQAVVKDATKLEAPVVVVTGASRGIGKATALALXKAGCKVLVNYARSSKEAEEVSKEIEASGGEAITFGGDVSKEADVESM

SEQ ID NO: 28128 - DNA, 602 bp, Zea mays
  misc_feature: Ceres CLONE 1402047-F
  misc_feature: Translation starting site: 216
  misc_feature: Pfam Name: ADH_zinc_N Pfam Description: Zinc-binding dehydrogenase
  misc_feature: SWISSPROT Homolog: EC 1.1.1.1 Alcohol dehydrogenase
tccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaagctgagagcctgagacaaacgatctctctgatcgaatttgctcatctgtgttctcttccaattccaacatgcaggcgcaacttgatctgttccccagagtcttcggccacgaggcatccggagtagtagagagtgtcggtgaaggtgtgaccgagttccaagtcggtgaccacgttctcactgtcttcattggggaatg

SEQ ID NO: 28129 - DNA, 636 bp, Zea mays
  misc_feature: Ceres CLONE 1402049-F
  misc_feature: Encodes the peptide sequence at SEQ ID NO. 28130
aaagctggagctccccgcggtggcggccgctctagaactagtggatcccccgggctgcaggaattcgcacgagaccattacctagaacatcctaatcgaaaaccgcattcattcatctagcgcgcgacagagaggagaacaaaaaggaagggcgaggaggacaggaagccgagcgcaagagctgaggcttcgccgcgaaaccccagacctcgcgacgacccttcccctccgcggagtcgtgctcgcacgctctccgatccaagatgtataaagaggtgagaggaaatcgtgataaggcgcagaagtacatgaccattacccgtgccagtgagaacgatgcccttcaggcactgaaagctagtgattgacacttgcaaggaggttttgacttcttctatagccaagctcagtgctctgaggtcgctactcggcatcttgaagatattgtccacacatataaagcacctgatgctgatatgatgatgcagcacagaatatctacattttgcaaggatctgaaggctcatcctcagcatatagccatgcttgtcatatcatggcaccggaaagccgtcatcatgagtgcaattactgcgccgagaatcattggcggactgcaccaaattgatgtagatg

SEQ ID NO: 28130 - protein, 34 aa, Zea mays
  misc_feature: Ceres CLONE 1402049-F
MYKEVRGNRDKAQKYMTITRASENDALQALKASD

SEQ ID NO: 28131 - DNA, 622 bp, Zea mays
  misc_feature: Ceres CLONE 1402050-F
  misc_feature: Encodes the peptide sequence at SEQ ID NO. 28132
  misc_feature (411)..(411): n is a, c, t, g, unknown, or other
  misc_feature (456)..(456): n is a, c, t, g, unknown, or other
aagctggagctccccgcggtggcggccgctctagaactagtggatcccccgggctgcaggaattcgcacgagaccattacctagaacatcctaatcgaaaaataggggccatcagatccaagaagagggaagagcaccaaggaccttcggcgcccgttcaggatccacatcttcccgagcgagttcttggttgacctcttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtagtggtcgcaagagcctgaccaccgtccanggattgaagaaggagttcagctacagcaagatcctcaaagatctncagaaagagttctgctgcaatggtacagtggtccaggacccagaacttggacaggtcattcagctcccggggtgatcagaggaaagaacgtctcgaattttctcctccagggcggatttggaaaaaggggcccatcaggattctgggttttggagaaacccccggg

SEQ ID NO: 28132 - protein, 89 aa, Zea mays
  misc_feature: Ceres CLONE 1402050-F
  misc_feature (27)..(90): Pfam Name: SUI1 Pfam Description: Translation initiation factor SUI1
  misc_feature (50)..(50): Xaa is any aa, unknown, or other
MSDLDIQIPTAFDPFAEANAGDSGAAAGSKDYVHVRIQQRSGRKSLTTVXGLKKEFSYSKILKDLQKEFCCNGTVVQDPELGQVIQLPG

SEQ ID NO: 28133 - DNA, 616 bp, Zea mays
  misc_feature: Ceres CLONE 1402057-F
  misc_feature: Encodes the peptide sequence at SEQ ID NO. 28134
tggagctccccgcggtggcggccgctctagaactagtggatcccccgggctgcaggaattcgcacgagaccattacctagaacatcctaatcgaaaagccgccaacccccaaacaaaaccctaggccaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgccttcgaccagggctccagagccgcccttcaggccggcgtcgagaagctcgccgccgcggtcggcgtcaccctcggacccagaggaaggaatgttgtcttggatgagtttggaacccccaaagtggtcaatgatggagttaccattgcccgcgctattgagctcgctgatcccatggagaatgctggtgcttccttgattcgtgaagttgctagtaagacgaatgactcggctggtgatggaactacaactgcctctgttctcgctagggagatcatcaaattgggcatgttgagcattac

SEQ ID NO: 28134 - protein, 152 aa, Zea mays
  misc_feature: Ceres CLONE 1402057-F
MATIPTTDSGLVLSSSALLRRTRRAASSVTARLPAVARRRPQLLVRASAKEIAFDQGSRAALQAGVEKLAAAVGVTLGPRGRNVVLDEFGTPKVVNDGVTIARAIELADPMENAGASLIREVASKTNDSAGDGTTTASVLAREIIKLGMLSI

SEQ ID NO: 28135 - DNA, 636 bp, Zea mays
  misc_feature: Ceres CLONE 1402059-F
  misc_feature: Encodes the peptide sequence at SEQ ID NO. 28136
aaagctggagctccccgcggtggcggccgctctagaactagtggatcccccgggctgcaggaattcgcacgagaccattacctagaacatcctaatcgaaaactgcattcattcagctagcgagcgagagagaggggaacaaaaaggaagggcgaggaggacagggagccgagcgcaagagctgaggcttcgccgcgaaaccccagacctcgcgccgccccttcccctccgcggtgtcgtgctcgcacgctctccgatccaagacgtataatctgcggagaggaaaccgcgacgaggtgcagcagttcatgaccattaccggcgccagtgagaaggttgcccttcaggcactgacagctagcgattggcacttggaaggagcttgtgacttcttctataggcaacctcaagactctgcggacaatactccgcatcttgaagatattttcaacagatataaagaacctgatgccgatatgataatgcaggaaggaatatcaccaatttggcatgatctggcagagatccccaagcatatgccatgcttgtcatatcatggcacatgaaaggcgccacaatgtgtgaattacctcctcgggaatcatggccggactgcagcccaatagtgtagattca

SEQ ID NO: 28136 - protein, 85 aa, Zea mays
  misc_feature: Ceres CLONE 1402059-F
MTITGASEKVALQALTASDWHLEGACDFFYRQPQDSADNTPHLEDIFNRYKEPDADMIMQEGISPIWHDLAEIPKHMPCLSYHGT

SEQ ID NO: 28137 - DNA, 603 bp, Zea mays
  misc_feature: Ceres CLONE 1402067-F
  misc_feature: Encodes the peptide sequence at SEQ ID NO. 28138
aaagctggagctccccgcggtggcggccgctctagaactagtggatcccccgggctgcaggaattcgcacgagaccattacctagaacatcctaatcgaaaaagaaacactttacattagattttttgtatgaaacgcccgcaaccgacttgctcctcaagcctccctgcctgccagctcactcgccttcttcctcccattcccctcgaaccaaccagcagcgattcggatcaaaacgaaacgaaccaaaccaaccaactcgccaccctccaaagccgcagccccaatcccaccgccggccaggcaggcagagcgcaccccgcgccatgtcagccacgtcgtcgttcacagcgggggagtcgtctcgagctggcgagcaaccggagcgcgacgaggtggtcgagttcctggactgcccttgggtagcactctcctccgccatcgtcgtcatcggcgccaacgacgagcgggcacggatgctcgcgcccggtgcctcccgacatcttttctcgaacctcagccccccgtgggtcggggccttcctaattgggcctggcccaaaaggatccctcccgaactaaggattcaggtccaaacccgggt

SEQ ID NO: 28138 - protein, 84 aa, Zea mays
  misc_feature: Ceres CLONE 1402067-F
MSATSSFTAGESSRAGEQPERDEVVEFLDCPWVALSSAIVVIGANDERARMLAPGASRHLFSNLSPPWVGAFLIGPGPKGSLPN

SEQ ID NO: 28139 - DNA, 579 bp, Zea mays
  misc_feature: Ceres CLONE 1402072-F
  misc_feature: Encodes the peptide sequence at SEQ ID NO. 28140
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
tggagctccccgcggtggcggccgctctagaactagtggatcccccgggctgcaggaattcgcacgagaccattacctagaacatcctaatcgaaaagcgggggtcgcctgagatcacataaacaatggtgaaggctgttgctgtgcttggtagcagcgatggtgtcaagggcaccatctttttcacccaagagggagatggccctaccgctgtcaccggaagtgtctctggcctcaagcctggcctccatgggttccatgtacatgcacttggtgacaccaccaatggatgcatgtcaactggaccacactacaatcctgcgagcaaggagcatggggcaccagaagatgagaaccgccatggctggtgatcttggaaacgacagctggagcagatggtggtgctaatatcaatgggcaccgaacggccaaatcccactggactggggcccaaaatccaaaatattttttttggaaaaaaaaaaaannnnnttttggtttccccccccctccctctgttttttttaaggggggggggacccttctctaaaaaaaatctgtaaaaaaccgggggggggt

SEQ ID NO: 28140 - protein, 81 aa, Zea mays
  misc_feature: Ceres CLONE 1402072-F
  misc_feature (1)..(80): Pfam Name: Sod_Cu Pfam Description: Copper/zinc superoxide dismutase (SODC)
  misc_feature: SWISSPROT Homolog: EC 1.15.1.1 Superoxide dismutase
MVKAVAVLGSSDGVKGTIFFTQEGDGPTAVTGSVSGLKPGLHGFHVHALGDTTNGCMSTGPHYNPASKEHGAPEDENRHGW

SEQ ID NO: 28141 - DNA, 771 bp, Zea mays
  misc_feature: Ceres CLONE 1402079-F
  misc_feature: Encodes the peptide sequence at SEQ ID NO. 28142
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
gaacccacccccccccccccccccaaaaaccccccaaacaaaannnnnacaaagctggagctccccgcggtggcggccgctctataatagtggatcccccgggctgcaggaattcgcacgagaccattacctagaacatcctaatcgaaaaccacagcctccccagcatcagtgaagctcgctcaccgtcattcgacgacgccctcccgcacacacgaccatggccgcggcgatgaccggcagtgctcgcgccagcaccggctccttgctcgtgcttctcttcgtcgcgctggccggcgcgaccgccggggcgagtgccaccgttgccttcagcagcggcgacagcaacgcggcggcgctgctgacgacgccagcatcggcgtccccggggcagctgaacggcatcatccagtgccttatgggctgcttcacgcaggtgttcggctgttcgttcggatgcatgggcaagcagggcgctgacctgccgctctgcatcatcagctgcgaccagaagagcgtcgtgtgcatggtcagctgcggccttgcgccgtcaccgccatcaccgtcgccgcccacgcccaaaccaccagcacccaagccgcccacgcccaagccgcccggcccgccctacaccccgccgtacgccgccgctgccgtcaccggacgcacatctgcctgaatatgtcgacatgtgcctgccagctctcaaccgatccatcgtaccagtacgtagtaatgtacgatggatcggttgagagcggcggcggcgac

SEQ ID NO: 28142 - protein, 152 aa, Zea mays
  misc_feature: Ceres CLONE 1402079-F
MAAAMTGSARASTGSLLVLLFVALAGATAGASATVAFSSGDSNAAALLTTPASASPGQLNGIIQCLMGCFTQVFGCSFGCMGKQGADLPLCIISCDQKSVVCMVSCGLAPSPPSPSPPTPKPPAPKPPTPKPPGPPYTPPYAAAAVTGRTSA

SEQ ID NO: 28143 - DNA, 714 bp, Zea mays
  misc_feature: Ceres CLONE 1402085-F
  misc_feature: Encodes the peptide sequence at SEQ ID NO. 28144
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
gctctttactagtggatcccccgggctgcaggatttcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggacttctcggtgcgcgtgcgccgccgcctgccgtgacttcctgcagccgtgtgaacccttcaagtaacgtggcggcctcggggtaccacttacctcatcaggcccgggggtgtacctgggccaccatcccccgtcatcctggctgggtgggccggcgcccagcctgggcaaccctcagcccgggaacaaattttggggcccaaggggggggggggggagggcaacttaaggaacttggcccaccgggggttccgcgttttcctcggccgcgggctctggggctcttttacaaatttttcccggggtttaaaaatctaatgggccccaaggggccacacggggccccccggggggcccccacccaacacccaaaatttctctttagagggggggttaacaaaaaaagccgcgcgcgggcnnngagagaagatcctcacccacgagagtgtgtg

SEQ ID NO: 28144 - protein, 39 aa, Zea mays
  misc_feature: Ceres CLONE 1402085-F
MAREEQALLSTEIVNRGVEPSGPDAGSPDFSVRVRRRLP

SEQ ID NO: 28145 - DNA, 673 bp, Zea mays
  misc_feature: Ceres CLONE 1402086-F
  misc_feature: Encodes the peptide sequence at SEQ ID NO. 28146
gcggtggcggccgctctagaactagtggatcccccgggctgcaggaattcgcacgagaccattacctagaacatcctaatcgaaaaaccttgtctacaagggttttccgctgtcttatcccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgcctcgccgctcgcgggcggcgccccgtcgtacaacagcgtgccaccgccccccgatgagatccagctcgcgaagcagcgcgcgcaggagatcgcggcgcggatctttaacgccgcagaggccaagcgtcctcgcgtcgacaacggcgacgatgacagcggcggtcttcggtgtaggcctgggcagcactgggtggcggtggcccgcatcggcggcggaggactcggcttctcgtcctctggccggtggtgggcacggggcttctatcccacaattatcttctcagagaggcgcacctcagactccttcctttatgggggaatatccagggtacaagcaaaaagattgaatccaaaagggggaaagggggttgggtcgtaactcattgggaaaagccggggaaaacta

SEQ ID NO: 28146 - protein, 156 aa, Zea mays
  misc_feature: Ceres CLONE 1402086-F
MADDHYSSKRKYDDPSPPPRRTGFSSGPPPASPLAGGAPSYNSVPPPPDEIQLAKQRAQEIAARIFNAAEAKRPRVDNGDDDSGGLRCRPGQHWVAVARIGGGGLGFSSSGRWWARGFYPTIIFSERRTSDSFLYGGISRVQAKRLNPKGGKGVGS

SEQ ID NO: 28147 - DNA, 654 bp, Zea mays
  misc_feature: Ceres CLONE 1402088-R
cgaattgggtaccgggccccccctcgaggtcgacggtatcgataagcttttttttttttttttttctgtttttttaaataactttgggcagcggcatttcaattgggtatacatttttgggttgtccccagccccatattgtaccttccgcttctgttgaagacgcgctggccagactgaggacgcatcccatggccgatgggcgcgcgtgtgtgtgtaagccaccaagtgtgtgggagagataattcgtgtacatatggaaatagggccgcttgatcctcatcatgaggcagcgcgcgtctccgtcagctcgaaccgaattcctcgggtgaggtcggcaaatcggcccccccccgcatctgagggcccggccagatcaccggaatcccgcccttgagggcctcggagatcaaaggacaaagctagaaaccctccgagagcagcctattttgatgcaaagagctcacccatcgggataattgggccggataaaccaaggatctgaggtgccttccagaaatactataggcctgctcctttatctccaaaaattcaagggactacgtgggaacgatcgtcgctttacctaaataccctgaagtaaccttcgtacaaacgggaaaagtaggggccctctaatgcttcccccaacat

SEQ ID NO: 28148 - DNA, 667 bp, Zea mays
  misc_feature: Ceres CLONE 1402088-F
  misc_feature: Encodes the peptide sequence at SEQ ID NO. 28149
tccccgcggtggcggccgctctagaactagtggatcccccgggctgcaggaattcgcacgagaccattacctagaacatcctaatcgaaaagtggcttctcattcattgttgattgattgatcctccccgcctcactcctttgtctcctcgcctcgtgctcgctcgctcccctcgccctggcgaggagggcagcagaaaccctagcggctcaggccgggcgggggttagatgctccaaggttcgagagggaagggtaggttagtggtgcgccatcgactatgggctgcgtcttcggccgggcggctgcgtcgtcctctgcagcgccgaagaagaagtggggcaaggggagggcgtccccgcaggccgaagaggggacgccctccgcggtcgccgccaccgacgcagaagggagggcgcggcgtcctatcggtgatgggatgtggaaggtaccccatctggtgtgagctttcacgcttgccgggggggaggattcccgcttcgtgagtgcaggcgctgatctgatgtttcctggtatcagcatacctccagaagggtttccatcttttgaagctggccaaccatgggcagtaaaagttcctggtaaccctgctgcaattgcggttgggagcacaactatgagtagtactgaagctttgaaggcaggac

SEQ ID NO: 28149 - protein, 48 aa, Zea mays
  misc_feature: Ceres CLONE 1402088-F
MFPGISIPPEGFPSFEAGQPWAVKVPGNPAAIAVGSTTMSSTEALKAG

SEQ ID NO: 28150 - DNA, 674 bp, Zea mays
  misc_feature: Ceres CLONE 1402090-F
aaagtggagctccccgcggtggcggccgctctatcctagaggatcccccgggctgcaggaattcgcacgagaccattacctagaacatcctaatcgaaaaatcgcacatattattgagaccaactagcaacatagaaagcacaatattgtaccaataatggcagccaaaagattttgcctcattatgctccttggtctttctgcaagtgctgctactgcgatcattgtcccgcaatgatcacaagctcctatagcttcccttcttaccccatacctctcaccagcgatgtcttcagtatgggaaaatcctattcttctaccctacaggatccaacaggaaagtcacagcaggtgatctatacctttatcaccccttggttccccccaaaggtgtttcaggccctttttcccacccccccttgggggttttttggggcaaaaatttgggcgaaaaaatcaaaaatccggttaaaaaaattttgggtgacccttttgaaaaacaggaccccttgtgggtttttgggggaaaaacaattgggggaaaaagaataaaagaggtcctggtaaaaaaaaatttggggggtctttcctcccaaaagaaatatttttttgtttttttcgcccaacccaccaaggcgggaaacctctattttggtgtaaaatatatatgaaaa

SEQ ID NO: 28151 - DNA, 643 bp, Zea mays
  misc_feature: Ceres CLONE 1402096-F
  misc_feature: Translation starting site: 269
cgcggtggcggccgctctagaactagtggatcccccgggctgcaggaattcgcacgagaccattacctagaacatcctaatcgaaaaaccctacccctctctctctctctcctctacctccttttcctctaacctttagctttcctccctccctctcctctctcccccctcctctaacaagaactactcccagccattcagatcctaagttgctgaccttgctgctgcttgttggagatagatttgttggttctaagttcgaagtaccatgagtccaccgagtgtgatggggcagtttggggacacaacctacaccaaggtttttgttgggggactcgcgtgggaaacccagaaggagacgatgaggaagtacttcgagcagtttggggagatcctgggaggctgttgtcatcactgacaagaacactggcagatccaagggctacggatttgtacccttccgggatccggacgcggcgatgagagccttgcggtgatccgaacgggtgattgaagggaagggaggcctaactggaacctgctttccccttgggggtcaaagggttaagggctcccaacccccaggagggggggggacgataaaaaaattgttttaagggggagggggggggcaccccccccg

SEQ ID NO: 28152 - DNA, 703 bp, Zea mays
  misc_feature: Ceres CLONE 1402097-F
  misc_feature: Encodes the peptide sequence at SEQ ID NO. 28153
aaagctggagctccccgcggtggcggccgctctagaactagtggatcccccgggctgcaggaattcgcacgagaccattacctagaacatcctaatcgaaaagtccgccccccgccaccaccgcactcccatccagatgggagtgcgcaagaggagctttcggcattccggtctcgctcgaccaaccggatccccgtgagagtccccacccacaccccgagggcggcgtcgggtcgtcggggacagctgatttcacaagacgagccggcgagccggccggcatttcgtcgtcggatggcgccggcctcctcctcgtccgccggcgtcgcgtgcctcgtcctgctcctgctcctgctcctcgccggcgcctccgcggcgcacggctcgttccaggctaggcgtgctctgtcagatgaccatgggagcggtatagtggcgcgatggcggaggttgctcgccgacgctgcgactccagcgacaactctcttgtgctggctgcggcgaggactcaccggagggaccccttcgcaaacctaaccggggacagggggggggtggaaattaacgacgaggactactggggtttccggagggaacccgggggggccctcttcccagggccgggctggggggtcgtcgtttccgggggcaaatggcccgaaaccccgggggggggggggggtttgggggggaaaaaaaaacc

SEQ ID NO: 28153 - protein, 80 aa, Zea mays
  misc_feature: Ceres CLONE 1402097-F
MAPASSSSAGVACLVLLLLLLLAGASAAHGSFQARRALSDDHGSGIVARWRRLLADAATPATTLLCWLRRGLTGGTPSQT

SEQ ID NO: 28154 - DNA, 715 bp, Zea mays
  misc_feature: Ceres CLONE 1402099-F
  misc_feature: Encodes the peptide sequence at SEQ ID NO. 28155
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (596)..(596): n is a, c, t, g, unknown, or other
  misc_feature (683)..(683): n is a, c, t, g, unknown, or other
aaagctggagctccccgcggtggcggccgctctagaactagtggatcccccgggctgcaggaattcgcacgagaccattacctagaacatcctaatcgaaaaacggtccaccgacgactcttcttcctcacctcctcccgctccagctccagctcgtctctctcctcgcctcgcgtagggtttcgcttcccgtctcgccgccgtcagcatgggggacaactacgatgacgaaggggagccgatcgtgaacctcgacgaacgggaaccctcccctgagcatcagccgtacgaagacctcgatgacgacctcgacggcggcggcgattggacccgcgaccgctctccgacccccgtccacggagacgacggcggggcagggtcctcctccaagccccgaaagcgccttctcaagaagggcggcggtggaggcatgcccggagatgacgggctggatgactttgggttggaggacgaggacgcggacccttcgggcctgaggcgaggaagaagaaggtctcgtcgtcgctgagggacctcgcgaggagcggggcggccaggcagaagaagctaaaaatgcnnnnnnnnnaccccacggnaagatttacgaactctgcgatcggtagggatacgttgccgatcagcaagaacggactgacgatgcaggttaaacccttgatgatggncagagtggatatcacgagctctgccatactat

SEQ ID NO: 28155 - protein, 106 aa, Zea mays
  misc_feature: Ceres CLONE 1402099-F
MGDNYDDEGEPIVNLDEREPSPEHQPYEDLDDDLDGGGDWTRDRSPTPVHGDDGGAGSSSKPRKRLLKKGGGGGMPGDDGLDDFGLEDEDADPSGLRRGRRRSRRR

SEQ ID NO: 28156 - DNA, 664 bp, Zea mays
  misc_feature: Ceres CLONE 1402103-F
cgcggtggcggccgctctagaactagtggatcccccgggctgcaggaattcgcacgagaccattacctagaacatcctaatcgaaaagtcgtaagtctgcgctttcatcccttattgttccaggaacaaacaaaatctacaggtttccaagacaccaggacggagacatcgaggaggcggcggagacgccgccgcgtccttccgcttctgagccgtataacaacaaacccctcggccccgtcccctctgtccatcgatcaccttgaccacgtgcctgtgccgcaggccgcagccaggcatctccggcgaatctggtttgaggcgcggagagaggatatttgcatgcgggactgatcaatcaaagcaatggcagtagcgcccatggactggcggtgctggttcgattagtctaggccacaaggttttatggccgtttcggagtacccaacagcagtagattgcgatgggtgggatatgacaggaaacaagggacagatcagttgattgctagagccgtatcccgtggatcggacacaactagacttctcgaatccggacggggaagacgcagttttcaagaggatttcgataagcgcttcagcttgcacacttgacagatgggtaattgatggtggaaccgaggccaactaactttttctctcaa

SEQ ID NO: 28157 - DNA, 737 bp, Zea mays
  misc_feature: Ceres CLONE 1402104-F
  misc_feature: Encodes the peptide sequence at SEQ ID NO. 28158
tcaccgcggtggcggccgctctagaactagtggatcccccgggctgcaggaattcgcacgagaccattacctagaacatcctaatcgaaaactgtgaggctcaccaaacaagcctgctactttcttcttgggaggttccttttctcccaataccatcatgaaagaatgaatgactttgtaacaccttaccagctgaccctcataaaataaaccaactaccattccggtactcacctctctctgtcccattctcgcctcgcagagcagctgtatctgggacattgactaccgccgcatacgagcacgtggcgctccgagggcatcgacagtgctagtcacttcaatggcgagctgcctgcaccaccgcgtcacgacctcaaccaagaccagcgccacttcatcatgttcgcgccattctgcaacaggtgcctgtgcatggcaggacctcgccgcagcgctgctgccgcccaagaggataaattcaggagacctgcctcatgcgacctgggcgacgacctggtctttgaggactacctgtacagcatgaacaacgcgctgctcgaccggctgtggtcaccaaagaggctgaacgccgacaaggcgctgacggacttcctcaacgcgctctgatggactactccgcgaaactgaagaacgactacagagccagcacgtcactgctggctccgtagctgcacttgcccgagctcagagtgcgtagatgcttcaccaggtac

SEQ ID NO: 28158 - protein, 75 aa, Zea mays
  misc_feature: Ceres CLONE 1402104-F
MFAPFCNRCLCMAGPRRSAAAAQEDKFRRPASCDLGDDLVFEDYLYSMNNALLDRLWSPKRLNADKALTDFLNAL

SEQ ID NO: 28159 - DNA, 600 bp, Zea mays
  misc_feature: Ceres CLONE 1402105-F
  misc_feature: Encodes the peptide sequence at SEQ ID NO. 28160
  misc_feature (49)..(49): n is a, c, t, g, unknown, or other
  misc_feature (156)..(156): n is a, c, t, g, unknown, or other
  misc_feature (247)..(247): n is a, c, t, g, unknown, or other
tggagctccaccgcggtggcggccgctctagaactagtgggatcccccngggctgcaggaattcgcacgagaccattacctagaacatcctaatcgaaaactaatcgagcatcgcagagataggcgtcttcgtactcgcctacctccgcggctcanacctttcccccttctcccaattccctccgtcggccgccgctccatcccgtacgacgacaccatgagggagtgcatttcgatccacatcggncaggccggtatcccagtcggaaacgcgtgctgggagctgtactggcttgagcatggcattcaggctgacggtcagatgcccgggtggacagaacattggggggaggggatgatgcttttcacactttcttcagtgaaactgggtgctgggaagaccgggccccgggctggtttttgtgaccttgaccccttgtgcctcaatgagggggggaatggggaccttaaccgccagggttttttcccccctggaggaaggtttttttccttggggaagggggggggggccccacaactttttggcccgggggccaaaccccctttggaaaagaaaaattttttcccccaaggccctgt

SEQ ID NO: 28160 - protein, 127 aa, Zea mays
  misc_feature: Ceres CLONE 1402105-F
MRECISIHIGQAGIPVGNACWELYWLEHGIQADGQMPGWTEHWGEGMMLFTLSSVKLGAGKTGPRAGFCDLDPLCLNEGGNGDLNRQGFFPPGGRFFSLGKGGGAPQLFGPGAKPPLEKKNFFPQGP

SEQ ID NO: 28161 - DNA, 667 bp, Zea mays
  misc_feature: Ceres CLONE 1402113-R
  misc_feature (624)..(624): n is a, c, t, g, unknown, or other
  misc_feature (655)..(655): n is a, c, t, g, unknown, or other
cgaattgggtaccgggccccccctcgaggtcgacggtatcgataagcttttttttttttttttttgtcgaggaaaatgaaatttgggacgatccttgggatcgattgaaagaacagataaatcaacagttcgttaattacatattgcaagtccttacaggtagaattagcgaaagcttgaaatactagcaaaggcacgtgcgaacgtacgtcaaaatttggcaacgtacacatatataggcggaagttaaatcaaatgcatgccatccatggtacgtacggccggtcaggtgccgcgcgcgcgctcatcgtcacaactccatcagaggacagagatccggccatcaggggcatgccgggttgtgtcccgggccaccgtagtagaagtgggttccccagcctccgcgggcggagtgctggccgccgtcgtcgtcgtcgtcgtcgtaggccttgcgtatgtcgtagcaggcggggtcctcggccagcgcctggatggcgtcaagcgccacctcggccaggctgttgtcggcgtccaccgtcctcaggtttgcggaaatagctggcggggccgaagccccccggcggcgaaaccgccccgagccccatctgcgtggggggtgttganccccaaccgagggcctgggggtccaaccacnttcgcccgcccc

SEQ ID NO: 28162 - DNA, 701 bp, Zea mays
  misc_feature: Ceres CLONE 1402113-F
  misc_feature: Encodes the peptide sequence at SEQ ID NO. 28163
  misc_feature (701)..(701): n is a, c, t, g, unknown, or other
cgctctgaactagtggatcccccgggctgcaggaattcgcacgagaccattacctagaacatcctaatcgaaaaagcagagggccatcttctactcttctctcccagccaacccccttgtccgacggttcatgcctgctcaattttagtgaccagttacggcaaatgcagccctcggcggacagaaggaagaagaagcggcgacggcgcaggaggaagacgttggagctatgctactcatcgagacctgctgccggcccccatcaaggacagaggcagagcaactcctctatccccgtgagacggcaccagaatcggcagcctcgtggcaagaacacccttcgcgtactcgagcctgctccagctacctcgcctcctctgactgcgcgcccatcgaggtcgtccatctcgagacccagaagcacctgacggtgctcctcgacatgatcgcgctcatctctcgtcctgccctctccctcctctcgcgacggcgtcccgctgcacgacgccccgcacgatgacaaggatccatactcacccgtggagtacctacgagaccgccgagctcttcattgagagccaccacggccacatcatcgactgcgtggcgagaaactacttacacagcctgtagcagccgctcatttgtgccacgccgtggagactaacaccgaccacgagcccgagaagcgtctcgtccan

SEQ ID NO: 28163 - protein, 87 aa, Zea mays
  misc_feature: Ceres CLONE 1402113-F
MQPSADRRKKKRRRRRRKTLELCYSSRPAAGPHQGQRQSNSSIPVRRHQNRQPRGKNTLRVLEPAPATSPPLTARPSRSSISRPRST

SEQ ID NO: 28164 - DNA, 632 bp, Zea mays
  misc_feature: Ceres CLONE 1402117-F
aaagctggagctccccgcggtggcggccgctctagaactagtggatcccccgggctgcaggaattcgcacgagaccattacctagaacatcctaatcgaaaactcttgatccgagccgccaccaaaccctaactatctaaaacccccgtctcgctgtccgatggccgccgcctcgccgccgccctccccaccccacgcaaagcgccccaagatgtcctcctcctccgacccggtaagccagaatgctgagccccaacctcggggcctttcgaccgcgttgaaggcgcgaatctgcgcagggtcttcaaggacaagcgcgcaaggtcgcatcttctcggtactgggggcggggtatcagggcttgcgaaaaaattcgggggcgcgcccccttaggggggggacccccagggggggggcttttccacgggggggccggggcccaaaggaaaaggtcccccccccccctttaaaatggggaggggggggggggccacaccaaaagggtccccccccccccccaaagggggggtgggggtttttttatataacccccgggtgttttatttttttttgtaagaaggtttcctcccccaaaaaaacccccccaaaaaataggggggggggaaaacaac

SEQ ID NO: 28165 - DNA, 710 bp, Zea mays
  misc_feature: Ceres CLONE 1402125-F
tccccgcggtggcggccgctctagaactagtggatcccccgggctgcaggaattcgcacgagaccattacctagaacatcctaatccaaaaagagggtggcgcacctgcgtcactcggtccgcgctgccgcgatctcctctgacggcgaaatcgcccggtggatgacacatgtccaacggacggggtgggaggcgagaacaagacctcgtggacttttgcgagcgacttctgatggacgagcgccgagctcgacacgcctgccatgagtctaatccgacagagccatataccatcatacgttctcctaccttccctcctgcgtctccttgatctacttttcgttaatcggcatgtctgctgctcgctgtatcacatgtgattacgacgagctcgtgcccgaatccggccccattgataggttggacaacccgattttgaactgaaaacacacagctatcggcattaagctcacgcaacacgtgacctgtgctctcagatcttcacgtcttttactctctgaaccgctcgctctagccaaggcctggaaatgaacttttgcgtagtctcagcatgcgtcttctgcttaccttgattgttgcaggattcgttctctagagctcccaagtgatattaccatccagggtggggaggcaaccttctacttgcaacagctctggatgcgatcgaggcgcgccaatataaccgcgaa

SEQ ID NO: 28166 - DNA, 667 bp, Zea mays
  misc_feature: Ceres CLONE 1402126-F
  misc_feature: Encodes the peptide sequence at SEQ ID NO. 28167
  misc_feature (589)..(589): n is a, c, t, g, unknown, or other
  misc_feature (656)..(656): n is a, c, t, g, unknown, or other
  misc_feature (667)..(667): n is a, c, t, g, unknown, or other
tggagctccccgcggtggcggccgctctagaactagtggatcccccgggctgcaggaattcgcacgagaccattacctagaacatcctaatcgaaaactcttcgtctccttcgtcgtcctatcttataatcgcatttcgaaatccccaaacggaagcatcgccactcttccgaacctgaacaatcaccaccgttattaagaagatgatgcgctgcgctgcaacgggcggcgggtgcgtcgcttcgtgtagcggcgatcggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattcattggagaaggttcaagttaaatcctcaggacatgttctgccatatgttggcgttgcttgtttgggggctaattctgtttggtaccatccttggtgtggtcaatggcgcacttgaatatctcgccaaggnatcttgggattgctgaaaatgtgcttgcagggggggggtgggtggttagcacatccttggtgtggcnacaactagtcn

SEQ ID NO: 28167 - protein, 133 aa, Zea mays
  misc_feature: Ceres CLONE 1402126-F
  misc_feature (129)..(129): Xaa is any aa, unknown, or other
MMRCAATGGGCVASCSGDRRLPAVNPCSVRMPTGNDGWCAGLRSRAADLAGLEMANLRGGVGGLFRASPRYGRLQATAAVDPEDIHWRRFKLNPQDMFCHMLALLVWGLILFGTILGVVNGALEYLAKXSWDC

SEQ ID NO: 28168 - DNA, 679 bp, Zea mays
  misc_feature: Ceres CLONE 1402129-F
  misc_feature: Encodes the peptide sequence at SEQ ID NO. 28169
aagctggagctccccgcggtggcggccgctctagaactagtggatcccccgggctgcaggaattcgcacgagaccattacctagaaacttccttagctaacttcccagccccgacaccttggccgccgctccgtgcgcacccagttgctgaggttgcaacgctgcagccggcgaggatcggatgaaccaccaacccctcctataaatcctaaccgagtcctctgcttctgctctcatccatctgtagagtgcaacatgcagtgccccatggacactgctgctagtggaacctcgccagtgatgcaattccatagcaatgctgatgagtctatcgcccattcatctccattggcaacattaatacaacgttcacagcgccattgctatggggatggatccccaggcgaatttccccttgctgtgagcccctccattgttctccatgtgctctcatcttgtgatctaggtccgaaagatctcgccaatctggaggctacatgcgtatttttcggcaaacctgcaagttttgcaccagactttgcattgtcacttcgggagcttggcggattttgatatgggcccaaaaagggaccattgtttaaccccatgaaaccagaaatcccggggggggcggaaaacaccgtgggggaaaggctcttggaaaacatggtcttgggca

SEQ ID NO: 28169 - protein, 105 aa, Zea mays
  misc_feature: Ceres CLONE 1402129-F
MQCPMDTAASGTSPVMQFHSNADESIAHSSPLATLIQRSQRHCYGDGSPGEFPLAVSPSIVLHVLSSCDLGPKDLANLEATCVFFGKPASFAPDFALSLRELGGF

SEQ ID NO: 28170 - DNA, 600 bp, Zea mays
  misc_feature: Ceres CLONE 1402131-F
  misc_feature (186)..(186): n is a, c, t, g, unknown, or other
  misc_feature (231)..(231): n is a, c, t, g, unknown, or other
  misc_feature (232)..(232): n is a, c, t, g, unknown, or other
tggagctcaccgcggtggcggccgctctagaactagtggatcccccgggctgcaggaattcgcacgaaccattacctagaacatcctaatcgaaaaaatcagtgctcgctagcccaccacgccctgaacctagcccggacaccagccagaacaggccatgtccatgggctccccggtgcagctcangcggctgaagcctctgtaccagttcgtgggtgaacacatcctggnncatcgtggcgtgccgtcggccaccggcggtccttgctcaaggcgtcgtcgcttcgggccccagaaaatcctgggggctccgggccggggcaacctggtccttggcccgggtttctgccttgcccggggcccaggtgggttttaccctgatggttccggccccgccccgggggaaacctggggggaataaacgggggttttcccaccaaacccccaattgggccgggtccccgtttttcgaaaatttcctggagaacttccccccgggggggggccggggttttttaacaaaagggacaagccccgcgttttttaacacccctcccttttgataaagagccctgggttttcctaaaaaaaaaaaaaaaa

SEQ ID NO: 28171 - DNA, 627 bp, Zea mays
  misc_feature: Ceres CLONE 1402138-F
  misc_feature: Encodes the peptide sequence at SEQ ID NO. 28172
gctctagaactagtggatcccccgggctgcaggaattcgcacgagaccattacctagaacatctaatcgaaaatttttagtcccatcggctcggatccgcccgcccgccgtgcgcgcgtgcacgcacgcactcctcgtgagcatatggggctggcagtggcggtggtcaggcgtgcgacgcagcgggccggtgcctcccgttctcgctgcgctggtaagagacccactgccgccgagccccgacaccaccggcaccgcacggaggtaagaaaagaaagaaatcccgggggatcacgtggttatgagctaccaaattcagacacgagacaaacgctggaggcggaccacactagaactagaaccctctctactggtctactactctacgccccatcccgaccggaccgtgaccggacccaccttcctccacctctctgcccgccggcggacgacgccaatggcggtggcaaccatataatagcccgagcaacggcgtcgtcgcagggcattacggggacgaccgcaccacggcgtttcagcggcacggtgtactcgccgttacggaccacggtggcgctctcgctgggtcttcaggccatccacttcaccgccttcctcgcccccccc

SEQ ID NO: 28172 - protein, 161 aa, Zea mays
  misc_feature: Ceres CLONE 1402138-F
MGLAVAVVRRATQRAGASRSRCAGKRPTAAEPRHHRHRTEVRKERNPGGSRGYELPNSDTRQTLEADHTRTRTLSTGLLLYAPSRPDRDRTHLPPPLCPPADDANGGGNHIIARATASSQGITGTTAPRRFSGTVYSPLRTTVALSLGLQAIHFTAFLAPP

SEQ ID NO: 28173 - DNA, 658 bp, Zea mays
  misc_feature: Ceres CLONE 1402141-F
  misc_feature: Encodes the peptide sequence at SEQ ID NO. 28174
  misc_feature (123)..(123): n is a, c, t, g, unknown, or other
  misc_feature (370)..(370): n is a, c, t, g, unknown, or other
  misc_feature (396)..(396): n is a, c, t, g, unknown, or other
  misc_feature (405)..(405): n is a, c, t, g, unknown, or other
  misc_feature (406)..(406): n is a, c, t, g, unknown, or other
aaagctggagctccccgcggtggcggccgctctagaatagtggatcccccgggctgcaggaattcgcacgagaccattacctagaacatcctaatcaaaaacccacgagtacaaacagcggcngctcgcctccacgcgagccaagcgcccgcaaaaccctagccccgcccgccccaaaccctaggcggctacggtctccgatcccggggtcacgtcctaatggcatcttcgccggacttgttccccaacgttaccttctccgacgtctccgaagccgcagcagggcctgcggccgagggggccaccgccgcgttcggtctcggcgccgccactggagccccgcgcctcagcctcgtgaagggcgaggcgnagccccacggtcgagatcgacctcgncgacgcganngtatttaagttgggacccgacggatgggctgtgtgtgtgcgacgagtcggaggctaaggatggcgtgggaagagaaatcaattttcagagcaaatataagggtggtcttaagacagaaagctgagaaagaaaggcctctcctttaattttttcaccgatggcacaaccaggtaattaatgggaaaaccgggtggaacggcttgaaaaaaagaatcaataatttggtttcgaaaaacaaattcgaaacaaaaa

SEQ ID NO: 28174 - protein, 64 aa, Zea mays
  misc_feature: Ceres CLONE 1402141-F
  misc_feature (51)..(51): Xaa is any aa, unknown, or other
  misc_feature (62)..(62): Xaa is any aa, unknown, or other
  misc_feature (63)..(63): Xaa is any aa, unknown, or other
MASSPDLFPNVTFSDVSEAAAGPAAEGATAAFGLGAATGAPRLSLVKGEAXPHGRDRPRRRXXI

SEQ ID NO: 28175 - DNA, 703 bp, Zea mays
  misc_feature: Ceres CLONE 1402142-F
tccccgcggtggcggccgctctagaactagtggatcccccgggctgcaggaattcgcacgagaccattacctagaacatcctaatcgaaaactagtttcatttcctgctgttccagccgctcacccaagaaccggtcgtcaggagcttggggcgaccgagctattctattctccttgttccttttggccggacgcccctttactccttctttgcttctttgcttctattttttttcctttcttgcatctggccgctaggtactctttctctctttctgattttttttgttctagcagctggccgctagattctcttggctgacctctcttttctctctttttttttccaaatctgatccggcttctggacgcgtgcttagggctcacagaaccctaaactgatcttagatttcttatacctgatgtgatcgggtggaatgatatctgccgagctctcatgtataaaatccctttcattagtttactgctattttttacaaaaatgaactcggctcatcacggctactggaactctattcaagatgcggattctgtgctaaatccgactccgagatcctctttctgggtggaactaccggagaaagcgaccgccttcctccaatcgcatagaggacctgatactaggattatgatcgagtgacgtataccacgcgcaagatctagcatcggatttgttgaaccc

SEQ ID NO: 28176 - DNA, 631 bp, Zea mays
  misc_feature: Ceres CLONE 1402147-F
  misc_feature: Encodes the peptide sequence at SEQ ID NO. 28177
  misc_feature (113)..(113): n is a, c, t, g, unknown, or other
  misc_feature (126)..(126): n is a, c, t, g, unknown, or other
  misc_feature (135)..(135): n is a, c, t, g, unknown, or other
  misc_feature (443)..(443): n is a, c, t, g, unknown, or other
  misc_feature (458)..(458): n is a, c, t, g, unknown, or other
  misc_feature (557)..(557): n is a, c, t, g, unknown, or other
  misc_feature (558)..(558): n is a, c, t, g, unknown, or other
  misc_feature (575)..(575): n is a, c, t, g, unknown, or other
aagctggagctccccgcggtggcggccgctctagaactagtggatcccccgggctgcaggaattcgcacgagaccattacctagaacatcctaatcgaaaaacacatattatntgagaccaactangcaacatangaaagcacaataagtgtaccaacaatggcagccaaaatattttgcctccttatgctccttggtctttctgcaagtgctgctacggcgaccattttcccacaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcanggcacaacaactacnacaacttgtgctagcaaacctttgctgctactctcagcaacaacagtttcttccattcaccaactagctgcattgaactctgctttctaatttgcacanncacaactaccattcagncaggtatctgctggctacccccagcaattttcttccattcacccactgacagcttt

SEQ ID NO: 28177 - protein, 121 aa, Zea mays
  misc_feature: Ceres CLONE 1402147-F
  misc_feature (95)..(95): Xaa is any aa, unknown, or other
  misc_feature (100)..(100): Xaa is any aa, unknown, or other
MAAKIFCLLMLLGLSASAATATIFPQCSQAPIASLLPPYLSPAVSSVCENPILQPYRIQQAIAAGILPLSPLFLQQSSALLQQLPLVHLLAQNIXAQQLXQLVLANLCCYSQQQQFLPFTN

SEQ ID NO: 28178 - DNA, 688 bp, Zea mays
  misc_feature: Ceres CLONE 1402150-F
  misc_feature (566)..(566): n is a, c, t, g, unknown, or other
  misc_feature (567)..(567): n is a, c, t, g, unknown, or other
  misc_feature (573)..(573): n is a, c, t, g, unknown, or other
  misc_feature (595)..(595): n is a, c, t, g, unknown, or other
  misc_feature (620)..(620): n is a, c, t, g, unknown, or other
aaagctggagctccccgcggtggcggccgctctataactagtggatcccccgggctgcaggaattcgcacgagaccattacctagaacatcctaatcgaaaaatttccattcctcgctcaccaagccaacagccaaatccaattcgccgacgactctctttattcctcccgctcgccgccgccgccaccgcctgagggcaagaagcgagcgagcgcaccgcggatctccctcccggccccgccgcgcgcaccggtgaagacgacgagcccctcgtgaatggtgggagcccgcgcgacgtccgtcgcctcgcagccgcagccggaggaggcctccttccgcggcttcggttactgcatgcagggctggtaccaccgctgcatcggtctcgacccctgaaccccgccgccacttgcttctttgatttgatttcattcggttcgttcggtgcccctcccgtcctggatctgttgcgcgagagcgcggcagcgcgcgagattcgcccccttctcttctcctaggaagcaggaagcaagccgaccgctcgctgagcgccgccgccgagggnncgtcgncggtgccgatggaagctctggnagggtggagacccgcggcaaggccnggccgccgcgggggcccgacgaccccctgcgcgttcctgggtggacggtgaccgtccttcgggagcgc

SEQ ID NO: 28179 - DNA, 651 bp, Zea mays
  misc_feature: Ceres CLONE 1402152-F
  misc_feature: SWISSPROT Homolog: EC 1.11.1.15 Peroxiredoxin
gctcttcaactagaggatcccccgggctgcaggactccgcacgagaccattacctagaacatcctaatcgaaaaatacattggaaccactacgtcacacttatctatcacacaatggagacctctctctccgtctccagagttatcacttcatccgccttctccaaccccaaaacgctactctcaccaacctccgacttctgcgccccaaacttcttctcccgctccctagctcccgacctctccttaaaatctcatagacgcactgctcctcgatctccgccgtcagatacttcacaacaaccaccatctccgcctccatctccgtcggagataaactccacgactctaccctctcctacctcgatgccgtctccaacgctgccgaaagagacaccgactccaccctaaccgacggcaagaaaaccatcctcatccccgacccgggcgctgtgacgccggcctggtcgaataaacacgtccccgggattctactccaaagtcggagagatcagattcacagggcgggacgtaaccacgcgcgtctcctgggaaccacccgctcctgaagagaggagggaacgaaagaactcggggattcagggaaagcgggaagcagctgttccaaggctaacctttgcattcactgact

SEQ ID NO: 28180 - DNA, 705 bp, Zea mays
  misc_feature: Ceres CLONE 1402154-F
  misc_feature: Encodes the peptide sequence at SEQ ID NO. 28181
  misc_feature (331)..(331): n is a, c, t, g, unknown, or other
  misc_feature (343)..(343): n is a, c, t, g, unknown, or other
aaagctggagctccccgcggtggcggccgctctagaactagtggatcccccgggctgcaggaattcgcacgagaccattacctagaacatcctaatcgaaaaaaaaataggctccccaagaaacccacggacaacagagtagcttaaacacgcgctcgcgtacagcgaagaaatggcgatggcgatgcagccatcttagtccccttccctgatcccctctccctctccttctccatggccgcccctcctctggtgtttgtcgccgctgccatagccgcgctcgccatcttcgtcctcgtcctcgtcgtcttcgccttccggcgatggggtnggtgggcggcgncagcgccgcccgctccaggccgcggcggaggcctcgaccccggtcgctgtccaggaggaggatatagataggcctcttctttccgaaaatcgggacgatcactctagacaaagtaatattttttcttgggaagttctgtaggagaaccttcaaagattcaatcaaataggagtaacatttccgcctagaagtcatgcaattgctgaatacagggaggacttatccagaatgaatgttgtgctacacaaggagaaactcatgtaatcaatattgaaaatgatacttctgaagagtttcgattaggaagcacgttaagacggacatcaccagcaaaattgacaaccctgctgaaagcacaaaaa

SEQ ID NO: 28181 - protein, 59 aa, Zea mays
  misc_feature: Ceres CLONE 1402154-F
  misc_feature (33)..(33): Xaa is any aa, unknown, or other
  misc_feature (37)..(37): Xaa is any aa, unknown, or other
MAAPPLVFVAAAIAALAIFVLVLVVFAFRRWGXWAAXAPPAPGRGGGLDPGRCPGGGYR

SEQ ID NO: 28182 - DNA, 688 bp, Zea mays
  misc_feature: Ceres CLONE 1402157-F
  misc_feature: Translation starting site: 262
  misc_feature: Pfam Name: DUF125 Pfam Description: Integral membrane protein DUF125
  misc_feature (178)..(178): n is a, c, t, g, unknown, or other
  misc_feature (280)..(280): n is a, c, t, g, unknown, or other
  misc_feature (646)..(646): n is a, c, t, g, unknown, or other
aaagctggagctccccgcggtggcggccgctctagaactagtggatcccccgggctgcaggaattcgcacgagaccattacctagaacatcctaatcgaaaaaccaacagaaaacctcgcagctagcagcaagatcttagcacaaacaccacagcccacaggctgattaatcactccnagactaatcaaacgaacgcttagctaatagcgcgcgatcttttttccccctccccctcttgagtcttgagcgtgcgagaagagatggcgctgaacggcggcnagacgacgttggtgcaggacgaggagaagcagcagcttctgctggagaagcacaccgagaagcacttcacagcgggcgaggtggtccgggacatcatcatcggcgtctccgacggcctcaccgtgcccttcgcgctcgccgcggggctgtccggcgccaacgcctcctccgcgctcgtgctcaccgcggggctcgccgaggtcgccgccggcgccatctccatgggggctcggagggtacctggcggcgaagagcgaggctgaccactacaaccgggagctgcagcgcgagcaggacgagatcgaccccgtccccgacgtcagggccgccgagatcgccgacatcctgtcgcagtacggctggggnccgggaggagaccgggcccggtggtgacctccctccgcacaa

SEQ ID NO: 28183 - DNA, 648 bp, Zea mays
  misc_feature: Ceres CLONE 1402158-F
  misc_feature: Encodes the peptide sequence at SEQ ID NO. 28184
tggagctccccgcggtggcggccgctctagaactagtggatcccccgggctgcaggaattcgcacgagaccattacctagaacatcctaatcgaaaaatacaaaaaacagttcttcctctattctattcttacatggtatcagccgcctagatcctgccttcctctcttttgcgtccgacatgagtgatacgcagagttcattttccagcactactgctgccgtttcttccaccaccgctcttcctctctctcaagctatacacagcgtgaacatcaaatcgcttgtgtcgtacattcttgatactcaagttcacaactacggcaaatggagccaactcttcaccattattctcggtcgcttcgatcttctccaccatatcactacctctgatgttttctcggatgatcctgcctgggtccgtgagaacctcacagttctctcatggatcttcgccactatctatgaagacctcgtcgacatggtgattcgtcccgcccggtcgacgcgcacacgccatctggcgtcatctgtgcgacatcttctccgcaacaaggccagtcgtgccgttcatcttgaggctgcattccctctctaccccaggaagatctttcgcgcacgattatggcatcgccttcacagctgccaa

SEQ ID NO: 28184 - protein, 156 aa, Zea mays
  misc_feature: Ceres CLONE 1402158-F
MSDTQSSFSSTTAAVSSTTALPLSQAIHSVNIKSLVSYILDTQVHNYGKWSQLFTIILGRFDLLHHITTSDVFSDDPAWVRENLTVLSWIFATIYEDLVDMVIRPARSTRTRHLASSVRHLLRNKASRAVHLEAAFPLYPRKIFRARLWHRLHSCQ

SEQ ID NO: 28185 - DNA, 696 bp, Zea mays
  misc_feature: Ceres CLONE 1402161-F
  misc_feature: Encodes the peptide sequence at SEQ ID NO. 28186
cactttgtagctctcttaggtggcggccgctctagtatagtggatcccccgggctgcaggaattcgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggtaccagcgggtggagaagccgccgcccgaggccgccgccatcggcgagaatgagatccgcatcaccactcagggcctcgtccgcaactacgtcacctacgccacctccctcgtccaggaaaaacaggtgaaggaaattgtgttgaaggctatgggacaggctataagcaaggcagtggctattgctgagatcataaagaagaggattcctggtttgcatcaagatacaataatcagttctgtcagtattactgatgtatgggagcccattgaggaaggacttgtaccattggagatgactcgtcatgtttcaatgatatcgatttccttgtcacctaaggagcataacaagaattcacctgggtatcaagctcctctacattcggatctta

SEQ ID NO: 28186 - protein, 133 aa, Zea mays
  misc_feature: Ceres CLONE 1402161-F
  misc_feature (18)..(88): Pfam Name: Alba Pfam Description: Alba
  misc_feature: SWISSPROT Homolog: EC 3.1.26.5 Ribonuclease P
MDRYQRVEKPPPEAAAIGENEIRITTQGLVRNYVTYATSLVQEKQVKEIVLKAMGQAISKAVAIAEIIKKRIPGLHQDTIISSVSITDVWEPIEEGLVPLEMTRHVSMISISLSPKEHNKNSPGYQAPLHSDL

SEQ ID NO: 28187 - DNA, 636 bp, Zea mays
  misc_feature: Ceres CLONE 1402164-F
  misc_feature: Encodes the peptide sequence at SEQ ID NO. 28188
aaagctggagctccccgcggtggcggccgctctagaactagtggatcccccgggctgcaggaattcgcacgagactattacctagaacatcctaatcgaaaaaagtcgccccaggcgacgaggcgaggtgcgtgcaattccgtagctgcaacgaactccctcgaccgaatcgcccgctgctcctctatccctttcctgctgctgctactaccttaagactatcactatcatggccttgatgctgctagcgcgcaacctgcgctcccgcctccgcccaccgctcgccgccgccgaggagttctcgtcggccgcggcggaggcggatagggcgatacgggacgggccgcggaacgactggagccggcccgagatccaggccgtctacgactcaccgttcctcgacctcctctttcacggggctcaggtccacagaaatgtccataaattcagagaagtgcagcaatgcacacttctttcaatcaagactggtggatgcagtgaagatagttcttactgtcctcagtcatcaagatacaacactggatttgagggccataaattgatgaacaaagatgctgtcttgcaagcagcaaaaagggcaaagagtctgggagcatccgtttttgcatgggagct

SEQ ID NO: 28188 - protein, 135 aa, Zea mays
  misc_feature: Ceres CLONE 1402164-F
  misc_feature: SWISSPROT Homolog: EC 2.8.1.6 Biotin synthase
MALMLLARNLRSRLRPPLAAAEEFSSAAAEADRAIRDGPRNDWSRPEIQAVYDSPFLDLLFHGAQVHRNVHKFREVQQCTLLSIKTGGCSEDSSYCPQSSRYNTGFEGHKLMNKDAVLQAAKRAKSLGASVFAWE

SEQ ID NO: 28189 - DNA, 650 bp, Zea mays
  misc_feature: Ceres CLONE 1402165-R
caattgggtaccgggccccccctcgaggtcgacggtatcgataagcttttttttttttttttttataatagcaatgtcttatattaactcagtgtagacatacaatgcagtgtcacctatcacgaaaccatgattagtaggcgtaaagatcactcggccctggatctttaaagcaatcaccctctaacttactggtattataatggtcacatctcataccagcaaaaaacatagcttgaacgtccagagttggtgctaggaatttgaactcaccagtttcagcgggcctgcaatttttgttacctctgttttttgcctaagcaactcttattctcttttagataactcaaccgctaaaatatctagctgtagaattatgaaactattgaggagtccacaaaagtgataaattcaatacataggagccatcaaattcaaaagtagtttttcccttgattagcagaacctacttatccctcaattagctggccctaaaatataatgtgcaacacgtgggtgctgaagcctgaaggaaaggtcccagtccttgctcttcagattgcacaacccctcgttcttgcatatcccaacctccaggtcaaaaactattacagtttttcttgcccatattgatgctaaatctgggacat

SEQ ID NO: 28190 - DNA, 688 bp, Zea mays
  misc_feature: Ceres CLONE 1402167-F
  misc_feature (458)..(458): n is a, c, t, g, unknown, or other
  misc_feature (504)..(504): n is a, c, t, g, unknown, or other
  misc_feature (505)..(505): n is a, c, t, g, unknown, or other
  misc_feature (554)..(554): n is a, c, t, g, unknown, or other
  misc_feature (655)..(655): n is a, c, t, g, unknown, or other
  misc_feature (657)..(657): n is a, c, t, g, unknown, or other
tggagctccccgcggtggcggccgctctagaactagtggatcccccgggctgcaggaattcgcacgagaccattacctagaacatcctaatcgaaaaaattttctcagtctcgagcgcccgcgtccctcgccccgtcgcgactcgcgacttcgcgagtcgccccgtcccagcctcccagccgtcccggctccccgcgaccccgccctccggcagtccggcgcgggggctcctctccgatccggtgagccgaacgaggatcccaactccccgaagaaagcggccacagccagagccagggtggctcggctctcctctcacagactgcgccgcagcgcctagcgctcggctggcagccgctccggccggtcggccccgcgcccccgcccctgctgcctacatccgcctgcagccagaagatctgcctccagcgaccgccctgcctgccccttgtggcttnctgtggttctgcacaccagcacacgcatttgtccccaaacaacggnnggcggcgatgagtatctcagaagagttcccggcgaaggatctgacggtnaaaaggaggaggtcttcatcaacgaggaggacatcatccacgagataaccatccgacgaagaagatctcccgaccgcgacgacaaaaaaaggacgacgcgncnacacggggatatgtttgatttccgaaagacc

SEQ ID NO: 28191 - DNA, 754 bp, Zea mays
  misc_feature: Ceres CLONE 1402171-F
  misc_feature: Encodes the peptide sequence at SEQ ID NO. 28192
  misc_feature (739)..(739): n is a, c, t, g, unknown, or other
ggagctccccgcggtggcggccgctctagaactagtggatcccccgggctgcaggaattcgcacgagaccattacctagaacatcctaatcgaaaagagcaacccggcgaaagccccccataccctcgcaccctaaaacagcggcgcacaagatgtccgacgaccccaccaacggcggcggcggtgatcgcgtggaggacgtcgtccgcaccgagggtgaaacacaacctcgtgatgatggcttgtcgaaatccaaggatagggacaaagatagagaaaaggactaggacagagatcgtcgcagagaccgtgacagagatcgagggagagacagggaccgtgatagggacagggacagggatcgggacagagacaagaatcgcctaagtaggcatcaccgtgaaagacgggaacagcgagaccgtcctgatgatcacagagtccgtgattctgaaagaagaagagaacgcgacaaagatgggcatcgtaggcatcgttctcggtctcgttcaaggggtagagatcgaagatctaggtcacgttcaagaagcaagcgagttagtggattcgatgcgccacccccgcaagcaatgggttcaacatttccagttattccaaccccaagtcagtaccaggctcttcgcttcctaacattggtggcatgtttccaaacatgctcactttcgatgttgctgggcagccacaagcaatgactcaacaggctactcgtcatgctcgncgtggttatgtcggt

SEQ ID NO: 28192 - protein, 44 aa, Zea mays
  misc_feature: Ceres CLONE 1402171-F
MSDDPTNGGGGDRVEDVVRTEGETQPRDDGLSKSKDRDKDREKD

SEQ ID NO: 28193 - DNA, 733 bp, Zea mays
  misc_feature: Ceres CLONE 1402176-F
  misc_feature: Translation starting site: 368
  misc_feature (21)..(21): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (31)..(31): n is a, c, t, g, unknown, or other
  misc_feature (32)..(32): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (49)..(49): n is a, c, t, g, unknown, or other
  misc_feature (50)..(50): n is a, c, t, g, unknown, or other
aaaaccccacaccacaccccncccnnnccannccgcnntnnggaaattnnacaaagctggagctccccgcggtggcggccgctctataactagtggatcccccgggctgcaggaattcgcacgagaccattacctagaacatcctaatcgaaaactctcttcttccaccaccacctcctactccgctgcaaccccaaatctctccttcctcgcatacgcgcgcagcggaggagctgagaccaacgaagaagaagaagaacaaccgagcaagcacaagcttagctagcgtgtaggtgtccaaggcgacgacggccgccgcgccaggctagccaaccagctgctcatcgctcctagctgcggagccgatatggctggcgccgacgtcgacgtcgggacggagctccgtctcggtctgccgggaggaggcgccgatgcggccaaggctgccaagaggggcttcgaggacaccatcgacctcaagctgaagctgcccaccgccggcatggaggaagctgccgccgccgccgccgccgccgccaagcccgagccggcagccgagaaggccaagaggcccgccgaggcgccggccgctgatgccgagaagccacccgcacccaaggcacaaggctgtgggttggccaacagttcggtcataccgcaggaacgtcctgaccgtcctgtctgtgaagagcacaaatgaagaggagcccgcacaaccaccagcccgctgcca

SEQ ID NO: 28194 - DNA, 469 bp, Zea mays
  misc_feature: Ceres CLONE 1402177-F
  misc_feature: Encodes the peptide sequence at SEQ ID NO. 28195
  misc_feature (99)..(99): n is a, c, t, g, unknown, or other
  misc_feature (273)..(273): n is a, c, t, g, unknown, or other
  misc_feature (354)..(354): n is a, c, t, g, unknown, or other
ccgctctagaactagtggatcccccgggctgcaggaattcgcacgagaccattacctagaacatcctaatcgaaaataccttcaataagaatggctccntgatatttctggatttgtcatttaatcagcttgactcaaagatcccaaaggagcttgggaacatgtactacctcatgatcctgaatcttggccacaacttgctgtctggcgtcatcccaccagaactagctggtgccaagaagcttgctgtactcgacctgtcacacaaccagnttggagggcctattcccactctttctcgacgtgtccttgtcgaaaaatcaccttccaaatatcattgaatgttcaattccnaactcggttcgttttacattccccaaaattttcaaaggaaaaaaaaaaacccctggggctttttgggggttccccccctgttttcccgggggggaaaaaaaagtttgtttttttt

SEQ ID NO: 28195 - protein, 59 aa, Zea mays
  misc_feature: Ceres CLONE 1402177-F
  misc_feature: SWISSPROT Homolog: EC 2.7.11.1 Non-specific serine/threonine protein kinase
  misc_feature (38)..(38): Xaa is any aa, unknown, or other
MYYLMILNLGHNLLSGVIPPELAGAKKLAVLDLSHNQXGGPIPTLSRRVLVEKSPSKYH

SEQ ID NO: 28196 - DNA, 710 bp, Zea mays
  misc_feature: Ceres CLONE 1402181-F
  misc_feature: Encodes the peptide sequence at SEQ ID NO. 28197
tggcggccgctctagaactagtggatcccccgggctgcaggaattcgcacgagaccattacctagaacatctaatcgaaaactccactccctcccccccgcctccactaccccactcccaggcgccgcacaggtacgtcgccggcggcgatgacgacgcgcttcaagaagaaccgcaagaagcgcggccacgtgtccgccgggcacggccgcatcggcaagcacaggaagcatcccggaggtcgcggtaacgccggtggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccgaaaaggcggcggaagccggcggcgacaaggccccgcagatcgacgtcacgcagttcggctacttcaaggtgctcgggaagggggtgctgccgcccaagcccatcgtcgtcaaggccaagctcatctccaaggtcgccgagaagaagatcaaggccgccggcggcgccgtcgtgctcacgaagcttggggaggcgagcaccccgatccggcgaggtgccgcgagcgaggcagcgatgagaggccgtgcgtcccatctccgcgcgctcctctcgcgagcgctctctccaagccttcctcctcctggtcgc

SEQ ID NO: 28197 - protein, 187 aa, Zea mays
  misc_feature: Ceres CLONE 1402181-F
  misc_feature (107)..(139): Pfam Name: L15 Pfam Description: Ribosomal protein L15
MTTRFKKNRKKRGHVSAGHGRIGKHRKHPGGRGNAGGMHHHRILFDKYHPGYFGKVGMRYFHKLRNKFYCPAVNIERLWSMVPAEKAAEAGGDKAPQIDVTQFGYFKVLGKGVLPPKPIVVKAKLISKVAEKKIKAAGGAVVLTKLGEASTPIRRGAASEAAMRGRASHLRALLSRALSPSLPPPGR

SEQ ID NO: 28198 - DNA, 685 bp, Zea mays
  misc_feature: Ceres CLONE 1402182-F
  misc_feature: Encodes the peptide sequence at SEQ ID NO. 28199
  misc_feature (387)..(387): n is a, c, t, g, unknown, or other
  misc_feature (440)..(440): n is a, c, t, g, unknown, or other
  misc_feature (518)..(518): n is a, c, t, g, unknown, or other
  misc_feature (520)..(520): n is a, c, t, g, unknown, or other
  misc_feature (531)..(531): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (680)..(680): n is a, c, t, g, unknown, or other
cgcggtggcggccgctctagaactagtggatcccccgggctgcaggaattcgcacgagaccattacctagaacatcctaatcaaaaaacgtctcgtcagtttttttccctttttcccgtggcccgtgggtgtgcgtcctaggtgtgcggcgggcggtgcgccgtgcgcctcctctcctcgccgcgacgctgccgtgttcgcgattcagcgccgtgctcgacgcccctcctcccttcagaagtcagcgccgcatctccggttgcagagacttgcgctgccacctctccgcttttcgtccttcagttgctcgacgcccctcctcccctcagaagtcagcgcagcgtctccactctccacgccgtcgcgtcggcgacgcgggtccttcgnaataaagacggtttgttctcgcatcgggcgtcagccggattcgagggacatanaatgatggaagtccgatcttgggtgccaccacgtcgaagcggcttgtggcctggtgtagatccggcgaaagcgcgagncnaaggcccgggntctggcgtcgtcattggcctccatgaatcttcgtattgccatcgcgctaaagggaacgaannnngcgacgaggtctaaaaactttgatttggatataatgcggatatgaaaatgcatgcactacatgctagaaacctgggcctttgggntgggg

SEQ ID NO: 28199 - protein, 55 aa, Zea mays
  misc_feature: Ceres CLONE 1402182-F
  misc_feature (26)..(26): Xaa is any aa, unknown, or other
  misc_feature (27)..(27): Xaa is any aa, unknown, or other
  misc_feature (51)..(51): Xaa is any aa, unknown, or other
  misc_feature (52)..(52): Xaa is any aa, unknown, or other
MMEVRSWVPPRRSGLWPGVDPAKARXXGPGSGVVIGLHESSYCHRAKGNEXXDEV

SEQ ID NO: 28200 - DNA, 684 bp, Zea mays
  misc_feature: Ceres CLONE 1402185-F
  misc_feature: Encodes the peptide sequence at SEQ ID NO. 28201
  misc_feature (449)..(449): n is a, c, t, g, unknown, or other
  misc_feature (646)..(646): n is a, c, t, g, unknown, or other
aaagctggagctccccgcggtggcggccgctctagaactagtggatcccccgggctgcaggaattcgcacgagaccattacctagaacatcctaatcgaaaacctcgcgcgcacgttctgccgcgcgcatacgcccgcatcccgcagccgcggcagcgccgcagccgctccttccatcctccgccctccttccatcctccgcggatcccagctctccctcccgcgcccgcccgcagccgcaccgcatcccgcagccggcgtcggcgcaacggctgatgctcaaggggtgtgagtcgctgctacagcggcagtgccggccgcgcacccccgcggggtacatggagcccacgccgctaccggttggcggtgaagagcaaggggacagataagcccaaaggcagcaaggggaacgtcgacaaggaccccaacaagcctgactcccaacactntttttgttcgctggtgcttgcggcgaacggtgctggcgaagctctcccgtgctgggcctctgggatgctccagggcaccgggttcggcgaagacgtggagtcacccacacggcggatgcgccgccgtgctttggcttgcagtttcctcgatcgattcaagggaaatattggtcagtgggaagagactggtgaatcanaggcagtcaacgctaaatggggaggcgaagtgcctgct

SEQ ID NO: 28201 - protein, 37 aa, Zea mays; identical to SEQ ID NO: 25346
  misc_feature: Ceres CLONE 1402185-F

SEQ ID NO: 28202 - DNA, 682 bp, Zea mays
  misc_feature: Ceres CLONE 1402189-F
  misc_feature: Encodes the peptide sequence at SEQ ID NO. 28203
  misc_feature (99)..(99): n is a, c, t, g, unknown, or other
  misc_feature (125)..(125): n is a, c, t, g, unknown, or other
  misc_feature (480)..(480): n is a, c, t, g, unknown, or other
  misc_feature (491)..(491): n is a, c, t, g, unknown, or other
ccccgcggtggcggccgctctatactagtggatcccccgggctgcaggaattcgcacgagaccattacctagaacatcctaatcgaaaaatgatgcttnctgccagtttggggtcctttcacatnagatgtccatcctgaaggtagcaacaaaacatgataggatagaggcagaatggtaccattcaattcgcagcaacggttttagaaacaaaatgagtacatacagacaggaggtggtcgtcaaggaattgtctcctttgaaataacccgcctgtctcggcgtggcgcccaaacgcaacggtcctgccaacgagcacctgctctgctctcgccggctctctaacccttccgaatcccctcctcgcaacagcccggcaatcacctgccccacgaccaccaccataaatcaccagacgatggagctattccccgacggggccttcgtgcggctgcagagccgcgcgagaaagacgtacgntcacgccgacngggactgggcgggggtctccctgcggccgaacggacccggtccacccttgaaacgggtgttggcggttggaacatttggtctgggtcgaacaaggggaaacatttcgtcctcctccaaaaagcgcctaagggcggtacttttcttttcaaatcaggaggggccgcccggcaccggggcacgcgaacccccc

SEQ ID NO: 28203 - protein, 88 aa, Zea mays
  misc_feature: Ceres CLONE 1402189-F
  misc_feature (21)..(21): Xaa is any aa, unknown, or other
  misc_feature (25)..(25): Xaa is any aa, unknown, or other
MELFPDGAFVRLQSRARKTYXHADXDWAGVSLRPNGPGPPLKRVLAVGTFGLGRTRGNISSSSKKRLRAVLFFSNQEGPPGTGAREPP

SEQ ID NO: 28204 - DNA, 753 bp, Zea mays
  misc_feature: Ceres CLONE 1402190-F
  misc_feature: Encodes the peptide sequence at SEQ ID NO. 28205
  misc_feature (130)..(130): n is a, c, t, g, unknown, or other
  misc_feature (334)..(334): n is a, c, t, g, unknown, or other
  misc_feature (347)..(347): n is a, c, t, g, unknown, or other
  misc_feature (388)..(388): n is a, c, t, g, unknown, or other
  misc_feature (417)..(417): n is a, c, t, g, unknown, or other
tccccgcggtggcggccgctctagaactagtggatcccccgggctgcaggaattcgcacgagaccattacctagaacatcctaatcgaaaaagcacctccattcccagccacgagacgacgaaaccctangcctccctccccctctctcaccaggccaccacctcgccggaacccggcgcctcgaaggagcacgggatcatcggccgccgtcggccgcggctgcggaggagcggtgtaagatgttgaacggcggcggcggcggccagaagaagcggaacacgaagatcgagccctatcggcaccgcgtagagaccgaccccaagttcttcgacnagtcgtggcggangctccatgacgccatccgcgagatctacaaaccacacgccngcggtctctccttcgaggagctctacggnactgcttatacatggtatttgaacaagtttgctccttcagctcttgagaaactcacagaaaacatgaaagagcatctggaaaaaatgcgcaaatgaatagaagcttgtccaggggggtttgtccctggaaaaattggccgcgaaaatgaatggcccataacagggctttggcatagaataagaaaacccggggggaatgggacgggaattattttccccctaaataaaaaaaccccgggttcccaaaagggggataaaagttttgggagggaaaaaaaaagggggggcccccaatataaaggggagggggtgtgtgggaccccttttggagagtaa

SEQ ID NO: 28205 - protein, 90 aa, Zea mays
  misc_feature: Ceres CLONE 1402190-F
  misc_feature (32)..(32): Xaa is any aa, unknown, or other
  misc_feature (36)..(36): Xaa is any aa, unknown, or other
  misc_feature (50)..(50): Xaa is any aa, unknown, or other
MLNGGGGGQKKRNTKIEPYRHRVETDPKFFDXSWRXLHDAIREIYKPHAXGLSFEELYGTAYTWYLNKFAPSALEKLTENMKEHLEKMRK

SEQ ID NO: 28206 - DNA, 566 bp, Zea mays
  misc_feature: Ceres CLONE 1402191-F
  misc_feature: Encodes the peptide sequence at SEQ ID NO. 28207
  misc_feature (202)..(202): n is a, c, t, g, unknown, or other
  misc_feature (211)..(211): n is a, c, t, g, unknown, or other
tggagctccccgcggtggcggccgctctagaactagtggatcccccgggccgcaggaattcgcacgagaccattacctagaacatcctaatcgaaaaataccgacgcgagcacgcgccgagcaacgtctcgaaaaggccatgcaggacggcggcgaggtgctgttcctggacggcgtcggggaggtcgccgtcaccatcggncgcaacggnctctctgcacggcccctcccacccggactgatctcttcatgttggtcgtccattacactggcagcctaaaatttaaaaaggcaaaatcaatttttcaaaaggttttggccaaaaagaggcttggaaaagggcccaaatcctgggggggccccttgggaaaaaaaaaaaaaatggttttttcgggcaaaaaaaaatttgggagtgcccccccgtttttgtcccccactggggggtttcacccccaaaaaaaggagaacccccccccccccccggggggggccccctgggggaaaaaaaaattttttttgtgggcccaccaaaaaactttttatgaaagaccatctgcccccaaaaa

SEQ ID NO: 28207 - protein, 46 aa, Zea mays
  misc_feature: Ceres CLONE 1402191-F
MQDGGEVLFLDGVGEVAVTIGRNGLSARPLPPGLISSCWSSITLAA

SEQ ID NO: 28208 - DNA, 675 bp, Zea mays
  misc_feature: Ceres CLONE 1402197-F
  misc_feature: Encodes the peptide sequence at SEQ ID NO. 28209
  misc_feature (410)..(410): n is a, c, t, g, unknown, or other
  misc_feature (411)..(411): n is a, c, t, g, unknown, or other
  misc_feature (442)..(442): n is a, c, t, g, unknown, or other
  misc_feature (480)..(480): n is a, c, t, g, unknown, or other
  misc_feature (481)..(481): n is a, c, t, g, unknown, or other
  misc_feature (646)..(646): n is a, c, t, g, unknown, or other
aagctggagctccccgcggtggcggccgctctagaactagtggatcccccgggctgcaggaattcgcacgagaccattacctagaacatcctaatcgaaaaagccagccaggcccaggagcgcgagttctgtgcctgtgcctctgctccacctcccctgcccctgcgccccaagtccacgtccaccactcagcactcacgctgctcgctcgctcgctcgtacacgcgcccgcttcgcgcaggtgcgtgtagaacgacggaggcattccatttccgactgagccatgtgtgtttggatcggacaacccctgccaaaaccgcgtgagccagcgctgttctgcctctgatcgtgtgtgctgctgttggttttggttttgggttttggtttggctagggaaggaaccgtggtgnnggggagcggacggacatgatgcacgccaagntcggagtcggacgtgacgagccttgggcggcgtcgccnnccgccgcggtcgccgaaagcggggccggcggcgccggcaacggcggctactacgtgcagagccccgtcgcgggagtcgcacgacggcggctacaagtcctcgtcgatgcagcccacgccggtctacaacagccccaacgagtcgccgtcgcacccctcctacggncgccactcccgctcctcctccgtcagccg

SEQ ID NO: 28209 - protein, 29 aa, Zea mays
  misc_feature: Ceres CLONE 1402197-F
MQPTPVYNSPNESPSHPSYGRHSRSSSVS

SEQ ID NO: 28210 - DNA, 688 bp, Zea mays
  misc_feature: Ceres CLONE 1402201-F
  misc_feature (479)..(479): n is a, c, t, g, unknown, or other
  misc_feature (578)..(578): n is a, c, t, g, unknown, or other
caaagctggagctccccgcggtggcggccgctctagaactagtggatcccccgggctgcaggaattcgcacgagaccattacctagaacatcctaatcgaaaaaagaacaaaccattgttggacgcgttcccctcctgcacgcaacctcatctcgtcctccagatcctggatggccgtcctccttgataccttgcctcgcgagtgctctcggtgagctactttgttttgatttatcaggaaatccgtttgcttcatgttatgcaggctcagatctgattgctggattcggcatcttacgggcttgaatagagctaggactgggagaaaacaacaaacccgcgttggttcctgtatcggttagtccttgccttcaaggttcatgttgtttttgttttggtggtcgagcatcgcatgttctgcttctggttccagatctggagaaatttctaagtcgtcgtcgctcgtccgtcgtttcggnttcggagcggatctgaggcgacgatggctggagggcggcgggatctctttggtctgcagtcctgtttcacctcgaatggatgatgtctctgcgctgatnattattggatcaatttcgatatttattagtagatctatgagatatgccgcctggaagaggcgaggtaagctgaagcatgtaaaagtctgcgtgcgtcgacagcaaaaaaa

SEQ ID NO: 28211 - DNA, 702 bp, Zea mays
  misc_feature: Ceres CLONE 1402211-F
  misc_feature (358)..(358): n is a, c, t, g, unknown, or other
  misc_feature (382)..(382): n is a, c, t, g, unknown, or other
  misc_feature (408)..(408): n is a, c, t, g, unknown, or other
  misc_feature (438)..(438): n is a, c, t, g, unknown, or other
  misc_feature (439)..(439): n is a, c, t, g, unknown, or other
  misc_feature (447)..(447): n is a, c, t, g, unknown, or other
  misc_feature (470)..(470): n is a, c, t, g, unknown, or other
  misc_feature (504)..(504): n is a, c, t, g, unknown, or other
  misc_feature (509)..(509): n is a, c, t, g, unknown, or other
  misc_feature (510)..(510): n is a, c, t, g, unknown, or other
  misc_feature (525)..(525): n is a, c, t, g, unknown, or other
  misc_feature (526)..(526): n is a, c, t, g, unknown, or other
  misc_feature (588)..(588): n is a, c, t, g, unknown, or other
  misc_feature (599)..(599): n is a, c, t, g, unknown, or other
cgcggtggcggccgctctagaactagtggatcccccgggctgcaggaattcgcacgagaccattacctagaacatcctaatcgaaaaagtaccactgctccgctcatctctcctgcggcggtggaagattaggaattgagcccgcggcaagctcggggagttactgtgaatccatctgattcccacccacccgctcagacgcagctgcattccgcgatcccaggcggcgggaggcggctcttgatgctagagatgctcgctccgcgtcgttctcggcagcagcgacggcgggtaggtggaggcagagggccccggtgagaacagaagtgtcggtgggttctggtgttcccttaccttncgccgcttcgcgagtgctgttctnttccttcagttgtcggcggcaatggncgccgggcctgaggctggcctacccgtggnnggaaaggnatgtccggcggggcacgcccggntggtggtgaccatggagaaccccaactactcggnggggnnaagattgaggccccnnaaggggggaaggcgctcccgggccggagtgcttcccatgaacaaaagggcgggggccgagancgccaagcagnctcacttgggggtggtgctacgtccgcggcccaccggggccggccgggaggccttcgcctcgtgtcgctggccgggacccggggtcgctggccgtgctgccgg

SEQ ID NO: 28212 - DNA, 710 bp, Zea mays
  misc_feature: Ceres CLONE 1402212-F
  misc_feature (236)..(236): n is a, c, t, g, unknown, or other
  misc_feature (627)..(627): n is a, c, t, g, unknown, or other
  misc_feature (628)..(628): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
cgctcttaactagtggatcccccgggctgcaggaattcgcacgagaccattacctagaacatcctaatcgaaaaacgagctctccatcttgccatctgctcctatttctgtcgcgagctggatgagggcatgatacagttcacgggatctggctccccgacggccaattcttcatctcgccttcgaaaacccggtccttgtcgggccgtcggactggagggaccacgccgccggcnaggaaggggtccagaggtaccgcatccgcaacctcccggacaacttccccggcctctacgagctaggcgttgcctgcgcggccgacgagggcgtcaggtcccggaggcgtgacgcgcgaggcgtcgtcgtggtgtacctcggccaggccgactgtgtccgggcgaggctgcagcagtatggacgctcggggtcgcatctggacactacgaactcgccgggctcttctgatagagatgcggcgaatgcgctcgccgagggtcctggactcttcagagaagtgttctccagaggctactccatcgtgtttcgatgtgcgctgatggacaataaacaagaagctgagaagactgaagcactactgctgagagtatatgattatgcatggaacanngcttcaaaaaaaggggnnnnggccttgggtcccccccccccccaaaaaaaaatataaatggggggcggaaaaaaagttgtgt

SEQ ID NO: 28213 - DNA, 725 bp, Zea mays
  misc_feature: Ceres CLONE 1402214-F
  misc_feature: Encodes the peptide sequence at SEQ ID NO. 28214
aaagctggagctccccgcggtggcggccgctctagaactagtggatcccccgggctgcaggaattcgcacgagaccattacctagaacatcctaatcgaaaacctttcgggcagaaagagccagagagagagagagagagaggtcggggctggggagcacacacccatcacccatggactgactgacctccggactctccctgcttccgtcgccgccgcgggccgcccagctgactgctcctgccctccgcccgccctccatggcgtccgtcaagctcggctccaagcctgacgccttcaagcggcaaggccaggcatggttctgcacaacaggacttcctagcgatgtcaccggtgaggttggggatatgtctttccaccttcacgagttccctttactttcaaaaagtgcctttcttgaacggtcaattgaagaaaattctgaccaagaagaatgcatcgtcaaactaaatgacattcctgggggtgccaagtcatttgagctagttgcaaggttctgctatggtgtgaaaatagagctttcacctgcaaatgttgtctacctacggtgtgcctcagagcatctagaaatgactgaagaagtagctgaggaaaacctgattgcacagtcagaaatgttccgtcaccaagtggttctccgtaactggaaagattccttggcagcattggaaacatgtgatgacctactcccccatgctgaagac

SEQ ID NO: 28214 - protein, 155 aa, Zea mays
  misc_feature: Ceres CLONE 1402214-F
MASVKLGSKPDAFKRQGQAWFCTTGLPSDVTGEVGDMSFHLHEFPLLSKSAFLERSIEENSDQEECIVKLNDIPGGAKSFELVARFCYGVKIELSPANVVYLRCASEHLEMTEEVAEENLIAQSEMFRHQVVLRNWKDSLAALETCDDLLPHAED

SEQ ID NO: 28215 - DNA, 694 bp, Zea mays
  misc_feature: Ceres CLONE 1402216-F
  misc_feature: Translation starting site: 380
  misc_feature: SWISSPROT Homolog: EC 4.1.2.13 Fructose-bisphosphate aldolase
  misc_feature (376)..(376): n is a, c, t, g, unknown, or other
  misc_feature (443)..(443): n is a, c, t, g, unknown, or other
  misc_feature (478)..(478): n is a, c, t, g, unknown, or other
  misc_feature (497)..(497): n is a, c, t, g, unknown, or other
  misc_feature (534)..(534): n is a, c, t, g, unknown, or other
  misc_feature (565)..(565): n is a, c, t, g, unknown, or other
  misc_feature (567)..(567): n is a, c, t, g, unknown, or other
  misc_feature (579)..(579): n is a, c, t, g, unknown, or other
  misc_feature (580)..(580): n is a, c, t, g, unknown, or other
  misc_feature (590)..(590): n is a, c, t, g, unknown, or other
  misc_feature (651)..(651): n is a, c, t, g, unknown, or other
  misc_feature (652)..(652): n is a, c, t, g, unknown, or other
aaagctggagctccccgcggtggcggccgctctagaactagtggatcccccgggctgcaggaattcgcacgagaccattacctagaacatcctaaaaaaaaaggtaaggaaggagaagaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgtcaccaggcaggccgccgcgcccaggccgcccaccgtcntccatggtcgtccgcgcctccgcctacgccgatgagctcgtgaagaccgcgaaaacgatcgcgtcgncccggggcggggcatcctgggcgatggacgagcgnaacgcgacgtgcgggaagncggctggcgtcccatcgggctggaggaacacggaggncaacccggcaggcgtacggcacgctgctgtncnacagggcccggnncctgggccgntaccatctccgggctcccttccttcgaaaggagacgctgacccagtccccgccgtcgacgnncggaaaggatcgtgacatcccggggggggagccaggcattct

SEQ ID NO: 28216 - DNA, 821 bp, Zea mays
  misc_feature: Ceres CLONE 1402217-F
  misc_feature: Encodes the peptide sequence at SEQ ID NO. 28217
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (26)..(26): n is a, c, t, g, unknown, or other
  misc_feature (34)..(34): n is a, c, t, g, unknown, or other
cacaaccccccnnannnnnnnaaaantaacaganaaaaaaaaaacataacacaaaaaacaaccgaggggggggcgggggggcgtgcactagaggtagggccggcccgcgggtgtaggaattcgcacgagacatgacccagaaatccgaagggaaaagtccttcccctccctctgtccggagcgccgaagagaccaaagaccatcgaggcgggccgggcaccctcccctagcccggcggcctcctcccctacggctcccgggccagggggaaaggctaaccctagatgggcgccggcgggtcgacgggcgcgggggggatttggcgttttgccgccgaggccgccggtggtacggggagagaggcagcagcagggcgctgtgcgggccctgacaggggcggaggcgccaggccgcggggcacgtgggggggggggcgcctccggccggcgggcacgcccgaggccgggccacaccaacggccccgggcagggcggggggggggggcccaagaggttaggaggctgtgagtgggccgccagccgactgtggaagaagaacaaaccacgcgacaggcggtactaaataaagaggagtggaaaaagggagtgagagctgggagaaaagcaggggcgaattcctgccaaatataaaatcgccccgtagggtacagcggaagccatcccccggaggggggtgaagaggggggtgcggggggggcgtgaaaaacaggagagaagaggcgtaaggaataagatttgcgcgcgtacctctcctgcgcctggggcggaacacgggtcgctaggcaccacccatacacctag

SEQ ID NO: 28217 - protein, 80 aa, Zea mays
  misc_feature: Ceres CLONE 1402217-F
MGAGGSTGAGGIWRFAAEAAGGTGREAAAGRCAGPDRGGGARPRGTWGGGRLRPAGTPEAGPHQRPRAGRGGGAQEVRRL

SEQ ID NO: 28218 - DNA, 507 bp, Zea mays
  misc_feature: Ceres CLONE 1402222-F
  misc_feature: Encodes the peptide sequence at SEQ ID NO. 28219
  misc_feature (40)..(40): n is a, c, t, g, unknown, or other
  misc_feature (49)..(49): n is a, c, t, g, unknown, or other
  misc_feature (202)..(202): n is a, c, t, g, unknown, or other
  misc_feature (218)..(218): n is a, c, t, g, unknown, or other
  misc_feature (242)..(242): n is a, c, t, g, unknown, or other
  misc_feature (258)..(258): n is a, c, t, g, unknown, or other
  misc_feature (293)..(293): n is a, c, t, g, unknown, or other
  misc_feature (316)..(316): n is a, c, t, g, unknown, or other
  misc_feature (320)..(320): n is a, c, t, g, unknown, or other
  misc_feature (353)..(353): n is a, c, t, g, unknown, or other
ccccgcggtggcggccgctctagaactagtggatcccccngggctgcanggaattcgcacgagaccattacctagaacatcctaatcgaaaaaaaaccctgtttcacactagttctgtattcgtgtcctctggtctctcgcaggccaaacaaaagcgccgccgccgccggcaatgttccgccgcctcctcccccaccgtcgntacatctccacctcgncccgcctccaactcaacccgaccntctactctgacggaancatcccattctctatccttttcgtgggggccgtgncgctttccggaacagctcggcgntggncaggaagaaggccgcttttacccatcccccgtngccaacctaattttccccgaaataaaaaccccggccttggtcccaacccccgggggagccttttccccttttgaaaaaaaaaaaaacactctgggagggagggaagaaattgagaaaatctcttgacggggggccccccccccccccgcccccc

SEQ ID NO: 28219 - protein, 84 aa, Zea mays
  misc_feature: Ceres CLONE 1402222-F
  misc_feature (16)..(16): Xaa is any aa, unknown, or other
  misc_feature (24)..(24): Xaa is any aa, unknown, or other
  misc_feature (29)..(29): Xaa is any aa, unknown, or other
  misc_feature (41)..(41): Xaa is any aa, unknown, or other
  misc_feature (50)..(50): Xaa is any aa, unknown, or other
  misc_feature (61)..(61): Xaa is any aa, unknown, or other
MFRRLLPHRRYISTSXRLQLNPTXYSDGXIPFSILFVGAVXLSGTARRWXGRRPLLPIPRXQPNFPRNKNPGLGPNPRGSLFPF

SEQ ID NO: 28220 - DNA, 750 bp, Zea mays
  misc_feature: Ceres CLONE 1402230-F
  misc_feature: Encodes the peptide sequence at SEQ ID NO. 28221
  misc_feature (552)..(552): n is a, c, t, g, unknown, or other
tccccgcggtggcggccgctctagaactagtggatcccccgggctgcaggaattcgcacgagaccattacctagaacatcctaatcgaaaaactgcgatgtggtcctctcctcctatcacctgacctccacacacacacacagacagacaggcacgcgcaagcaaaaattcattcatatatgcacgctcgttcgttgtcgatctcccccatcactgcacggcgcggagcaacaagagcgagggattggagctcagctagtcgtctaatcagctagtaagtacgtgtagctaggctgcgctgcaccagctgccgtgcatgcagtgcatggcgcaggagggctctgaggcctccgtcgccagctccccgccgccccagccgccgccgtcggcctcctcctggtggcgcgacatgcagcacccggctgcctacggcgcgtggcctccgtcccccgcggcgaggtggacgcccccggtatcgatggcgccggcagcgacgcaacagcagcagcagcacggcggccgggagacgacgtcctccgacggtctctcggnctccaacgccaccgtagcgtccttcaccaaccactccgggtccgggctcagcctggactccgcgagtggagcttgaaggccgccgacgattgcctgcgacgccgccgagagacacctctgctaccaactccttcatgaagccggttggccagggtgcaaagagaatggaaatagctgcaggacgcacgatgacctctg

SEQ ID NO: 28221 - protein, 103 aa, Zea mays
  misc_feature: Ceres CLONE 1402230-F
  misc_feature (79)..(79): Xaa is any aa, unknown, or other
MQCMAQEGSEASVASSPPPQPPPSASSWWRDMQHPAAYGAWPPSPAARWTPPVSMAPAATQQQQQHGGRETTSSDGLSXSNATVASFTNHSGSGLSLDSASGA

SEQ ID NO: 28222 - DNA, 749 bp, Zea mays
  misc_feature: Ceres CLONE 1402234-F
  misc_feature: Encodes the peptide sequence at SEQ ID NO. 28223
  misc_feature (18)..(18): n is a, c, t, g, unknown, or other
  misc_feature (21)..(21): n is a, c, t, g, unknown, or other
  misc_feature (27)..(27): n is a, c, t, g, unknown, or other
tttttcctacccaaattnctncccccnctccctctccctgcacattccaaaaaatgtagctcaccgcggtggcggccgctctagaactagtggatcccccgggctgcaggaattcgcacgagaccattacctagaacatcctaatcgaaaaacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctggcatgaaggtcctcgtcctcgacccccaaaccgttgggatggtgagcgtggtgtacagccagtcggatctgctgcggaaggaggtcttcctcgtcgagaccatggacaacgcctccagctccagggagtccatggcgcacctcaaggccgtctacttcctccgaccctccgctaacaacgtccagaagctccgcaggcacctcgccatgccgcgcttcgccgagtaccacctattcttctccggaaatattgaagggtcccgcagattcaaatacttgctgactcggatgaaacaaggaggtggtgcagaaaaggttcaggaagtctatggctggattttttggggccattggccccaataccattttcacttctcaacatacaaaaataaccaccatggtatatgg

SEQ ID NO: 28223 - protein, 155 aa, Zea mays
  misc_feature: Ceres CLONE 1402234-F
MVLITLVRDYIDRMLHDIPGMKVLVLDPQTVGMVSVVYSQSDLLRKEVFLVETMDNASSSRESMAHLKAVYFLRPSANNVQKLRRHLAMPRFAEYHLFFSGNIEGSRRFKYLLTRMKQGGGAEKVQEVYGWIFWGHWPQYHFHFSTYKNNHHGIW

SEQ ID NO: 28224 - DNA, 716 bp, Zea mays
  misc_feature: Ceres CLONE 1402238-F
  misc_feature: Encodes the peptide sequence at SEQ ID NO. 28225
  misc_feature (396)..(396): n is a, c, t, g, unknown, or other
  misc_feature (472)..(472): n is a, c, t, g, unknown, or other
  misc_feature (627)..(627): n is a, c, t, g, unknown, or other
  misc_feature (628)..(628): n is a, c, t, g, unknown, or other
aagctggagctccccgcggtggcggccgctctagaactagtggatcccccgggctgcaggaattcgcacgagaccattacctagaacatcctaatcgaaaaagaccaggatccattaacacccctacgtacgcctttcctctggaaacccttctctcgcctgcctctcccccgtcgcgccgccacttcccctctcccgtcaactccggcttccgcgcgaggtcaagctagcgtttggagatctcgagacctgctgagatggcgacagagcaagcggcggagaactacacggtggaggacctcgtggccctgaacccctacaaccccgacatcctcaacgacctcgagaagttcgacaatgagcaggtctcatctcagacatatcactaggatgcanatctcagacttcatcgcttgtaccagtttgagccagatcagatgagcatacagattgtgggccacatactgataanggctctcatggcaatgccagaccctgactacagattgtgctgatccttaacccctgaacatgtgcaaaatggaggagcatttcaaggtattgaaaagttcttttcccaaaaccaaaagaaatgcaaagggtcaaaacaatttggggggggggaannaaaaaaaacccccccccctatttaaaaaaaaatgggccgtttttaaaaaaaaacccccccctctgggaaaaaagggggttttccctaa

SEQ ID NO: 28225 - protein, 43 aa, Zea mays
  misc_feature: Ceres CLONE 1402238-F
MATEQAAENYTVEDLVALNPYNPDILNDLEKFDNEQVSSQTYH

SEQ ID NO: 28226 - DNA, 713 bp, Zea mays
  misc_feature: Ceres CLONE 1402240-F
  misc_feature: Encodes the peptide sequence at SEQ ID NO. 28227
  misc_feature (543)..(543): n is a, c, t, g, unknown, or other
  misc_feature (582)..(582): n is a, c, t, g, unknown, or other
  misc_feature (606)..(606): n is a, c, t, g, unknown, or other
  misc_feature (610)..(610): n is a, c, t, g, unknown, or other
  misc_feature (620)..(620): n is a, c, t, g, unknown, or other
  misc_feature (629)..(629): n is a, c, t, g, unknown, or other
  misc_feature (666)..(666): n is a, c, t, g, unknown, or other
  misc_feature (669)..(669): n is a, c, t, g, unknown, or other
  misc_feature (670)..(670): n is a, c, t, g, unknown, or other
aaagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatctncagctcgtcggcctccaccagcagccgcgacagcgcggnccctttgtagctgtccagcgcggncccnacccttgggnggtccgggntttccaagccggggccgccctggagccgccgccgcgncgnnaccgtcgaaggcttcccgcttggcagcagctgcagctcccaaa

SEQ ID NO: 28227 - protein, 136 aa, Zea mays
  misc_feature: Ceres CLONE 1402240-F
  misc_feature (103)..(103): Xaa is any aa, unknown, or other
  misc_feature (106)..(106): Xaa is any aa, unknown, or other
  misc_feature (109)..(109): Xaa is any aa, unknown, or other
  misc_feature (123)..(123): Xaa is any aa, unknown, or other
MLLTSCRQGRGMASLSCARADGVVRSGALPAKLLLCASCCFPTAAPVADGEVQVLACRQHLHRLPRRQDLRRQRPRRRHLQLVGLHQQPRQRGPFVAVQRGPXPWXVRXFQAGAALEPPPRRXRRRLPAWQQLQLP

SEQ ID NO: 28228 - DNA, 692 bp, Zea mays
  misc_feature: Ceres CLONE 1402243-F
  misc_feature: Encodes the peptide sequence at SEQ ID NO. 28229
  misc_feature (505)..(505): n is a, c, t, g, unknown, or other
  misc_feature (584)..(584): n is a, c, t, g, unknown, or other
  misc_feature (630)..(630): n is a, c, t, g, unknown, or other
aaagctggagctccccgcggtggcggccgctctagaactagtggatcccccgggctgcaggaattcgcacgagaccattacctagaacatcctaatcgaaaaacagctgaaagcagccaaaacgcagaagctgcactgcatacatcgagctaactatctgcagcgatgtctcgctcctgctgcgtcgccgtgtcggtgcttctcgctgtcgccgcgacagccagcgccaccgcgccggcatggctgcacgaggaggccatggccacgggcccgctggtcgcagagggtgcaagggtggcgccctccgcgtccacctgggctgccgacaaggcgtcgccggcgaggccgagcggcggcatggccacgcagggcgacgaccagagctcgtcgggcggcagtggcagcagcgtgagcacggccaaggaggagggcgagaagcagggcaagagctgcctcaccaaggaggagtgccacaagaagaagatgatctgcggcaaggctgcancgctctcggcgcacagcaagtgcgccgcaagtgcaccaaagtcctgtgtcccacctgctaagaagccgaaagccggagncttgccggcgcgagacctcgaattcgatcgagtgttccttcattcnttgggtaaaaaaaaccttttgggggggtgcccctttgctttgcgttgccgtaaagagggaaa

SEQ ID NO: 28229 - protein, 175 aa, Zea mays
  misc_feature: Ceres CLONE 1402243-F
  misc_feature (114)..(114): Xaa is any aa, unknown, or other
  misc_feature (140)..(140): Xaa is any aa, unknown, or other
MSRSCCVAVSVLLAVAATASATAPAWLHEEAMATGPLVAEGARVAPSASTWAADKASPARPSGGMATQGDDQSSSGGSGSSVSTAKEEGEKQGKSCLTKEECHKKKMICGKAAXLSAHSKCAASAPKSCVPPAKKPKAGXLPARDLEFDRVFLHSLGKKNLLGGCPFALRCRKEG

SEQ ID NO: 28230 - DNA, 664 bp, Zea mays
  misc_feature: Ceres CLONE 1402250-F
  misc_feature: Translation starting site: 224
  misc_feature: Pfam Name: APG5 Pfam Description: Autophagy protein Apg5
  misc_feature (555)..(555): n is a, c, t, g, unknown, or other
  misc_feature (664)..(664): n is a, c, t, g, unknown, or other
tccccgcggtggcggccgctctatcctagtggatcccccgggctgcaggaattcgcacgagaccattacctagaacatcctaatcgaaaaacgtaactcgccttcctctcctccgccttggcccgccgtctctcgccgccccggccccaacccctctcgggctaggcgagtggaccggccgcccagcgtcgtcgccggcgagatcttcccaccgccgccggcaatggctgccccgcacgacgaggccgcggcgtgggcggaggaggcgacgcgccgggtctgggccggcgccgtgccgctccaggtccacctccacgacgccgacgtcaccgcgctacccccgccgccgcccttcctgactttgggaccaagaattgtgtatttgcccctcttgatacctgttataagggctcatttcagcaatgcactcccacctggtgttgacactgtttggtttgaatataaagggctgcctttgaaatggatgtaccaattggtgttctttttgatcttctatgtgcagatccagaaagaccatggaatctaatagtccanttttaggggatatccctcagaaatcttgtcaccatgcgagggtgaagatatagtgtgaagtggagctacatgaattccctgaaagaggccaccttcatcattacgggan

SEQ ID NO: 28231 - DNA, 635 bp, Zea mays
  misc_feature: Ceres CLONE 1402258-F
  misc_feature (422)..(422): n is a, c, t, g, unknown, or other
  misc_feature (423)..(423): n is a, c, t, g, unknown, or other
  misc_feature (480)..(480): n is a, c, t, g, unknown, or other
  misc_feature (577)..(577): n is a, c, t, g, unknown, or other
  misc_feature (589)..(589): n is a, c, t, g, unknown, or other
  misc_feature (625)..(625): n is a, c, t, g, unknown, or other
aaagctggagctccccgcggtggcggccgctctagaactagtggatcccccgggctgcaggaattcgcacgagaccattacctagaacatcctaatcgaaaagcgtttctttaccctaagcttttagctggtccaacgaaaggcacacagcccgacagccgccgctgtttcttcatcttcctcgcagcgccggcgctccttcttccgctccctctccgattcgcgctcggcacgcaggcgacggcggcggcgctcgtgctcgggcttctcagcgacggcgggcagtcccagactcggtgtcggcgtcagcggtcccccttccgcctgtcaccaatcgcctcgcgccctcgcctccggtcctccgcacaccgaccggcgcccttgcgtgcacgcctcccgctccccttcctgccttccggtgnnaccgtcgacggcgctcggaccccggagctgcactgcgcgccgcgtgcgacccgcggncagcgggagcagcagccgcgccgctttggtagcgcttataccccaaatgaatccttttacgtcgcttagctctcagcgcgctgagcgtgcgctaaantgccgattttgnaacctgaaatggtggatgttttgaataataactggnaaattgggga

SEQ ID NO: 28232 - DNA, 694 bp, Zea mays
  misc_feature: Ceres CLONE 1402260-F
  misc_feature: Translation starting site: 247
  misc_feature (570)..(570): n is a, c, t, g, unknown, or other
  misc_feature (571)..(571): n is a, c, t, g, unknown, or other
  misc_feature (680)..(680): n is a, c, t, g, unknown, or other
cagagctggagctccccgcggtggcggccgctctataactagtggatcccccgggctgcaggaattcgcacgagaccattacctagaacatcctaatcgaaaatcagcatctcgcgcttcagatctcgcccaccgatctggaactggaattccctcccgatctgtatgtatctcacgcacgcttgctcgcgttcttggctttgctcccacctctctctagcagagtaacagtctagcagagcaagcatgtcgtcgtcggcggagaacgaccccacggtgacggtgaccgagcgcggaggcaaggacaagcacgaggacggcggcgacaaggagcagggcggcggcggcttcatcgacaaggtgaaggacttcatccacgacatcgggagaaatcccagagaaggtcgtcgggttcggcaagcccacggccgacgtgtgcggcatccacatcccgcacatcagcctccaccgcgccgacctcggtcgtggacgtgctcatcaagaacccgaacccggtcccgatccccgctcgtggacatcgactacctcatcgacagcgacgccgcaagnnctggtgtcgggcctcatcccggacgccggcaccatccacgcgcacggccagaggaccgcaaaggatcccgggtgtcgctcggtcttcgacgacgtcaagagcacctacnaggacatccagccg

SEQ ID NO: 28233 - DNA, 663 bp, Zea mays
  misc_feature: Ceres CLONE 1402263-F
  misc_feature (450)..(450): n is a, c, t, g, unknown, or other
tcaccgcggtggcggccgctctacaactagtggatcccccgggctgcaggaattcgcacgagaccattacctagaacatcctaatcaaaaatcgagctgagctgagcatcatggggtagtgtgtgtgtgaggcgatagagaagctagtgctcataaccaaccaccactcagtcctcctcctctaccctttcccttccgccgcgttcctacttggtcctagagggagagagatctcgaactccaagggcgcatgctccggttgctagctacgatgccgtgtgcgtagctgcggcagcccttgatcgatcaatcgatcgcttgtgcggaatgagccggatcgagtggagtcagctagctagatactccgtggtcgtcgtcgtcgttggacgtacgccagaagagggagctagagaagaataccgtacagctgcttccaacatggcagctggnctcgtctggcccacctggtttggaattcgggggaaggggggaataaaaaaaaaatgggccccccccaaaaaaaaaaaaggggggggggggggccccccccccctctttttaaaaaaaaccccgccccgccccccccaaaaaaaaaaaacaaaacccccggaaaaacaaagggggggggggggggggggttccccccccaaaaaaaaggaaaaa

SEQ ID NO: 28234 - DNA, 528 bp, Zea mays
  misc_feature: Ceres CLONE 1402265-F
  misc_feature (375)..(375): n is a, c, t, g, unknown, or other
  misc_feature (453)..(453): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaaacgggaccgcagggaggaacctgcggtgggtggcaagcaggcgtgcgaatggcatntacggaaagggacccccgcggaaaaaggaatgccaaaagggaatggcccccagggggaccccaaaaatttacaccggnaggggaagggaaacagggggggggggcccccctaactccccccccctcccaaaaaaggacaaggggggggcgccc

SEQ ID NO: 28235 - DNA, 628 bp, Zea mays
  misc_feature: Ceres CLONE 1402266-F
  misc_feature: Encodes the peptide sequence at SEQ ID NO. 28236
cgctctgaactagtggatcccccgggctgcaggaattcgcacgagaccattacctagaacatcctaatcgaaaaaaaatcgggtttgccgtgcggcacttgcgtttcgggtcgggtacggacccgcaaaaagagctccgtcagttcctctacctcctctgtaggagcacacttgtttcggaaaggaacgcagattcacgccacgccgccgcctcaattatatggcgccggcgttctcggcacaggtccccgcgctccgacgggcagcactgcgcgtgcggtgggtcacggctgcgctgttctcatcggggattctcgccggcaacaagccgattctggtgcgtgacttcgtgaggtcagcgttgtacgaccccaaccatggctacttctccaagcgggcggggcccggtgggcgttcttgacgccagcatccgcttcaaccagctcgaaggggaggagtgcatatatacagcaccttgataagctggataagaagcatgatatccgcttggtttactcccgtggagctctttaagccatggtatgcctacgcaatagcagcatcgattctgcgttagaaaaatctttcacccccatggagataataccaaagatgggggggtggcttc

SEQ ID NO: 28236 - protein, 66 aa, Zea mays
  misc_feature: Ceres CLONE 1402266-F
MAPAFSAQVPALRRAALRVRWVTAALFSSGILAGNKPILVRDFVRSALYDPNHGYFSKRAGPGGRS

SEQ ID NO: 28237 - DNA, 941 bp, Zea mays
  misc_feature: Ceres CLONE 1402267-R
ggtgtgctattgtggaccgggcccaccctcgaaggtcgacggtatcgataagcttttttttttttttttctcgaccctaaaacactgactttattactttgagaaataattataccggctcatatatgggcacaggttttccacacatcctcatcaacacgcctttaaagtgtggcatttagataatcataacacattcacatgccttcaaatgggactgccaattaaaagcgccccacgtctgtacgacgaacaacgaagcgaggtcgtaaaaaacaaacaaaaggattgattgaaagctgctgcttatttgtatcaagtcgcatctgcatcatgctatggtatagtacaaaagcccaactccttcagaacttgtgctgcattcaaccgctctctgcgccggcgtaaggacccccgataacattaatcaccgatggttatcctggtgcggaacgattctgaaagggcagatttgaagctcgtctggtggctccacaagatatcctgttccctacaaaagcctccaatcatcttattggaacgcctgctgcccagaacataatgaggcttggcgctggagaacatccttaaaatgcgtccggggtaagctcggagaggggcttactcccgagtgcaccggccggtaaaaacatccagttgtttgttttataaaactaatatccttccactcagggtctgctgggctactctcgtacaataggtattcttgccctcccaattgccatcggaaagaccgcaaactccgaaatattagtcggcatatcaaactctttagccgccgggaggtccacgctagaggttcatcaatatcttatcccttactgtcagattttggatagtatcccgtgaattcgcaaatacacaccgattgatgacttggcgcgaaattgtcgctatgcactaccgcgggcattaaaggt

SEQ ID NO: 28238 - DNA, 759 bp, Zea mays
  misc_feature: Ceres CLONE 1402267-F
  misc_feature: Pfam Name: PWWP Pfam Description: PWWP domain
  misc_feature (1)..(1): n is a, c, t, g, unknown, or other
  misc_feature (12)..(12): n is a, c, t, g, unknown, or other
  misc_feature (58)..(58): n is a, c, t, g, unknown, or other
  misc_feature (376)..(376): n is a, c, t, g, unknown, or other
  misc_feature (377)..(377): n is a, c, t, g, unknown, or other
  misc_feature (395)..(395): n is a, c, t, g, unknown, or other
  misc_feature (522)..(522): n is a, c, t, g, unknown, or other
  misc_feature (595)..(595): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
ntttttttaaanttataaacgaggaagaaggggaaagggggcgaaaatgtggggggtntaataaagctgggagctccaccgcggggggcggccgctctagaaatagtgccatcccccgggctgcaggaattcgcacgagaccattacctacaacttcctaagcgaaaaactccgagcgacatggtctggggtaaagaagctgaaccgcgccggctggccgggcctcatctactgcgggggatagaacgtcaccatccaccaggaccaacgtctcgcatcccacctccccgacaaggccttcgcctgatgcgacacagccgagctcaggcgctatgaaccctacttccctgcccccgaggtctatgacgacgggcanngaggatttggacgccgtnctgcgaggcctccctccagcacatctacatccaccatgaaggctgaccgcggctcctccgccccggcctttcgccccggccgcatatcctcccctcgctcgacgaaaccggcgggggtcgtatggcntccaccaagacgttgaaaggctcctagatgcaatctcagttgcggaggctaaggacgagtagcagtcctcggncagaaaatgggagaggacgcctgcggacggacgggggaaagccctcttagctcgcaggggtccgggtggaaaagnnnnnagagagctccccacgagattgggcgggatggccagaccccctatacgtggcgccacggtcgtatcggatgacaagaaggatgaaa

SEQ ID NO: 28239 - DNA, 602 bp, Zea mays
  misc_feature: Ceres CLONE 1402273-F
  misc_feature: Encodes the peptide sequence at SEQ ID NO. 28240
ggagctcaccgcggtggcggccgctctagaactagtggatcccccgggctgcaggaattcgcacgagaccattacctagaacatcctaatcgaaaagaaaaccagctctcatattggcataattccaaatttctctcgtccgcaccgccgccactcgccttttcattccgcaccgccgccaacccgccgcctcttctttccatggaagtggacgacggtagccgcgccaccccgccactggacgccgtggccgccgccttcaagtcccaagtcatggagttgcaggacctcgtcctcgcccgcagcatgttcccggctacggcgctgcccgacctcgccaacgtggacgcgttggtgacggcgatggagtcgcaggtggaaaccatcagccgccgccttcaggaggagcttgacggcatccctaaagccaagaagctagtccagccgtccttgaaggaagaagagaagctgcagcatatgcttgcgaactttaccttctgggatgcggcaagaatgaatttgctaatcagcaccgaacagaggtcatcaaaggatgcggcctcatttttaactcctcttttaccggaagctaaggatgggga

SEQ ID NO: 28240 - protein, 133 aa, Zea mays
  misc_feature: Ceres CLONE 1402273-F
MEVDDGSRATPPLDAVAAAFKSQVMELQDLVLARSMFPATALPDLANVDALVTAMESQVETISRRLQEELDGIPKAKKLVQPSLKEEEKLQHMLANFTFWDAARMNLLISTEQRSSKDAASFLTPLLPEAKDG

SEQ ID NO: 28241 - DNA, 716 bp, Zea mays
  misc_feature: Ceres CLONE 1402276-F
  misc_feature: Translation starting site: 434
  misc_feature: SWISSPROT Homolog: EC 3.1.2.15 Ubiquitin thiolesterase
  misc_feature (458)..(458): n is a, c, t, g, unknown, or other
  misc_feature (665)..(665): n is a, c, t, g, unknown, or other
  misc_feature (683)..(683): n is a, c, t, g, unknown, or other
tccccgcggtggcggccgctctagaactagtggatcccccgggctgcaggaattcgcacgagaccattacctagaacatccaatcgaaaaattctagatcaagcgagtcctcccgtttcatcgcctcggaaaaaggcgagaaatctgcaacagaagaagcagcagcgacagcgattccttcctcgtacctttcgttgcgctcgcgcactcggatcgacccctctagggttttgcatcggcctcccgccagctcctatccctcccctctccctccgccgcgcgcccgcgcggggagccaccaaaccctaggacggcaaatccggtgcgatcacccacggtggaggcctcgtcggcggccgagaggagccgctcagggctcgggtcagggttccggtacctcgccggcgccgcctctggctggtgggaccggtggatggtcatgggagccagcggctccnagcttgagaaggccctcggagaccagttcccggaaggcgagcgctacttcggcctcgagaacttcggcaacacctgctactgcaacagtgtccttcagggagcagttactggaatattatgcaaataacaaaactccaggagacgctgaggaaaatcttctgacttgtttggccgacctttttatgcagataagccaagcaaagaanaagaccggtgttattgcntcaaaacgttttgttcagagagtgaagaaacag

SEQ ID NO: 28242 - DNA, 715 bp, Zea mays
  misc_feature: Ceres CLONE 1402277-F
  misc_feature: Encodes the peptide sequence at SEQ ID NO. 28243
  misc_feature (715)..(715): n is a, c, t, g, unknown, or other
tccccgcggtggcggccgctctagaactagtggatcccccgggctgcaggaattcgcacgagaccattactaaaacatcctaatcgaaaaattttattaattaacaaagagaagacttcttccttcctcgtcgtctccagaccattccaattcttgattccatcgccccaccatccacaactcccctaatccttccaacctcctcgacgtccagtccaccacctccacgcgcaatggccagtggctaggcggcaccaaccagatcacaaggattcgtttcatccggcagcgcaactctagagactccatgggcagctacgcgtacaagtactgtatgtgcttcacgcgcaagttccgatccccggacgcccagccgccgccggacgtccgcgccgaccacctctccttcgcctctgacgtccatgccctccgccgcttcgtcgccggcggccagggcgagtcccccgacgacgtcgaccgcatcctcgccatgctctccgggggccacagccatggaatcgcccgcctcgtcagaaggtggccgggggtatccacgcccacgctcgaagacttcttcggcttcctcttctcccccgacctcaacccacccatcgcgcaccaggttcaccaggacatgtcagaggcgttctctcactatttcgagttcaccgggcataattgctacctcactgggaaccagctcagtagagactcn

SEQ ID NO: 28243 - protein, 136 aa, Zea mays
  misc_feature: Ceres CLONE 1402277-F
  misc_feature: SWISSPROT Homolog: EC 3.1.4.11 Phosphoinositide phospholipase C
MGSYAYKYCMCFTRKFRSPDAQPPPDVRADHLSFASDVHALRRFVAGGQGESPDDVDRILAMLSGGHSHGIARLVRRWPGVSTPTLEDFFGFLFSPDLNPPIAHQVHQDMSEAFSHYFEFTGHNCYLTGNQLSRDS

SEQ ID NO: 28244 - DNA, 663 bp, Zea mays
  misc_feature: Ceres CLONE 1402282-F
  misc_feature (411)..(411): n is a, c, t, g, unknown, or other
  misc_feature (541)..(541): n is a, c, t, g, unknown, or other
cgcggtggcggccgctctagaactagtggatcccccgggctgcaggaattcgcacgagaccattacctagaacatcctaatcgaaaaagaactgactccctcgatcccagcggcagcggcggaagcgaacggtgaccgcgacctcccctgaccctgaggctgcatatactcggatcgggtttcacatctccggttttggattggttggttgcccgcggtgatgggaggagagctgtggtggtatccataggggatcctcgtttgcgtccttgtgcgatggcttcgacctccgttcctgagttaaccgcggacaagaaatgcgacaaagccatcgcggatacggcggcaccacttacttctcagggacactccgaagaaccgactgggaaagtcagcacactagtgcctgcntttgccggttgtaattgcagcaggcgatggggctgcatccagtggggtgatagaaaacagaaatggcatggacaattctgctgatggttctttgaagcggatggaacagtgaaggtgctgagaagagctncgctgcgggggagcgtcaggattaaaccttcggtgtcggctaaatgcagtgacaggccgagcagcctgtcgaaagccagtgggagcgccaaagatcagcggtcaactgctgaattgaatcga

SEQ ID NO: 28245 - DNA, 715 bp, Zea mays
  misc_feature: Ceres CLONE 1402283-F
  misc_feature: Encodes the peptide sequence at SEQ ID NO. 28246
  misc_feature (484)..(484): n is a, c, t, g, unknown, or other
  misc_feature (485)..(485): n is a, c, t, g, unknown, or other
  misc_feature (602)..(602): n is a, c, t, g, unknown, or other
  misc_feature (603)..(603): n is a, c, t, g, unknown, or other
  misc_feature (669)..(669): n is a, c, t, g, unknown, or other
  misc_feature (683)..(683): n is a, c, t, g, unknown, or other
aaagctggagctccccgcggtggcggccgctctagaactagtggatcccccgggctgcaggaattcgcacgagaccattacctagaacatcctaatcgaaaaactcgcctcgacgcgcctctgaaagatcggagacgccgggccgtccgcctccctctccgcctcccgtccccaaggccaatagttttccagtggcaatggcggaccaggctaaccaacccactgtccttcataagctcggtggccagttccacctgcgctcgatcatctctgaaggtgtacgggcccgtaacatatgcccatctgtctcatcttatgaaaggagatttgccacaaggaactacatgacccagagcctttggggcccttcaatgtctggtagcggtggcatcaatgtcccagtgatgcagaccccgctctgtgctaatgctcctgctgagagaaggagcaagaacttcatgatttgatttcatgagatggcggnnggtttcagctgctgtttcaaagaaatggttgtgctctccactcgaggcgtgtgaagctgcttattctccaaacaagaagtgagatgatttaagtctggtaggcttatcagaagccgnntacaaggggtatttgttgactgtggcttcaaacgtaccattttaaaggggatgaaggtttctcttnccctttcgttggangggtaacactgctaaatggttatttcgttact

SEQ ID NO: 28246 - protein, 89 aa, Zea mays
  misc_feature: Ceres CLONE 1402283-F
MADQANQPTVLHKLGGQFHLRSIISEGVRARNICPSVSSYERRFATRNYMTQSLWGPSMSGSGGINVPVMQTPLCANAPAERRSKNFMI

SEQ ID NO: 28247 - DNA, 664 bp, Zea mays
  misc_feature: Ceres CLONE 1402284-F
  misc_feature: Encodes the peptide sequence at SEQ ID NO. 28248
  misc_feature (355)..(355): n is a, c, t, g, unknown, or other
  misc_feature (381)..(381): n is a, c, t, g, unknown, or other
  misc_feature (476)..(476): n is a, c, t, g, unknown, or other
ggcggccgctctagaactagtggatcccccgggctgcaggaattcgcacgagaccattacctagaacatcctaatcgaaaagggccgggagtgggcgacgaacgatggctggctggccgtccgtgattgttttggaacgggcagcgtgtttggttggtgcctgtgctgtgccgccgttcgtctctgggtagcgtagcgacggcgccacggcggcttccggctcgtgcgcgcgcgcgcgtgtccgggcgagaagagctgccaagggatggaggcgctgaggaagcaggcgagcaagttcaaggagcaggtcgccaagcagcagcaggctgttataaagcaattcagtactactggnctatgagcggtcagattccattgtanattgatgaggttgaactacagagacatcaacagcttgagaaattgtatacttctactcgttcttgtaagggatttccagaaggacatagttaggnccagctggaaagggttggggtgtctattggaaacaaccatatttgaagtgggaacaaaaattttctgaggactgctataagatatgggaagcgaaaataatgcaagcgacgaagcccttagaaaagacatccttaatacgggaggtgctttgagaaatattgagaaagaggtatgaagatttcaacag

SEQ ID NO: 28248 - protein, 31 aa, Zea mays
  misc_feature: Ceres CLONE 1402284-F
MEALRKQASKFKEQVAKQQQAVIKQFSTTGL

SEQ ID NO: 28249 - DNA, 703 bp, Zea mays
  misc_feature: Ceres CLONE 1402286-F
  misc_feature: Encodes the peptide sequence at SEQ ID NO. 28250
cgcggtggcggccgctctatccctagtggatcccccgggctgcaggaattcgcacgagaccattacctagaacatcctaatcgaaaagaaaatctctgctcatttcacatcgaacgctccgcctacaatcctgtactgcacgcgctccccatccgcacaacttcccgcctcccatggcggcgccggcgccgggggccacccgcctccaccccccgttcctcctgcttccttccccgccgcgaccccatcctccactccggctccgcttcctcctgccgtccccgccgcctctccgcctccgccgccgcttcccgctgctcgctgccgccgccgtctccgccggcggcggcggtggaggggaggaagccgccggcaggaaggccgataaggccaggcagctgcagaagcgggtcctcgtgggcgtcgccatcggggtgggcgcaggcggcatcgtggtcgccggcggctgggagttcgcagccgccgtcgcagctgctgtccttgccggctcccgggagtacttcgagctcgtccgcagcactgccagcggaggcgggaccccgccgccgcgatacgtgtcccgcgcgagctccgccatcagcgctctcatgcccatccttacgctgtactatggacgcatggatgttactgtggcattttctgcatacgttattgccatagcattgcttttacaaagtagaga

SEQ ID NO: 28250 - protein, 176 aa, Zea mays
  misc_feature: Ceres CLONE 1402286-F
MAAPAPGATRLHPPFLLLPSPPRPHPPLRLRFLLPSPPPLRLRRRFPLLAAAAVSAGGGGGGEEAAGRKADKARQLQKRVLVGVAIGVGAGGIVVAGGWEFAAAVAAAVLAGSREYFELVRSTASGGGTPPPRYVSRASSAISALMPILTLYYGRMDVTVAFSAYVIAIALLLQSR

SEQ ID NO: 28251 - DNA, 635 bp, Zea mays
  misc_feature: Ceres CLONE 1402290-F
  misc_feature: Encodes the peptide sequence at SEQ ID NO. 28252
  misc_feature (538)..(538): n is a, c, t, g, unknown, or other
tccccgcggtggcggccgctctagaactagtggatcccccgggctgcaggaattcgcacgagaccattacctagaacatcctaatcgaaaagacgggggcgtttctcgatctgacgctcgcctgggcctgcctctgcctcgccgcgctcgccgccgccgccgcgcgcctcctcgcgctcctcggcctcccgctcccctgcacctgtgcgcgcccgcacctgccctgcctcctcgccttcctggtgcgctaccctccccgcgccgtcggatcccttcacgccgccctccgcgcccgcttccccttcgccggccccaccgacgacgaggcacgccttcagaaaggggtggaggaagagggggaggaggaggccatcgatgtgcggaaggaggaaggggattttcgtcgccgcgtggaggcgcgcgccgagctgcagatggagctcgagaaagagcgcagcgccgcggcgtcggcggccgaggaggccatgtccatgatcctgcgcctgcagaaagagaagtcggcgcttgagattgaggngcgacagcagcgccgaaacgctgaccagcgctgcgccttctacaaggacgaggtcaagaagctccgggaacatctggtccatgcggaaagcttgagg

SEQ ID NO: 28252 - protein, 67 aa, Zea mays
  misc_feature: Ceres CLONE 1402290-F
  misc_feature (1)..(64): Pfam Name: DUF593 Pfam Description: Protein of unknown function, DUF593
  misc_feature (35)..(35): Xaa is any aa, unknown, or other
MELEKERSAAASAAEEAMSMILRLQKEKSALEIEXRQQRRNADQRCAFYKDEVKKLREHLVHAESLR

SEQ ID NO: 28253 - DNA, 733 bp, Zea mays
  misc_feature: Ceres CLONE 1402291-F
  misc_feature: Encodes the peptide sequence at SEQ ID NO. 28254
  misc_feature (733)..(733): n is a, c, t, g, unknown, or other
tcaccgcggtggcggccgctcttcaactagtggatcccccgggctgcaggatttcgcacgagaccattacctagaacatcctaatcgaaaaagagctccaatggccgccgctctcccgcactcccgcctccacctcccgctccacacgcccagtcccacctcccgccgccgcccctgcccccgttcccgccgccgccttccctccttcgtcgccgtctcgcgcctccagaacaccaccgccgcgacccacccggtcctcccgcccccgggtccgcccccctccgccgcgctcctcgccgccgagggcgcctccctcgcgccgcgccgagagcaccgcttcccaggctcggtctcctccccaacaagcaccgcctctgcctctaacgaggcggagtacgccgtcctgcttctcgccctccaggtgcgccgcgccgacgccgccgaggtgctcgttgccgcgctcggcagagggaaggtcggcggcctgacctacatcaagaacctcacggggcgtatggggccgattgtggaccgcgctgttgtctaggccgcagcgatgacgcgggaccgacctgagctcgcccacatgtccttcgacgcccgtgcaaaggcgtacatccaggagtccggccttgtggagcttgtcgagtgattcaagcacaactcgatgacatatccccagatcgaaaaggtgtttgcgcatgctctggcgatttggggaaagctaagaaan

SEQ ID NO: 28254 - protein, 148 aa, Zea mays
  misc_feature: Ceres CLONE 1402291-F
MAAALPHSRLHLPLHTPSPTSRRRPCPRSRRRLPSFVAVSRLQNTTAATHPVLPPPGPPPSAALLAAEGASLAPRREHRFPGSVSSPTSTASASNEAEYAVLLLALQVRRADAAEVLVAALGRGKVGGLTYIKNLTGRMGPIVDRAVV

SEQ ID NO: 28255 - DNA, 656 bp, Zea mays
  misc_feature: Ceres CLONE 1402293-F
  misc_feature: Encodes the peptide sequence at SEQ ID NO. 28256
  misc_feature (391)..(391): n is a, c, t, g, unknown, or other
  misc_feature (480)..(480): n is a, c, t, g, unknown, or other
  misc_feature (495)..(495): n is a, c, t, g, unknown, or other
  misc_feature (499)..(499): n is a, c, t, g, unknown, or other
  misc_feature (644)..(644): n is a, c, t, g, unknown, or other
cgcggtggcggccgctctagaactagtggatcccccgggctgcaggaattcgcacgagaccattacctagaacatcctaatcgaaaagtgtcgtcttcctctccgccgcttctcctgtccaccctcgactgcttgcgcgtgacctgagccgccgccgcctacatccgctcatccccgcgcccgcctcaaccacgccgccaccgaccacgtataatcctgcctccccttcgcgcggtttcgaggctcgtttcctttgggatcgttcgtctgccccgaccgcgtgggcgcttcttcttcgggatctcgctggaccgagcggcccagggctagggattcaggcccatggcgtggcggcgcgtcctcacccagattgcaaggcatcgaccagcanaagcaatctacaatgaactagttgcttcctccccctttgggtgttcttcgaagtgacatcacttcaggtgccaggattagacatttacnagagaggaaccagtncagntacattggtagctttggcacgccgggtccgagacttagaatcaccaagcggaacttctctgctttaagagaatttacagaagtgaccccagagcgtgtcatacaaatatttgaaagccaaccttcattacattctatcctgcagnacttttcggaga

SEQ ID NO: 28256 - protein, 34 aa, Zea mays
  misc_feature: Ceres CLONE 1402293-F
  misc_feature (17)..(17): Xaa is any aa, unknown, or other
MAWRRVLTQIARHRPAXAIYNELVASSPFGCSSK

SEQ ID NO: 28257 - DNA, 691 bp, Zea mays
  misc_feature: Ceres CLONE 1402296-F
  misc_feature: Translation starting site: 208
  misc_feature: SWISSPROT Homolog: EC 4.3.1.5 Phenylalanine ammonia-lyase
  misc_feature (538)..(538): n is a, c, t, g, unknown, or other
  misc_feature (627)..(627): n is a, c, t, g, unknown, or other
  misc_feature (634)..(634): n is a, c, t, g, unknown, or other
  misc_feature (646)..(646): n is a, c, t, g, unknown, or other
  misc_feature (647)..(647): n is a, c, t, g, unknown, or other
  misc_feature (655)..(655): n is a, c, t, g, unknown, or other
  misc_feature (656)..(656): n is a, c, t, g, unknown, or other
caaagctggagctccccgcggtggcggccgctctagaactagtggatcccccgggctgcaggaattcgcacgagaccattacctagaacatcctaatcgaaaatccaagaagagcacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtgaagatcgagggctccaccctccgcgtcggccaggtggccgccgtcgcctccgccaaggacgcgtccgggcgtcgctgtcgagctcgacgaggaggcccgcccccgcgtcaaggcccagcagcgagtggatcctcgactgcatcgcccacggcggcgacatctacggcgtcaccaccgggcttcggcggcacctcccaccgcgcanccaaggacgggcccgcgcttccaggtcggagctgctcaggcatctcaacgccggaatcttcggcaccgggcagcgacgggacacctgtnccccccnttcgagtccccnncgcggggnntatttttttttgttggcgcatcaacaccctcctcc

SEQ ID NO: 28258 - DNA, 665 bp, Zea mays
  misc_feature: Ceres CLONE 1402301-F
aaagctggagctccccgcggtggcggccgctctagaactagtggatcccccgggctgcaggaattcgcacgagaccattacctagaacatcctaatcaaaaatgattacaagaaaaatagtttcaatgccagattttctttgcttgctcatttgatcgcgcagagtgctgctgatgataacattatggatttgattcagaggcacattatctttcactcacatgatcaggaggggtatgaactggcaatgcatgtgttgtatcagctgcagagtatcagtgttgctaattcaccagaaagctctacctccacctctaaacattacgagaagttctttatatcacttgcgaggtccttgattgattcactgcctgcttcagacaaatcttttagcaaacttttatgcgatgcaccatatctacctgagtctttgtttagattactggaggatctttgcatgtcagaagacaacagccaacaattaaaggatggagatggggaccgtgttacccaaggcctgggaactgtatggagccttatcttgggtcggcctccgcttcgccatgtttgcttggatattgctctgaagtgtgctgcccactctcaagatgaagtcaggggaaaagcagttagattggttgcaaaaaggctctatgatctaacat

SEQ ID NO: 28259 - DNA, 705 bp, Zea mays
  misc_feature: Ceres CLONE 1402308-F
  misc_feature: Encodes the peptide sequence at SEQ ID NO. 28260
  misc_feature (375)..(375): n is a, c, t, g, unknown, or other
  misc_feature (484)..(484): n is a, c, t, g, unknown, or other
  misc_feature (490)..(490): n is a, c, t, g, unknown, or other
  misc_feature (573)..(573): n is a, c, t, g, unknown, or other
  misc_feature (588)..(588): n is a, c, t, g, unknown, or other
  misc_feature (632)..(632): n is a, c, t, g, unknown, or other
aagctggagctccccgcggtggcggccgctctagaactagtggatcccccgggctgcaggaattcgcacgagaccattacctagaacatcctaatcgaaaatttcttcgatcgtggttgcgccatccctcactctcctccgaagccatcgtccacgtcccagcctccccggactctaggggcagaagctgcagcgtcgagatggtgaaggggcgcacggggcagcgcgtgaggctctacgtccggggcaccgtccttggatacaagcggtccaagtcgaaccagtacgagactacgtcgctggtgcagatcgagggggtgaacaccaaggaggacgtcgcgtggtactgcgggaagcggatggcctacatctacnaggccaagaccaagagcagcggcacccactaccgctgcatctggggcaaggtcgcccgcccgcatggcaactccggcgtcgtccgcgccaaagtcagggtccacctggncgcggnaatcatgataatctgaatgtgtggaggacccttttcttctagattttatcttcagctgtccttggtaggggttgtggtcaggntgaggagtaccaggntgagctggctatctgagaaccattaaagttctctgaggtttggnggtatggatcactggagttttattggaagtttaagtaagaactatttggttggcaaattttgaaggaagaccc

SEQ ID NO: 28260 - protein, 101 aa, Zea mays
  misc_feature: Ceres CLONE 1402308-F
  misc_feature (12)..(101): Pfam Name: Ribosomal_L35Ae Pfam Description: Ribosomal protein L35Ae
  misc_feature (59)..(59): Xaa is any aa, unknown, or other
  misc_feature (95)..(95): Xaa is any aa, unknown, or other
  misc_feature (97)..(97): Xaa is any aa, unknown, or other
MVKGRTGQRVRLYVRGTVLGYKRSKSNQYETTSLVQIEGVNTKEDVAWYCGKRMAYIYXAKTKSSGTHYRCIWGKVARPHGNSGVVRAKVRVHLXAXIMII

SEQ ID NO: 28261 - DNA, 670 bp, Zea mays
  misc_feature: Ceres CLONE 1402311-F
  misc_feature: Encodes the peptide sequence at SEQ ID NO. 28262
aagctggagctccccgcggtggcggccgctctagaactagtggatcccccgggctgcaggaattcgcacgagaccattacctagaacatcctaatcgaaaaactgcgatgtggtcctctcctcctatcacctgacctccacacacacacacagacagacaggcacgcgcaagcaaaaattcattcatatatgcacgctcgttcgttgtcgatctcccccatcactgcacggcgcggcgcaacaagagcgagggattggagctcagctagtcgtctaatcagctagtaggtacgtgtagctaggctgcgctgcaccagctgccgtgcatgcagtgcatggcgcaggagggctctgaggcctccgtcgccagctccccgccgccccagccgccgccgtcggcctcctcctggtggcgcgacatgcagcacccggctgcctacggcgcgtggcctccgtcccccgcggcgaggtggccgcccccggtatcgatggcgccggcagcgacgcagcagcagcagcagcacgggcgccggggcgacgacgtccctccgacgttctctcggcctccaacgccaccgtagcgtccttcacaaccacttcggggtccgggctcagctggaactccgggtgggaaactttaaggcccccccccctttccctccgccgcctt

SEQ ID NO: 28262 - protein, 84 aa, Zea mays
  misc_feature: Ceres CLONE 1402311-F
MQCMAQEGSEASVASSPPPQPPPSASSWWRDMQHPAAYGAWPPSPAARWPPPVSMAPAATQQQQQHGRRGDDVPPTFSRPPTPP

SEQ ID NO: 28263 - DNA, 673 bp, Zea mays
  misc_feature: Ceres CLONE 1402314-F
  misc_feature: Encodes the peptide sequence at SEQ ID NO. 28264
  misc_feature (419)..(419): n is a, c, t, g, unknown, or other
  misc_feature (471)..(471): n is a, c, t, g, unknown, or other
cgcggtggcggccgctctagaactagtggatcccccgggctgcaggaattcgcacgagaccattacctagaacatcctaatcaaaaatctctcgctcccggatcgccgcgagctcctttttgatctttgactcgcatcgcgtctcctctcgcctccgttttggataagcccgtctggaagcctctcctgctttcatttcgccggcccgcggagaacagctcggcgggttcccttcgtgcagcgttcggagagctcttcctgctgctctgcgacggacggggacggagaggtcaaaaatgtaccatcacggatgatggatggtctccggtatcatctgcgtgggacatagatggaggactacttttcacgcttccaaaaccttggttggcagctaagacaatacttgacagaattaatangaaaaatttggttcggaccattaatcggattcctcaccgtcttggagtcaanttctctgctagcccatggaggatcattgactggcaccacagtatattttcatgaaagggcatctacgttatctgttaatactattaccactacagaaaacagactgcaatggaacatctgaaggcgcatttttcagaaaggactttccagtattacgaaaggttcttgggggcaggcctttctatctttacatgggtcaggg

SEQ ID NO: 28264 - protein, 80 aa, Zea mays
  misc_feature: Ceres CLONE 1402314-F
  misc_feature (24)..(24): Xaa is any aa, unknown, or other
  misc_feature (41)..(41): Xaa is any aa, unknown, or other
MEDYFSRFQNLGWQLRQYLTELIXKIWFGPLIGFLTVLESXSLLAHGGSLTGTTVYFHERASTLSVNTITTTENRLQWNI

SEQ ID NO: 28265 - DNA, 668 bp, Zea mays
  misc_feature: Ceres CLONE 1402315-F
  misc_feature (522)..(522): n is a, c, t, g, unknown, or other
  misc_feature (529)..(529): n is a, c, t, g, unknown, or other
  misc_feature (552)..(552): n is a, c, t, g, unknown, or other
  misc_feature (553)..(553): n is a, c, t, g, unknown, or other
  misc_feature (631)..(631): n is a, c, t, g, unknown, or other
tccccgcggtggcggccgctctagaactagtggatcccccgggctgcaggaattcgcacgagaccattacctagaacatcctaatcaaaaagattcacagagtcggccagctgcctaggcaccggcgtccggatctcctgctccgctgctcgccgtctcgaggctctccggcgttgactcggcgcggcagcgccccccggtagcctagttccggatcccccaccgcccacgccccacagattgccccacccgcaccacccaccgtacggccggtgcctccccttcctcgtctccgcggcgtcgcagtcgcaggccggcccgggcactcctcccacccttataccagtccccgtcccctccgacccccgcgctggctgtttctggtaacctccctttcttcgaccgtgtcctctatccggactcgttcccgcttgagaccccgccctctaaggaggaggacgcggcagcgcgacagactgatgaggcgtgggcaccgctgtcccccttgagggaggagacganacagaanagggaggcgtgcgactgctgccnnaaaggcggtcgtcagctactgcgcgagccccggggggaacggtggcggcgaaaaccccgagggcatggagatgctcanctacgacaggtcttcttcaaggacttcggggcctccg

SEQ ID NO: 28266 - DNA, 669 bp, Zea mays
  misc_feature: Ceres CLONE 1402318-F
  misc_feature: Encodes the peptide sequence at SEQ ID NO. 28267
  misc_feature (383)..(383): n is a, c, t, g, unknown, or other
  misc_feature (384)..(384): n is a, c, t, g, unknown, or other
  misc_feature (425)..(425): n is a, c, t, g, unknown, or other
  misc_feature (440)..(440): n is a, c, t, g, unknown, or other
  misc_feature (447)..(447): n is a, c, t, g, unknown, or other
  misc_feature (453)..(453): n is a, c, t, g, unknown, or other
  misc_feature (454)..(454): n is a, c, t, g, unknown, or other
  misc_feature (462)..(462): n is a, c, t, g, unknown, or other
  misc_feature (468)..(468): n is a, c, t, g, unknown, or other
tggagctccccgcggtggcggccgctctagaactagtggatcccccgggctgcaggaattcgcacgagaccattacctagaacatcctaatcgaaaacccttagttgtatcctctcctcctccttggacctcccatcttccttcctcttcgttcgtttctccaaccgaagcttaccggcattcgctcctggttttccggccaagaaccgatttttttccggttccggcgtagcagcaggcagctagcttgccaccagctgattcattgcctctactagtgtttttcctgagctcggtggggtgatcggtcgatcggccgccgctcgagacacgtacgtacgtacgtacccgatcgagggtcgctccaagatgatgatgagcgnnaaccggaagcagagggtggcattgtcgccggatgaggaggncgccgcggtgccaangaggggntggggnnaagtccgncccgtncggatgctgttgcaaaagcggagccccgacgcggacccgccggctgtgccaccatccgcgttcaagtccaggtccaacggcgtctaaccacgagatctacatccattccccaggcatcctttcgcgagttgaaaaaaattggtggccggaaaaaaacgggcctgcacccgaaagaaacaaaaagggggggggacagggcca

SEQ ID NO: 28267 - protein, 61 aa, Zea mays
  misc_feature: Ceres CLONE 1402318-F
  misc_feature (5)..(5): Xaa is any aa, unknown, or other
  misc_feature (19)..(19): Xaa is any aa, unknown, or other
  misc_feature (24)..(24): Xaa is any aa, unknown, or other
  misc_feature (29)..(29): Xaa is any aa, unknown, or other
MMMSXNRKQRVALSPDEEXAAVPXRGWGXVRPVRMLLQKRSPDADPPAVPPSAFKSRSNGV

SEQ ID NO: 28268 - DNA, 692 bp, Zea mays
  misc_feature: Ceres CLONE 1402319-F
cgcgactggcggccgctctagaactagtggatcccccgggctgcaggaattcgcacgagaccattacctagaacatcctaatcgaaaagtggcttctcattcattgttgattgattgatcctccccgcctcactcctttgtctcctcgcctcgtgctcgctcgctcccctcgccctggcgaggagggcagcagaaaccctagcggctcaggccgggcgggggttagatgctccaaggttcgagagggaagggtaggttagtggtgcgccatcgactatgggctgcgtcttcggccgggcggctgcgtcgtcctctgcagcgccgaagaagaagtgggccaagggggaggtcgcccccgcaatcccgaagcggggtcgccctccggaggcggccgcaccgcacctgtacgttagcccgtctgtggcgtctccgggggcctgagggtcgccagtacccctcaccgcgtcgcaactcctcgttcttgcccagatgatgcatggcgatcacccacccacctccacctggaaatggactataatgaggataacccccccctctttcgttaccgtacactccccctcggaccgaaacccacacccgcctcacccccctctatcaccaattgctaaattcctctccagtaccgtccgcactcgcccccccaacccctcccccaacccaacatcacactg

SEQ ID NO: 28269 - DNA, 707 bp, Zea mays
  misc_feature: Ceres CLONE 1402321-F
  misc_feature: Encodes the peptide sequence at SEQ ID NO. 28270
  misc_feature (310)..(310): n is a, c, t, g, unknown, or other
  misc_feature (326)..(326): n is a, c, t, g, unknown, or other
  misc_feature (368)..(368): n is a, c, t, g, unknown, or other
  misc_feature (369)..(369): n is a, c, t, g, unknown, or other
  misc_feature (382)..(382): n is a, c, t, g, unknown, or other
  misc_feature (395)..(395): n is a, c, t, g, unknown, or other
  misc_feature (470)..(470): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (679)..(679): n is a, c, t, g, unknown, or other
tccccgcggtggcggccgctctagaactagtggatcccccgggctgcaggaattcgcacgagaccattacctagaacatcctaaaaaaaaaaaacccccgtcctcctcgccgctccgccgcgcggttgagcgccgacgagcgagcccaccgctgcctcgtccgccctatggatatggatgtccgccgcagggttccaccgccgcacgggagcgtccctaggcgccagcaggcgaccggggccgagtgggagcgggtgcgtgtgcaggcgggtgatgcgctaccgctgccgatccggcacacgaacctcantcttctcggcgctgtntcgccgcgtcgctggtgtactgaatgcgtccggtggcccgcnngggaagatccgcngcctccacgccgnctccacgtggtctccccccggccgagatcttcgccatctgcgggcctcgtcgcgtcgctcatctacctcctcagnttttccttcgggatcgcccttcgtggccagtccgtcgtctccagcagcgacggacggacgaggaccttcatcgtcgactccgccacgnnnnggnnncgcggggcgccgccgacgcctgcgaaaaaccccgtggtgcgcttgctgggggagccccgccgccgcgacggaaaaattggcggaggaggacgaaggagaccgggggcccgggntggggcaagggaagatccccgtctaacg

SEQ ID NO: 28270 - protein, 180 aa, Zea mays
  misc_feature: Ceres CLONE 1402321-F
  misc_feature: SWISSPROT Homolog: EC 1.1.1.34 Hydroxymethylglutaryl-CoA reductase (NADPH)
  misc_feature (48)..(48): Xaa is any aa, unknown, or other
  misc_feature (68)..(68): Xaa is any aa, unknown, or other
  misc_feature (72)..(72): Xaa is any aa, unknown, or other
  misc_feature (101)..(101): Xaa is any aa, unknown, or other
  misc_feature (131)..(131): Xaa is any aa, unknown, or other
  misc_feature (132)..(132): Xaa is any aa, unknown, or other
  misc_feature (133)..(133): Xaa is any aa, unknown, or other
  misc_feature (171)..(171): Xaa is any aa, unknown, or other
MDMDVRRRVPPPHGSVPRRQQATGAEWERVRVQAGDALPLPIRHTNLXLLGAVSPRRWCTECVRWPAXEDPXPPRRLHVVSPRPRSSPSAGLVASLIYLLXFSFGIALRGQSVVSSSDGRTRTFIVDSATXXXRGAPPTPAKNPVVRLLGEPRRRDGKIGGGGRRRPGARXGAREDPRLT

SEQ ID NO: 28271 - DNA, 684 bp, Zea mays
  misc_feature: Ceres CLONE 1402322-F
  misc_feature: Translation starting site: 262
  misc_feature (399)..(399): n is a, c, t, g, unknown, or other
  misc_feature (431)..(431): n is a, c, t, g, unknown, or other
  misc_feature (445)..(445): n is a, c, t, g, unknown, or other
  misc_feature (449)..(449): n is a, c, t, g, unknown, or other
aaagctggagctccccgcggtggcggccgctctagaactagtggatcccccgggctgcaggaattcgcacgagaccattacctagaacatcctaatcgaaaaacttggcgctagggtttcccccctctcatttcccctcctcctcccgctccccctggatccccaagcctcgacgcccggctagggttttgcctccttcccgccgccgctgtttcagcgagcgagaccgaggggtagagaaagagcggtgcttagccacccatgtcctgcgtccgagcgagcgggtcgaggtacggcggaaccgctacaaggtggcggttcacgcgtaagaggggcggcggcggcgcgaggacaatatggtggagatccgcacgagctcgccgtgaggagagcctcctncaagagcgcccgtgaggggctccaagcccagntccctgcccgtccntccnggggtcgagaagaaagcttgaagcctccagctatggtttagtggggtttattcggatgataataaccttcagcttgaggcaacacacagttccgcaaattgctctctatagagaggagtccccccatcgaagaggtatcaaaacaggtgtagttcccagaattgtgcagtctctcaccagagagatttcccccagctgcagtttgaagctgcatgggctctcacaaatatggctt

SEQ ID NO: 28272 - DNA, 576 bp, Zea mays
  misc_feature: Ceres CLONE 1402325-F
  misc_feature (242)..(242): n is a, c, t, g, unknown, or other
  misc_feature (258)..(258): n is a, c, t, g, unknown, or other
  misc_feature (259)..(259): n is a, c, t, g, unknown, or other
  misc_feature (268)..(268): n is a, c, t, g, unknown, or other
tggagctccccgcggtggcggccgctctagaactagtggatcccccgggctgcaggaattcgcacgagaccattacctagaacatcctaatccaaaaacaccaacccgttctgcctccgcttcgatcatggggtggtcgcgctttcgtcgccgccatcaacggtgtcgctatctcctccctatccggcgtccgcgatgctcgccacccctcctcccccacgcgtcggagctcgccatgctcngctccctcccctcggnntcgcctcgntccccttccgccctttcgtcgggtgcgctgggaaaaagggccagcagccccaaactccccagggggggcatttcggccacctttccctgaacgcgggaatcccgccgttccccccttttgttgggtggggccccaaaccaatccgcttttgctctaagaaggaaatttttccaaaaccctcccggggggggggtccccccccgggcgggttttcaaaaaccccccccgcggggggaaaaaaaaaacgcccccccccccccccgggggggcccccccccccccccccccccccccagaaaagagggggg

SEQ ID NO: 28273 - DNA, 662 bp, Zea mays
  misc_feature: Ceres CLONE 1402327-F
  misc_feature: Encodes the peptide sequence at SEQ ID NO. 28274
  misc_feature (330)..(330): n is a, c, t, g, unknown, or other
  misc_feature (514)..(514): n is a, c, t, g, unknown, or other
  misc_feature (554)..(554): n is a, c, t, g, unknown, or other
  misc_feature (596)..(596): n is a, c, t, g, unknown, or other
  misc_feature (608)..(608): n is a, c, t, g, unknown, or other
tccccgcggtggcggccgctctagaactagtggatcccccgggctgcaggaattcgcacgagaccattacctagaacatcctaatcgaaaaaatctcctctccatcgaaaccctagcacgacgcaattcccgtcttcccacgccgtatcgccgttgctatgggcaagaagcggaagctcgagcccaaatcggcggcagggttcacgccggttaaggcctccccgaccaccaggtctgccaccgctaaggccgctggtctatccgaggtcctcgcccccgtcgaggctacgatggagaagctgccgcagggggcaggcggcgaggatgtanaggaaatcgaggaggaggtggaggtcgagaaggaagtggaagtggaagaagaagaagaaggcgagagcgactaggcttcgatccaggcgctgctggattcgttccccaaggaccagctcgtcgagctgttacgcgacgctgccatcgctcacggcgacgtgctaaccaccatccggcgcgtggncgacgccgacccggctcagcggaagatcttcgtacacggnctcgggtgggacaccacaaccgacaccctcaccgaggccttncggccatacggngaagataagggttttcaagggtcgtcaccgaccgcaacacggcaagtcaagggg

SEQ ID NO: 28274 - protein, 81 aa, Zea mays
  misc_feature: Ceres CLONE 1402327-F
  misc_feature (58)..(58): Xaa is any aa, unknown, or other
MGKKRKLEPKSAAGFTPVKASPTTRSATAKAAGLSEVLAPVEATMEKLPQGAGGEDVXEIEEEVEVEKEVEVEEEEEGESD

SEQ ID NO: 28275 - DNA, 878 bp, Zea mays
  misc_feature: Ceres CLONE 1402328-R
ttgggtaccgggccccccctcgaggtcgacggtatcgataagcttttttttttttttttttaggatgacaagagagagaacatattattcgctctagcttctttccctaccacatatcatacatttgctcgatttctgcacgctacatacaccgacataccccgaaaaggaaagaagaaaaagaagagtagattaataagaggatgaatgaacacgctacatacgcacggcgatgcctagttgtttccgtcgccattggccttggccttggccttcctgaggtgcgcgatggcctcctggagcgtcggccggaacctctccatgtccagcctcacgtcctgcttgtcgaggtaggcgtccttgagggactcccagcccttgctcttgatcccgttggggtccgtgaagatggggtggtcgcgggggtactggtccaccagcgtgctctcctccggctcgatccggtactcgaggtagcgcagccccatgtccacggacgggcctcggaagtatccggccacgaactccagccctcccagcggcaccacctggatcaccaccccgcccgtgggcaggaacaccatgttgggcagcccggcgccgtgcacgcccatgatggccgtcgcagccgttggccagctccgcgaagggcgcccccttcgtggcgtcccttcgaaaacaccgccttgaaacccgacggccttcggggccggcgcacgaacctcctccgtgttttgacaaaaccgccggggttcggcgggggggggccaaccaccagaaagccctgggggcctccttggccggcccgcctgaggaaattccgccccgcgcggggggagcccctttaagggggggcgccccattggaaaaccgggtgg

SEQ ID NO: 28276 - DNA, 676 bp, Zea mays
  misc_feature: Ceres CLONE 1402330-F
  misc_feature: Translation starting site: 167
  misc_feature: SWISSPROT Homolog: EC 2.1.1.68 Caffeate O-methyltransferase
  misc_feature: SWISSPROT Homolog: EC 2.1.1.76 Quercetin 3-O-methyltransferase
  misc_feature (301)..(301): n is a, c, t, g, unknown, or other
  misc_feature (319)..(319): n is a, c, t, g, unknown, or other
  misc_feature (321)..(321): n is a, c, t, g, unknown, or other
  misc_feature (324)..(324): n is a, c, t, g, unknown, or other
  misc_feature (325)..(325): n is a, c, t, g, unknown, or other
  misc_feature (333)..(333): n is a, c, t, g, unknown, or other
  misc_feature (355)..(355): n is a, c, t, g, unknown, or other
ccgcggtggcggccgctctagaactagtggatcccccgggctgcaggaattcgcacgagaccattacctagaacatcctatcgaaaagtcgcatcgcacgccatcagcagctagcgcgctcctcgagcccagcagagaaaggccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctggccctgctggaggtgtgnaaaaaagggggggccggngnagnnaaaggcgncgctggcgcccgaggagggggngggcgcggaggcccgcggcgcccagcgaccccgccgccgccgcggacatgagggaccgcatgctccgcctgctcgcctcctacgacggcgtccggtgccagatggaggaccgggacggccgctattagcgccgctactcggccgcgcccggttggcagtggctcccccccacgaggtagtagggcccatggaccacctccggttttggatcagaacacggcttttttggagaggtgtcactctctcccggttggtgtgttgtatttctcattcggttttttttgtttattgcaccgctgcgttcacaacctgccgccagcg

SEQ ID NO: 28277 - DNA, 669 bp, Zea mays
  misc_feature: Ceres CLONE 1402332-F
  misc_feature: Encodes the peptide sequence at SEQ ID NO. 28278
  misc_feature (563)..(563): n is a, c, t, g, unknown, or other
  misc_feature (594)..(594): n is a, c, t, g, unknown, or other
  misc_feature (653)..(653): n is a, c, t, g, unknown, or other
  misc_feature (663)..(663): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccattacctagaacatcctaatcgaaaagttaaaatgcagtaagtaattcacgacccccggcgcccccgtctccgctcctttattaatatcgccgcggcctcgcacctccatctgttctatatcgccccattgctcgctcgccaagagttcttcttgttaggcaaggcaaaagcagaagcaaaaaaagaaaggtcttgttgccgatggggagctcagggttctcgtggacgcttccggaccaccccaagctccccaaggggaaaccggtggctgtcgtcgtgctggacggatggggcgaggccaaccccgaccagtacaactgcatccatgtcgctcagactcctgtcatggactcgctaaagaatggcgctcctgagaaatggagactagtgaaggtcatggaacagctgtgggtctcccatctgatgatgcatggccaccagtggaagtggtcacatgcacttggtgctggtcgattttcgcccagntgctaaagctgtcgatcagctctgcctccgnaagattattgatggagatgggtcactacatcaagatcttttgaagtgtatctcacttantgggtgtggnnggggg

SEQ ID NO: 28278 - protein, 96 aa, Zea mays
  misc_feature: Ceres CLONE 1402332-F
  misc_feature: SWISSPROT Homolog: EC 5.4.2.1 Phosphoglycerate mutase
  misc_feature (95)..(95): Xaa is any aa, unknown, or other
MGSSGFSWTLPDHPKLPKGKPVAVVVLDGWGEANPDQYNCIHVAQTPVMDSLKNGAPEKWRLVKVMEQLWVSHLMMHGHQWKWSHALGAGRFSPXC

SEQ ID NO: 28279 - DNA, 710 bp, Zea mays
  misc_feature: Ceres CLONE 1402337-F
  misc_feature: Translation starting site: 401
  misc_feature: SWISSPROT Homolog: EC 1.2.1.3 Aldehyde dehydrogenase (NAD(+))
  misc_feature (291)..(291): n is a, c, t, g, unknown, or other
  misc_feature (322)..(322): n is a, c, t, g, unknown, or other
  misc_feature (409)..(409): n is a, c, t, g, unknown, or other
  misc_feature (448)..(448): n is a, c, t, g, unknown, or other
  misc_feature (476)..(476): n is a, c, t, g, unknown, or other
  misc_feature (567)..(567): n is a, c, t, g, unknown, or other
  misc_feature (569)..(569): n is a, c, t, g, unknown, or other
  misc_feature (645)..(645): n is a, c, t, g, unknown, or other
aagctggagctccccgcggtggcggccgctctagaactagtggatcccccgggctgcaggaattcgcacgagaccattacctagaacatcctaatcgaaaaacttactggtcctcactcccacaccaaccaaccaacctcctctgcctgccgcttctcctgctgcgggcggtcacggctgcaagtactagaggaggacatccgcttccattactgcgcctgcgaggatcggaggaaccagtagcggaggcttcgattttcggcgggcgcaataaatttcccgcatggctcnggagggccgcgtcctcgctcgtctcccgctngcctcctggcgagggcccctgccggcgcgccgcccgctgccccctctgcgctgcgcaggacagtgcctggcagatgggatgcacagngctgttgccaggtgtcccttcagaggttcagcactgcangcagcagtagaggagcccatccacgccngtcagtccatgtgaactacacaaagctcctcattaatggcaaacttttggttgattccgcatccggcaagaccttcccaactctgacctcntnaaaaagggggggagggattgctcatgggggctgagggggggacgcagaggacattaaaccgtgcagtagctgcggntcgcagggtttttttgatgaagggccatggggccgagatgtgccccaaaaggaaagtccgaatcc

SEQ ID NO: 28280 - DNA, 673 bp, Zea mays
  misc_feature: Ceres CLONE 1402340-F
  misc_feature: Encodes the peptide sequence at SEQ ID NO. 28281
  misc_feature (387)..(387): n is a, c, t, g, unknown, or other
  misc_feature (400)..(400): n is a, c, t, g, unknown, or other
tggcggccgctctagaactagtggatcccccgggctgcaggaattcgcacgagaccattacctagaacatcctaattgaaaaattttgttctccatcccagttcccccggcaaacacactctcggttctcccgtgcctctcgccgtctcgcgtcgcaacgactggccggccgccgggcgccgccgacctacgtgccaaggtccgcatattcggaaccttcgccggcgagcacccaccaggatttttttgtacatctaagatgtacagggcctcgaatttcatacctgatcctaatcaggtgctcctagatgccaaaccattaagatcgttagctccaatgttccctgcccccatgggagtcaatgttaatcagtcaagtacgccacncattggtctgtgntcactccggttggtcaattttcagccagggttttggtgcaggtaaccttcctgccctttggatcgttcacttactttcagtgccactttcaaatggtgtttcttatgcaggcaccagttgctaatggtgccattgatgccacccctatctctgcatacaaaacaaggtcaaaatatcacttggatgggtgatgatgatccttactcgggtaaccaaactgaacggaagcctaggagagccggaccttcccgggtcctggtcgtgatggttcaa

SEQ ID NO: 28281 - protein, 61 aa, Zea mays
  misc_feature: Ceres CLONE 1402340-F
  misc_feature (43)..(43): Xaa is any aa, unknown, or other
  misc_feature (47)..(47): Xaa is any aa, unknown, or other
MYRASNFIPDPNQVLLDAKPLRSLAPMFPAPMGVNVNQSSTPXIGLXSLRLVNFQPGFWCR

SEQ ID NO: 28282 - DNA, 718 bp, Zea mays
  misc_feature: Ceres CLONE 1402341-F
  misc_feature: Encodes the peptide sequence at SEQ ID NO. 28283
  misc_feature (377)..(377): n is a, c, t, g, unknown, or other
  misc_feature (438)..(438): n is a, c, t, g, unknown, or other
  misc_feature (532)..(532): n is a, c, t, g, unknown, or other
  misc_feature (589)..(589): n is a, c, t, g, unknown, or other
tggagctccccgcggtggcggccgctctagaactagtggatcccccgggctgcaggaattcgcacgagaccattacctagaacatcctaatcgaaaatctgggccccatgtgctaactgcctgtaaaccctaatcccgaatccctcccggcctcctccgtctcgcgctcgattcgaatccgagctccctatcctgctcctgctgttcccgctgcaatggaggacaacgcggtcgaagagcccgagttgagcggtgcggcggagttcgcgccggcgctcgtcgccgcccacccacacggcaactccgtcgccgtcgccatcgggcccgagctccgcgtgtttgatctcaggtctggtcatccagtttcattgtcagantgattgtggtggccattctcattcagacgcaataagagctatctgcttcagtgtgagtggnagctttgtttgcttcagctggtgatgacaactttgtgaagggtttggaagactgatttcgtggcgttgcatccagactatacttcccgagaaanaggggtcaagtggcagttgttatttagcaacgttggacctggtatgtatcttttggnaaaaaaatttgggggggggtgggttgggtaaggccacttttgcggggaaaatagtgggaaaaaaaaggtttttcaggttgataaacaaaacctgtgagccaatttcttgggtccaataattgcaggaat

SEQ ID NO: 28283 - protein, 53 aa, Zea mays
  misc_feature: Ceres CLONE 1402341-F
MEDNAVEEPELSGAAEFAPALVAAHPHGNSVAVAIGPELRVFDLRSGHPVSLS

SEQ ID NO: 28284 - DNA, 641 bp, Zea mays
  misc_feature: Ceres CLONE 1402343-F
  misc_feature: Encodes the peptide sequence at SEQ ID NO. 28285
aaagctggagctccccgcggtggcggccgctctagaactagtggatcccccgggctgcaggaattcgcacgagaccattacctagaacatcctaatcaaaaaaaggtaaggaaggagaagaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagacacggaggccaaccggcagcgtaccgcacgctgctggtcacggcggccggcctgggccagtacatctcggggccttcttcttcgaaggagagctgaccagtccgccgtcgacgccgcaagaa

SEQ ID NO: 28285 - protein, 120 aa, Zea mays
  misc_feature: Ceres CLONE 1402343-F
  misc_feature: SWISSPROT Homolog: EC 4.1.2.13 Fructose-bisphosphate aldolase
MASATVLKSSFLPKKSEWGATRQAAAPRPPTVSMVVRASAYADELVKTAKTIASPGRGILAMDESNATCGKRLASIGLETRRPTGSVPHAAGHGGRPGPVHLGAFFFEGELTSPPSTPQE

SEQ ID NO: 28286 - DNA, 903 bp, Zea mays
  misc_feature: Ceres CLONE 1402345-F
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
tgcccccccccccccccccccccccccnnnnnanaaagggtacccccaaaaaaatggagctccccgcggtggcggccgctctagactagtggatcccccgggctgcaggaattcgcacgagaccattacctagaacatcctaatcgaaaacttccgtccttggcaaccaggcccaggcatcgtttcaccgctattcctcctgccccatctcctcccgatccatccgagcccaaaccctagtccagccagatctccgccgccgccggcgagagcacggcatcagatccgccgcgatggcgttccgccggatcttatccacagcggtgcgccgccgttcggtcatcgccgcgacagtggcccgaaaacgcgcgcgaggccctccagggccgtcctccggaggggacggtgggtgttatcccccccaccccacaccccggggggcccctctcccgtgatgcccaataacaattcgtctccctacgaaaaccagtataccccccaacatatccccgtctgccttttctcgtctcccaccaaccccccatttcttccccccgatatatagcgagcgcgccacggcgggcccatctcgcccagcgcgggggactaaatagggccgccccactccctacccccgccagtccccggcacaaaccccgcggatctcaccccaccccctggacacctatcccggagccatgggcggtgtgtggtcttctctatattattatttttgccttttgcaacgtgagacgaataactgagaacacgaaggggagaatgtggaataatatctcacaacgccgcccgcactgtcccgcgcgcggcagcctacttcgtacttgtctgaacaaacgccccctcctacacacgctctatacaccgcgcagagcattcactggg

SEQ ID NO: 28287 - DNA, 737 bp, Zea mays
  misc_feature: Ceres CLONE 1402346-F
  misc_feature: Encodes the peptide sequence at SEQ ID NO. 28288
  misc_feature (501)..(501): n is a, c, t, g, unknown, or other
  misc_feature (533)..(533): n is a, c, t, g, unknown, or other
  misc_feature (534)..(534): n is a, c, t, g, unknown, or other
  misc_feature (584)..(584): n is a, c, t, g, unknown, or other
  misc_feature (587)..(587): n is a, c, t, g, unknown, or other
  misc_feature (617)..(617): n is a, c, t, g, unknown, or other
  misc_feature (674)..(674): n is a, c, t, g, unknown, or other
aaagctggagctccccgcggtggcggccgctctagaactagtggatcccccgggctgcaggaattcgcacgagaccattacctagaacatcctaatcgaaaaattatcgatcccagccccaggccatggcgacgaggtggaggaggtcgctgctctgggtcgccgtcgtccagttcctgaccctgtgcgtcgccgagcatctcgtagtggaagcatacaaaaagtcctacattgtgtatctgggatcacatgcatatggccgtgatgcgtcggcggaggagcatgctcgcgcaacccagtctcaccaccacctcctggcatcgatcctcggcggcgacgacgaccaccaccatgagacggcgcggcagtccatcttctactcctacaccaagagcagcatcaatggcttcgcggcgcacctgggaggagtcggtcgcgcagcagatcgcggagcacccctgaggtggtggcggtgctggagagcaagatgctcaagctgcncaccacgcggtcctgggacttcatggacctgnnagcgccgacggtcacgtcctccctggctccatctggaaccacggctaggntcnggacaggacgtcatcatcgccagtctcgancagcggagtggtggcccgagtcccacagcttccaagacgacgggcggccagtggcgntttcgctggaaagggctcctgttcagacaccgtttaagtaccggtgtcgcctggcaccggcaa

SEQ ID NO: 28288 - protein, 204 aa, Zea mays
  misc_feature: Ceres CLONE 1402346-F
  misc_feature (126)..(126): Xaa is any aa, unknown, or other
  misc_feature (136)..(136): Xaa is any aa, unknown, or other
  misc_feature (137)..(137): Xaa is any aa, unknown, or other
  misc_feature (164)..(164): Xaa is any aa, unknown, or other
MATRWRRSLLWVAVVQFLTLCVAEHLVVEAYKKSYIVYLGSHAYGRDASAEEHARATQSHHHLLASILGGDDDHHHETARQSIFYSYTKSSINGFAAHLGGVGRAADRGAPLRWWRCWRARCSSCXPRGPGTSWTXXRRRSRPPWLHLEPRLGSGQDVIIASLXQRSGGPSPTASKTTGGQWRFRWKGLLFRHRLSTGVAWHRQ

SEQ ID NO: 28289 - DNA, 741 bp, Zea mays
  misc_feature: Ceres CLONE 1402347-F
  misc_feature (312)..(312): n is a, c, t, g, unknown, or other
  misc_feature (332)..(332): n is a, c, t, g, unknown, or other
  misc_feature (333)..(333): n is a, c, t, g, unknown, or other
  misc_feature (335)..(335): n is a, c, t, g, unknown, or other
  misc_feature (336)..(336): n is a, c, t, g, unknown, or other
  misc_feature (339)..(339): n is a, c, t, g, unknown, or other
  misc_feature (340)..(340): n is a, c, t, g, unknown, or other
  misc_feature (342)..(342): n is a, c, t, g, unknown, or other
  misc_feature (345)..(345): n is a, c, t, g, unknown, or other
  misc_feature (464)..(464): n is a, c, t, g, unknown, or other
tcaccgcggtggcggccgctctagaactagtggatcccccgggctgcaggaattcgcacgagaccattacctagaacatcctaatcgaaaaagcctccgccatttcttcatctccaatctccatccttccatcttccgctccctcccctgcttgcgctcgtcgcgcaggcgacctcggcggcgctcgggctcggcctctcagcgacggcgtcagcggcttcccctcctgcctctcgccagtcccctcggctctgttcctctgcgcaccggccggtgaccctgcgtgcgtgcctctttctctctctctctctnctctctctctctctctctcnnannatnncnatntatctcctcccgccttctgtaaatcgtcaacggcgcccggtcccgggagatacggcgcgcgcgtcctgagggcaacgggagccaacggccgctgctccaccaaggcgggcgcgccgctntcagagccttatgctgtgatgccacaatgctaagcgttacccatcatcttagcgctcctgcttagagccgcttttttgcatcactggtatagtggagtactcaggttaagggtaacaggcacttcctccggtcaagattataggacattttgacgtttcaaggtatatagatttcgctcctgaagtacatgaaccctggctagatttacgtatgagaagaaatattcctggcaaaacattttaataattggggacggaggaaagatggataagtaat

SEQ ID NO: 28290 - DNA, 667 bp, Zea mays
  misc_feature: Ceres CLONE 1402349-F
  misc_feature: Encodes the peptide sequence at SEQ ID NO. 28291
aaagctggagctccccgcggtggcggccgctctagaactagtggatcccccgggctgcaggaattcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatggcggcggcgccagcgctcgcgcgggagctgctggacgcggcgcgggagccggagttcgcggagtggcagcgcggcgtgcggcgccggatccaccagcacccggagctggcctcccaggagcaccgcaccagcgcgctcgtgcgcgccgagctcgacgcgatcggggtcccgtacgcctggcccggcgcgcaaacgggcgtcgtggtccccatcaccgggcccgccgggggcccccgtggtcgcgctcccggccgacttggaacggcctcccccatcaaggaaaagggaaaaaaggggaatttcaagaccaagggaaaaccgggaaaaatggattggggggggccccttgaacccccacacgggggggaagccctcttggggaaaaaacaaaaggggggggttctcaaccccc

SEQ ID NO: 28291 - protein, 138 aa, Zea mays
  misc_feature: Ceres CLONE 1402349-F
  misc_feature: SWISSPROT Homolog: EC 3.5.1.14 Aminoacylase
MAAAPALARELLDAAREPEFAEWQRGVRRRIHQHPELASQEHRTSALVRAELDAIGVPYAWPGAQTGVVVPITGPAGGPRGRAPGRLGTASPIKEKGKKGNFKTKGKPGKMDWGGPLEPPHGGEALLGKKQKGGVLNP

SEQ ID NO: 28292 - DNA, 671 bp, Zea mays
  misc_feature: Ceres CLONE 1402350-F
  misc_feature: Encodes the peptide sequence at SEQ ID NO. 28293
cgctctcaactagtggatcccccgggctgcatgtattcgcacgagaccattacctagaacatcctaatcgaaaaacgacaaatcgacgatcgccgcttctcttggccattgtagagggagagagagagcgcgagcgacctaggtcagtcggtttcggttttgggcgtcagcttcagctatccgcgaccgcgacgatgggtctgcgcgtggccgccaccgcgccagctccggccggcgtgcgcgtgctcggcaggggcgccgcgcgcgtgacgccgcgaccgtgggcggctgtcggcggcaggagacgcttctccgtgcggatgtccgtcgcgaccaccgaggccaccaccaccatcgccgtgggcgcctcggaggaccaggcgctggaggctaggaactcccagacggtggtggcggtcatcctcggtggtggcggcggcgacaggctcttcccggttatcagacgcagggtcaagaccgcgttgccaattgccggcgcgcacgggcccatcgacgtgccgatgagcaactgcctacacagcgggctccccactggtctatatcttcacacaagtaccactcgccaccccctcagttggtcaacatttctccgagcctaccgattttacgtcactggggcgggccaatcagtaaacgggtcccccctcccg

SEQ ID NO: 28293 - protein, 159 aa, Zea mays
  misc_feature: Ceres CLONE 1402350-F
  misc_feature: SWISSPROT Homolog: EC 2.7.7.27 Glucose-1-phosphate adenylyltransferase
MGLRVAATAPAPAGVRVLGRGAARVTPRPWAAVGGRRRFSVRMSVATTEATTTIAVGASEDQALEARNSQTVVAVILGGGGGDRLFPVIRRRVKTALPIAGAHGPIDVPMSNCLHSGLPTGLYLHTSTTRHPLSWSTFLRAYRFYVTGAGQSVNGSPLP

SEQ ID NO: 28294 - DNA, 743 bp, Zea mays
  misc_feature: Ceres CLONE 1402351-F
  misc_feature: Translation starting site: 235
aaagctggagctccccgcggtggcggccgctctagaactagtggatcccccgggctgcaggaattcgcacgagaccattacctagaacatcctaatcaaaaaatgcatcccggcgcatagatagagagagagaagagagagccccgactcgagagccaagaacgccgtgtgctgtgtttgtgtgcatctttctccgtacacgcacgcacgcacgcaccagctagcacgaccgccatggccgccaccaggagagcattcttccacagcgccgtcgacggcattgcgcgcgccgggccgggggaggccgagctgctgccggcgccgccgcaggtcgggcgaccggtggaaggcgccagcagcatggtcttcggcttccccgtgccgcggcccacgatgccggacagccggccggccgccgtcacccagcagttctttccgcccactactacggcggcgcagcaggcgacgatggaggagcaatgccacgtgcccgccggtagcgcggcggagcagtgggtccggtcgtccgcgtccaggaagagccgccgcggcccgcggtcacggagctcgcagtaccgtggcgtcaccttctacgccgcaccggccgttggaaatccacatctgggactgtgggaaacaggtgtacttgggtggattcaaaacggcgccaggcgctggcagggcctacaaccagccccgatcaagttccgggccctgaacgcgaatcaatttcccctggacaa

SEQ ID NO: 28295 - DNA, 625 bp, Zea mays
  misc_feature: Ceres CLONE 1402352-F
  misc_feature (360)..(360): n is a, c, t, g, unknown, or other
  misc_feature (361)..(361): n is a, c, t, g, unknown, or other
  misc_feature (397)..(397): n is a, c, t, g, unknown, or other
  misc_feature (404)..(404): n is a, c, t, g, unknown, or other
  misc_feature (407)..(407): n is a, c, t, g, unknown, or other
  misc_feature (459)..(459): n is a, c, t, g, unknown, or other
  misc_feature (460)..(460): n is a, c, t, g, unknown, or other
acccgcggtggcggccgctctagaactagtggatcccccgggctgcaggaattcgcacgagaccattacctagaacatcctaatcgaaaagtcgtaagtctgcgctttcatcccttattgttccaggaacaaacaaaatctacaggtttccaagacaccaggacggagacatcgaggaggcggcggagacgccgccgcgtccttccgcttctgagccgtataacaacaaacccctcggccccgtcccctctgtccatcgatcaccttgaccacgtgcctgtgccgcaggccgcagccaggcatctccggcgaatctggtttgaggcgcggagagaggatatttgcatggcgggactgatnncatcaagcaatggcagtagcgccatgggactgccgntgctggntcnattagtctaggccaaaggttttatgcccgtttcggagtacccaccagcagannattggcgatgggtggggttattgcgggaacaaggggccgattccggtgattggtaaggccgtaatccccggggatgggaaccactaaaattttcgaatcggatgggggaaaaccagtttttcaaagaggattcccaaaaaggctttagctttggccactggaaaa

SEQ ID NO: 28296 - DNA, 701 bp, Zea mays
  misc_feature: Ceres CLONE 1402353-F
  misc_feature: Encodes the peptide sequence at SEQ ID NO. 28297
  misc_feature (564)..(564): n is a, c, t, g, unknown, or other
aaagctggagctccccgcggtggcggccgctctacaactagtggatcccccgggctgcaggaattcgcacgagaccattacctagaacatcctaatcgaaaaacaccgcaatcttcaatctccccagcaatccctagcagaagccttccatcctcactcgctcgatggcccgcacgaagcagacggcgaggaagtccaccggcggcaaggcgccgaggaagcagctggcgactaaggcggcccgcaagtctgcccctgcgaccggcggagtgaagaagccccaccgcttccgccccggcaccgtcgcgctccgggagatccgcaagtaccagaagagcacggagctgctgatccgcaagctgccgttccagcgcctggtgcgggagatcgcgcaggacttcaagaccgacctacgcttccagagctctgctgtctccgcgctgcaggaggcggctgaggcctaccttgtcgggctcttcgaggacaccaacctctgcgccatccacgccaagcgcgtcaccatcatgcccaaggacatccagcttgcccgccgcatccgccggngagagggcctaagcgtcatattttctgtcatcagtgcccgatcagaagatgagagaaaatgctggggttctgggagtttgggttactgtcgaaatcatcgaggggttggttggtcactgctgtaaacttaattatca

SEQ ID NO: 28297 - protein, 174 aa, Zea mays
  misc_feature: Ceres CLONE 1402353-F
  misc_feature (58)..(132): Pfam Name: Histone Pfam Description: Core histone H2A/H2B/H3/H4
  misc_feature (134)..(134): Xaa is any aa, unknown, or other
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRRXEGLSVIFSVISARSEDERKCWGSGSLGYCRNHRGVGWSLL

SEQ ID NO: 28298 - DNA, 743 bp, Zea mays
  misc_feature: Ceres CLONE 1402354-F
  misc_feature: Encodes the peptide sequence at SEQ ID NO. 28299
  misc_feature (448)..(448): n is a, c, t, g, unknown, or other
  misc_feature (449)..(449): n is a, c, t, g, unknown, or other
  misc_feature (467)..(467): n is a, c, t, g, unknown, or other
  misc_feature (468)..(468): n is a, c, t, g, unknown, or other
aaagctggagctccccgcggtggcggccgctctagaactagtggatcccccgggctgcaggaattcgcacgagaccattacctagaacatcctaatcgaaaaaaagcaagcagatctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgcccatgtatgaatctagcccttccttttcttgnnatctccatggggacgcgnngggtgcgtccccctctggggggatgatgccagatggatactacaattaaaacgttggtggggacaaaaaaaaaaaaaaaaagtttatcgataccgccacccccaaggggggggcccgggaccccattcccccctaaagggggcgaattaccccgccccctggcccgcgttttacaagggggggaggggaaaacccgggggttaccaatataaaccgcttggagaaccccccttttcccggggggggaaaaaaaaaaaagcccccccacatccctc

SEQ ID NO: 28299 - protein, 63 aa, Zea mays
  misc_feature: Ceres CLONE 1402354-F
MASLKAAKPSGVAAQGKEPAPKLSETATKPSAAKSGGVKKAEQKPRETKRKVKSSKQAAAAKK

SEQ ID NO: 28300 - DNA, 740 bp, Zea mays
  misc_feature: Ceres CLONE 1402357-F
  misc_feature: Encodes the peptide sequence at SEQ ID NO. 28301
  misc_feature (351)..(351): n is a, c, t, g, unknown, or other
  misc_feature (389)..(389): n is a, c, t, g, unknown, or other
  misc_feature (393)..(393): n is a, c, t, g, unknown, or other
  misc_feature (394)..(394): n is a, c, t, g, unknown, or other
  misc_feature (400)..(400): n is a, c, t, g, unknown, or other
  misc_feature (421)..(421): n is a, c, t, g, unknown, or other
  misc_feature (426)..(426): n is a, c, t, g, unknown, or other
ccccgcggtggcggccgctctagaactagtggatcccccgggctgcaggaattcgcacgagaccattacctagaacatcctaatcgaaaaatcccacgctgccctcggcgctgcgcctggacccggcacctacctcccccctccccacctcgccgccggcgggtggagtcgggctggagcagccgctctcctctgttacccccctaaccccctataaagaaaaagaaaaaaaaacagagagagagagcgagcgaccggcggctcggcagccatggggcacggcgtcagctgcgcccgcaccggcgacgagcacgactacttccgcgcggcgcaggtcggggacctcgaggncctggacgcgctccctcgacgcgacccctctctcgccngcgnngcacgntctacgaacgggctctcgggntcacnatcgcgcccgcgatggccgcctcgaggtgctgtcaatgtcttggatcacgggtgcccgccgacgtggtgattcgcaacagcaaacgccgctgatgctcccgggcgatgcacggaaagactgactgcctgctggaattccctgaaggccgggcccaatccttcaggttcgattcccaagaaggggggaacttgcctggcccaagggttctaatttgggccaagttggggggctgggaggcatccccacgggggggggggaaccagccggggggccgattgggggggtttccccggcgttctcaccgagggaggga

SEQ ID NO: 28301 - protein, 74 aa, Zea mays
  misc_feature: Ceres CLONE 1402357-F
  misc_feature (27)..(27): Xaa is any aa, unknown, or other
  misc_feature (40)..(40): Xaa is any aa, unknown, or other
  misc_feature (41)..(41): Xaa is any aa, unknown, or other
  misc_feature (52)..(52): Xaa is any aa, unknown, or other
MGHGVSCARTGDEHDYFRAAQVGDLEXLDALPRRDPSLAXXARSTNGLSGSXSRPRWPPRGAVNVLDHGCPPTW

SEQ ID NO: 28302 - DNA, 652 bp, Zea mays
  misc_feature: Ceres CLONE 1402360-F
  misc_feature (472)..(472): n is a, c, t, g, unknown, or other
  misc_feature (497)..(497): n is a, c, t, g, unknown, or other
  misc_feature (512)..(512): n is a, c, t, g, unknown, or other
  misc_feature (573)..(573): n is a, c, t, g, unknown, or other
aaagctggagctccccgcggtggcggccgctctagaactagtggatcccccgggctgcaggaattcgcacgagaccattacctagaacatcctaatcgaaaactctcgtccggtatcaggctccttcgccattcgcccgttctacgccagagcccagaggaggcagcaagtcgttctcgcatctcgcgcgcctcgtgaacgaatccctaaccccacaattaaaagcaagcaacccccgctcccccacctgcgctaattaatcacatcacgagatccccttgcccacctccttcgcctcagtcacacgcctcgatctcgcctcgccgcgctcccaccaccgcaccatcccggccgcctcgctcgcgacgcaccaaggtgccctcgtatcccgcggcgccggattgggttccctccggggatcacgcggcgagcctcgccgctcgagccacaggataatatgttcaatctgttnccttgttcatttaaacgagagtggncttgaaggatgatanttgagcaaatggatctctatttcacatattttggagatggatgatctgccaggagatgaanggagatcccagacccacccttcaagaccgaaattgcccctcccattgggagcagaaagttccagtccctggccctggaa

SEQ ID NO: 28303 - DNA, 678 bp, Zea mays
  misc_feature: Ceres CLONE 1402361-F
  misc_feature: Encodes the peptide sequence at SEQ ID NO. 28304
  misc_feature (516)..(516): n is a, c, t, g, unknown, or other
cgcggtggcggccgctctagaactagtggatcccccgggctgcaggaattcgcacgagaccattacctagaacatcctaatcgaaaaaaaatcccaccacccttttccccttccaaccctcgggatctctccggcccgccatggaagtgttctactacctcgtgttcggcgcgctcgccgccatcgtggcggcgctggagctcgccaagtccggcaaggaccgcgtcgccacctccccggccttcaactcatttaagaacaactacatcctcgtttactccctcatgatgtctggggactggctgcaggggccctacgtgtactacctctacagccagtacggcttcgacaagggcgacattggccgcctcttcatcgccggcttcggttcctccatgctcttcggcaccatcgtcggatccctcgcggataagcaggggcggaagagggcgtgtgtcacgtactgcatcacctacatcctcagctgcatcaccaagcactctccccagtaaaagntcttatggattgggcgtgtcccttggtggcattgccacttcgctgctcttctccagggtttgagtccggggctcgtggcagacacacaagaaaaagattgatcccccaaagggttggcgataacattctccaaggctatatttcttgggaaggggctagggg

SEQ ID NO: 28304 - protein, 123 aa, Zea mays
  misc_feature: Ceres CLONE 1402361-F
  misc_feature (4)..(124): Pfam Name: DUF791 Pfam Description: Protein of unknown function (DUF791)
MEVFYYLVFGALAAIVAALELAKSGKDRVATSPAFNSFKNNYILVYSLMMSGDWLQGPYVYYLYSQYGFDKGDIGRLFIAGFGSSMLFGTIVGSLADKQGRKRACVTYCITYILSCITKHSPQ

SEQ ID NO: 28305 - DNA, 685 bp, Zea mays
  misc_feature: Ceres CLONE 1402362-F
  misc_feature (388)..(388): n is a, c, t, g, unknown, or other
  misc_feature (410)..(410): n is a, c, t, g, unknown, or other
tccccgcggtggcggccgctctagaactagtggatcccccgggctgcaggaattcgcacgagaccattacctagaacatcctaatcaaaaaacgtgaactcccccgacgactcagtgcgtcttcgccgccgttttcgtcgtcgcagattaaggttcccctcctctaacacgccggcgcttccccccctgccaccgcgacactcagtcgtcgccgccgtcggctctgctgccgtggccaagcgcgttggcagcgaggattgctttagcttgcaggcactttccccacccccaccgccgctgatttcgccgttatgcggtgaagccctttcgcgtgacgggctaatcggctgcctgatttctattatgatgggggtagtgtgctcctggntcgcgtctcggaggaccctcgncgtttatcgatccagtgatgtggagctcacctttcttcggctaacggttgtgtcaaggaagagggcttgttgatccctcgggagctggttggagtggccttccggttggggaaaatctggcggaaccgcaaaggtttctgaatccgatgggcccggggggggaatctatttggggaatccccccccgagggggaggatttgtgccccggaccttccccaaaaaatccccaaaaccccccccccctctaaaggggggggaaaaggtttttgccggg

SEQ ID NO: 28306 - DNA, 717 bp, Zea mays
  misc_feature: Ceres CLONE 1402364-F
  misc_feature: Translation starting site: 231
  misc_feature (363)..(363): n is a, c, t, g, unknown, or other
  misc_feature (507)..(507): n is a, c, t, g, unknown, or other
  misc_feature (536)..(536): n is a, c, t, g, unknown, or other
tggagctccccgcggtggcggccgctctagaactagtggatcccccgggctgcaggaattcgcacgagaccattacctagaacatcctaatcgaaaaacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctggcatgaaggtcctcgtcctcgacccccaaaccgttgggatggtgagcgtggtgtacagccagtcggatctgctgncggaaggaggtcttcctcgtcgagaccatggacaacgcctccagctccagggagtccatggcgcaccctcaaggccgtctacttcctccgaccctccgctaacaacgtcagaaaagctccgcaggcacctcgccatgcggcgcnttcgccgagtaccacctattcttctcaanaaaaaaattgaagggtcccgcagattcaaatacttgctgactcgatgaaaaaaaagggagttgtgcagaaaaaagtttcaggaggtccattggggcgggattttttgggccattgggaccccataccatttcacttctcaacatacaaaataaccaacatgtatatgctccccccaacagt

SEQ ID NO: 28307 - DNA, 687 bp, Zea mays
  misc_feature: Ceres CLONE 1402365-F
  misc_feature: Encodes the peptide sequence at SEQ ID NO. 28308
aagctggagctccccgcggtggcggccgctctagaactagtggatcccccgggctgcaggaattcgcacgagaccattacctagaacatcctaatcgaaaaaaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagcaaatggtttctggtgcgggtcatggtgggtacggcggcggcgacgacgggcaggccgtcgacttccggggcaacccggcggacaagtcgaggaccggaggctggctgggcgccgggctgatcctgggcacggagctggcggagcgcgtgtgcgtgatgggcatctccatgaacctggtgacgtacctcgtcggcgagctgcacctctccaactccaagtccgccaccgtggtgaccaacttcatgggcacgctcaacctgctcgcccctcgtcggcgggttcctcgccgacgccaagctcggccgctacctcaccatcgtcatctccgccaaattgccggccacgtgcgtgagtttgctgacggtggacactacgttggccgagcatgcttttcgccgtggtgtctgcatttcccacttccctcttctattttcttcttc

SEQ ID NO: 28308 - protein, 146 aa, Zea mays
  misc_feature: Ceres CLONE 1402365-F
MVSGAGHGGYGGGDDGQAVDFRGNPADKSRTGGWLGAGLILGTELAERVCVMGISMNLVTYLVGELHLSNSKSATVVTNFMGTLNLLAPRRRVPRRRQARPLPHHRHLRQIAGHVREFADGGHYVGRACFSPWCLHFPLPSSIFFF

SEQ ID NO: 28309 - DNA, 669 bp, Zea mays
  misc_feature: Ceres CLONE 1402369-F
  misc_feature: Translation starting site: 184
  misc_feature: Pfam Name: DUF827 Pfam Description: Plant protein of unknown function (DUF827)
  misc_feature (526)..(526): n is a, c, t, g, unknown, or other
  misc_feature (528)..(528): n is a, c, t, g, unknown, or other
  misc_feature (669)..(669): n is a, c, t, g, unknown, or other
ggagctccccgcggtggcggccgctctagaactagtggatcccccgggctgcaggaattcgcacgagaccattacctagaacatcctaatcaaaaaacatatccccactctagccaagtagtcagtcctctccaatctccactctcctctcgcaccaccaaaaaaccggtcccaccgttcgccatgagctccgaagccggatgctcagctccagccgccgccgcgccggatggggcgggtggcggcagggtggagatcgacacgtccgcgccgttcgagtccgtgcgggaggccgtcgaccgtttcggtggcagcgccgcctggagctccgacctcgtcaggcgcatggtcgcgccctccaaagaaacatgaacactctgaccaagctgcagaggccatcaacgccgaggagcaagctgcacagctagagaacgagctgccagttaaaagaaagggagactcttgatgtgctcaaggagctggaggcaaccaagaagatcatagcagacctgaaaactgagatacngnaagaaagcactgaaaacatcccctgaagaggctgctgaccaggtttctgaggggggagctccacagcagaaacctgaaacaccaacattgatgtggtggtggacatggaaaggggaaaaggaaaaccattcaggttcggtn

SEQ ID NO: 28310 - DNA, 680 bp, Zea mays
  misc_feature: Ceres CLONE 1402370-F
  misc_feature: Translation starting site: 147
  misc_feature (471)..(471): n is a, c, t, g, unknown, or other
  misc_feature (586)..(586): n is a, c, t, g, unknown, or other
  misc_feature (587)..(587): n is a, c, t, g, unknown, or other
  misc_feature (595)..(595): n is a, c, t, g, unknown, or other
  misc_feature (665)..(665): n is a, c, t, g, unknown, or other
  misc_feature (666)..(666): n is a, c, t, g, unknown, or other
  misc_feature (680)..(680): n is a, c, t, g, unknown, or other
ccccgcggtggcggccgctctagaactagtggatcccccgggctgcaggaattcgcacgagaccattacctagaacatcctaatcgaaaaactgccacgagcccacgacgcccgcagccgcagcgaaccagagaggagagcgggagatgaagggcgtcgggggcggcgcggcctccccgggggactatgtctacttcaaatctgtcgtcccgctccacaagatctccattgggtcaaaactgtggaggtactatgactttggacccaaggttgtgccacctcttgtttgtatcccaggaattgcaggaacggctgatgtatactataaacagattatgtccctttgtatgaagggttatcgagtaatatctattgacgttcctcaagtttggaatcaccatgaatggattcattcatttgaaaaatttttggactccatgaatatccatcatgttcacatttatggtacantctcttggtggattcctggcacaaatatttgctgaacaccgtccaaggagagtaaagtcattggtcctatcaaatacttttcttgagacgcacaagtttctgctgccatgcttgnntctccagntgttaattggaccccttcttttttggctgagcgtacctcttgacagaaaatccgagatggtcccatgacnnatctcgagatcagn

SEQ ID NO: 28311 - DNA, 655 bp, Zea mays
  misc_feature: Ceres CLONE 1402371-F
  misc_feature: Encodes the peptide sequence at SEQ ID NO. 28312
ggagctccccgcggtggcggccgctctagaactagtggatcccccgggctgcaggaattcgcacgagaccattacctagaacatcctaatcgaaaaaaaaaaacgcacggggagcttggagacttcacgacaaatcgacgatcgccgcttctcttgcccattgtagagggagagagagagcgcgagcgacctacgtcagtcggtttcggtttggggcgtcagcttcagctatccacgaccgcgacgatggatctgcgcgtggacgccaccgcgccagctccggccggcgtgcgcgtgctcggcaggggcgccgcgcgcgtgacgcctcgaccgtgggtgtctgccggcggcaggagacgcttctccgtgcggatgctcgtcgcgaccaccgaggtcaccaccgctatcgccgtgggcgcctcgaaggaccatggcgctggcagctaggaactccaagacgctggtggcagtcatcctcggtggggtcgacgtgaccagctcgttccgctaaccatacgcagggcctagcccgcgctggcaattggcggcgtgtacaggctcatcgacgtgcttatgagcactgcataaacggcgtgatcatcgaggtgtaatcctcacgcagttgactcggaatcctgatcgcatctctgcgggg

SEQ ID NO: 28312 - protein, 66 aa, Zea mays
  misc_feature: Ceres CLONE 1402371-F
MDLRVDATAPAPAGVRVLGRGAARVTPRPWVSAGGRRRFSVRMLVATTEVTTAIAVGASKDHGAGS

SEQ ID NO: 28313 - DNA, 677 bp, Zea mays
  misc_feature: Ceres CLONE 1402376-F
  misc_feature: Encodes the peptide sequence at SEQ ID NO. 28314
  misc_feature (341)..(341): n is a, c, t, g, unknown, or other
  misc_feature (561)..(561): n is a, c, t, g, unknown, or other
  misc_feature (572)..(572): n is a, c, t, g, unknown, or other
  misc_feature (617)..(617): n is a, c, t, g, unknown, or other
  misc_feature (677)..(677): n is a, c, t, g, unknown, or other
aaagctggagctccccgcggtggcggccgctctagaactagtggatcccccgggctgcaggaattcgcacgagaccattacctagaacatcctaatctaaaaactgggcattggctactgccaactacccgtggggtcccgtggaagagaagagagcatcgccggagttggggacggcgcgccgacgaggaacaaaagaagacggcggtggggcggagatggggagccctctgggcgggtggccgtcttacaacccgcacaacttcagccagctcgtcccggccgacccatccgcccagccctcgaatgtcacaccagccacttatgttgcgacccacagngactgatccgccacccaatcaagtgataacaacggagtccaggaacatcctgctgaggcacttctaccagaaatccgagaagctgaggccaaagagacctgccccggacaacctcgatacggagaacagcagcagcagcaacaacaagcagcccaggggaccggtcggcgacgtcggtgggcagtcgtcgagcgcgagaagctgaagcacagctggtggncgtccactccntccctgcctgcctgcttcttctcatctctgggggtcgtcatgcanaggcagaggcagatgcagccctgtggtgtctgtccctctcgctactaacctatctgaagn

SEQ ID NO: 28314 - protein, 79 aa, Zea mays
  misc_feature: Ceres CLONE 1402376-F
  misc_feature (12)..(12): Xaa is any aa, unknown, or other
MSHQPLMLRPTXTDPPPNQVITTESRNILLRHFYQKSEKLRPKRPAPDNLDTENSSSSNNKQPRGPVGDVGGQSSSARS

SEQ ID NO: 28315 - DNA, 716 bp, Zea mays
  misc_feature: Ceres CLONE 1402377-F
  misc_feature: Translation starting site: 242
aaagctggagctccccgcggtggcggccgctctagaactagtggatcccccgggctgcaggaattcgcacgagaccattacctagaacatcctaatcaaaagaaaacacaccatctccacctcgccgccgccgctcggatttccctctacctcaccctgtccgccgtcaaggagcagcaaggccaaggccgccgcggcgtcggcggccgtggtcgtggacgacatagccgagctgcaggggatgctagagcgcctgcggctggagaaggagaaggcggaggagatggttagggagcgggatgaggtcatccggaagaaggaggaggagatcgagaccagagacaaggagcaggagcgtctccaggccgagctcaggaaggcgcaacgcgccaaggagttcaagcctaccgtgagcttccccctcgtcaagtcgttgctggagaaagagcaagaagcagacgacaagggaaagaagaagaaggggaagggcggccacgagaggaagaagccgtgccccggcgtacgtgctctggctcaaggaccgttggaccgaggtcaagaaggagaaccctgaggccgacttccagggaggtgtccaacacgctgggcgcccaagtggaaggctctggggcgccgaggagaagcagcccctatgaggatcgatacgccagggagaaggagcctacctgggcaggtggttggccaggagaagcgcg

SEQ ID NO: 28316 - DNA, 708 bp, Zea mays
  misc_feature: Ceres CLONE 1402379-F
  misc_feature: Encodes the peptide sequence at SEQ ID NO. 28317
  misc_feature (573)..(573): n is a, c, t, g, unknown, or other
  misc_feature (579)..(579): n is a, c, t, g, unknown, or other
  misc_feature (673)..(673): n is a, c, t, g, unknown, or other
  misc_feature (691)..(691): n is a, c, t, g, unknown, or other
  misc_feature (706)..(706): n is a, c, t, g, unknown, or other
aaagctggagctccccgcggtggcggccgctctagaactagtggatcccccgggctgcaggaattcgcacgagaccattacctagaacatcctaatcaaaaggtggttgacggccgcttacccgcaccggcgccatgcgcgcgcgcggctaggtggtcgaggtcaagccaaacgctgcccaccgcctctgcctctgcctcgcatatatcctcgcgcacgttctttgctcgtctcgcactcgcttccttcgacgactcatcgccgatcacaccaggctagctagcccacccacagtcgtagggccaggaccgatcggaggagctcggtttttcgaccaggaccgccgccgccacacccgaagaagccgacgatgcagacgacgacgtcctcggcggcggcgtcgccgcgcccgcgcgcgcgggcgccgcagtccgtggtggccgagctggagggcgcgctgctccggagcgcggacacgttcccgtacttcatgctcgtggcgttcgaggcgtccgggctgccgcgcttcgcgctgctgctggcgctgtggccgctgctgcggctgctggaggnggcggnccggcgcggcctggcgctgcgcgccgccgcgtttgtggcccccgcgccgtgccgcgcgccggggtgggggcgggttccgggccctgctgtcccngtcctggccgtcgccccnccccgtggtcgtggngt

SEQ ID NO: 28317 - protein, 112 aa, Zea mays
  misc_feature: Ceres CLONE 1402379-F
  misc_feature: SWISSPROT Homolog: EC 2.3.1.15 Glycerol-3-phosphate O-acyltransferase
  misc_feature (68)..(68): Xaa is any aa, unknown, or other
  misc_feature (70)..(70): Xaa is any aa, unknown, or other
MQTTTSSAAASPRPRARAPQSVVAELEGALLRSADTFPYFMLVAFEASGLPRFALLLALWPLLRLLEXAXRRGLALRAAAFVAPAPCRAPGWGRVPGPAVPVLAVAPPRGRG

SEQ ID NO: 28318 - DNA, 690 bp, Zea mays
  misc_feature: Ceres CLONE 1402383-F
  misc_feature: Translation starting site: 195
  misc_feature (293)..(293): n is a, c, t, g, unknown, or other
  misc_feature (459)..(459): n is a, c, t, g, unknown, or other
gctcttaactagtggatcccccgggctgcaggaattcgcacgagaccattacctagaacatcctaatcgaaaaatttccacaagacccttgcgtgctctctctctctcctcttggcgacgactgggtggcaggtgcccaggtcttcttgggacccttcgccggcgacaagcaccaccagcttgcaggtttcaagatggaagtggtaaaaactacacatgctgggcatgcaaaatctcttgtatcaactattgattttagtacctgtcctgatggtattgtatgtgggggtggnggatgggattgttaaatgaggtcctcaatggtcttctatgcagagatgatcaaaatatgtctgcctctgtaccaataggtataataccctgctgggtctgataactcacttatttggacaggtcttgggttgtcaaggatccaatttctgcagcattgtcaatggnccagggggaggtcttacacctatttgatggttttttctgttggaatggaattcaaagtgggactattgcattatgggtacaccggaatcctaatttttgggttttggtaagggatggtctttgaccttcctcagagaaggatctgaaaggcattttgggccctttagcaaacttttggaaaatggcctttcccccaaccccgggtgttgcgccaagacacagtgtgcgatt

SEQ ID NO: 28319 - DNA, 723 bp, Zea mays
  misc_feature: Ceres CLONE 1402387-F
  misc_feature: Encodes the peptide sequence at SEQ ID NO. 28320
  misc_feature (419)..(419): n is a, c, t, g, unknown, or other
  misc_feature (462)..(462): n is a, c, t, g, unknown, or other
  misc_feature (544)..(544): n is a, c, t, g, unknown, or other
  misc_feature (549)..(549): n is a, c, t, g, unknown, or other
  misc_feature (598)..(598): n is a, c, t, g, unknown, or other
  misc_feature (599)..(599): n is a, c, t, g, unknown, or other
  misc_feature (637)..(637): n is a, c, t, g, unknown, or other
  misc_feature (687)..(687): n is a, c, t, g, unknown, or other
aaagctggagctccccgcggtggcggccgctctagaactagtggatcccccgggctgcaggaattcgcacgagaccattacctagaacatcctaatcgaaaaacggtccaccgacgactcttcttcctcacctcctcccgctccagctccagctcgtctctctcctcgcctcgcgtagggtttcgcttcccgtctcgccgccgtcagcatgggggacaactacgatgacgaaggcgagccgatcgtgaacctcgacgaacgggaaccctcccctgagcatcagccgtacgaagacctcgatgacgacctcgacggcggcggcgattggacccgcgaccgctctccgacccccgtccacggcgacgacggcggggcagggtcctcctccaagccccgaaagcgccttctcaaaaagggcnggcggtggaggcatgcccggcgatgacgggctggatgactttngggttggaggacgaggacgcggacccttcggctgaggcgaggaagaggaagggctcgtcgtcgctgagggacctcgcgaggngcggngcgggcagggaagaagaaggctaagaaaatgcggagggaggacgacggnnagggggagggacactgggatggtgaggggataggcggngatcagggaggaagggactcaggcggtagggatgaccaggatgatggggnagagggagatccaggagctctgggataacattgctg

SEQ ID NO: 28320 - protein, 78 aa, Zea mays
  misc_feature: Ceres CLONE 1402387-F
  misc_feature (71)..(71): Xaa is any aa, unknown, or other
MGDNYDDEGEPIVNLDEREPSPEHQPYEDLDDDLDGGGDWTRDRSPTPVHGDDGGAGSSSKPRKRLLKKGXRWRHARR

SEQ ID NO: 28321 - DNA, 672 bp, Zea mays
  misc_feature: Ceres CLONE 1402390-F
  misc_feature: Encodes the peptide sequence at SEQ ID NO. 28322
  misc_feature (396)..(396): n is a, c, t, g, unknown, or other
  misc_feature (397)..(397): n is a, c, t, g, unknown, or other
  misc_feature (549)..(549): n is a, c, t, g, unknown, or other
  misc_feature (610)..(610): n is a, c, t, g, unknown, or other
cgcggtggcggccgctctagaactagtggatcccccgggctgcaggaattcgcacgagaccattacctagaacatcctaatcgaaaaacacgatcgatcgggccaggcccgcattctatgggatccgtctctccactctcttctctaccgaacacaatctcatccgtcttcctcttccccatcagccgccctaccgagtcttcgcacgcacgacgcttcgtcaggatcgattcgcgagacctctcctgtccggatcgaggttcatggtttacatatgcgcgtttgtttactgatgcataccacgaccacctgatccggatgtcaggacagatctcctgctttaatcgagtccagttcatgtatgaactctcccttttcctggcacgttgctaatgnnaaaaggggtgttccgggatttaagagaaccacccacgcatccatgtctgaccagcaaaggcactacggcagctacgagctcctcccggtcaccaagaatttgcggtgcctggtcggcacgcggccgttcctcttggaaagccgagtcaccgnaaggcttggaagtttagcatattggcagggagtgcaaagacgacggttgcttagtgacagnaaacagggacgacactccccgagcaccgaaaagagaaaaaaagggcgaaggcagaagccctt

SEQ ID NO: 28322 - protein, 77 aa, Zea mays
  misc_feature: Ceres CLONE 1402390-F
  misc_feature (37)..(37): Xaa is any aa, unknown, or other
  misc_feature (57)..(57): Xaa is any aa, unknown, or other
MSDQQRHYGSYELLPVTKNLRCLVGTRPFLLESRVTXRLGSLAYWQGVQRRRLLSDXKQGRHSPSTEKRKKGRRQKP

SEQ ID NO: 28323 - DNA, 626 bp, Zea mays
  misc_feature: Ceres CLONE 1402393-F
  misc_feature: Encodes the peptide sequence at SEQ ID NO. 28324
  misc_feature (246)..(246): n is a, c, t, g, unknown, or other
  misc_feature (336)..(336): n is a, c, t, g, unknown, or other
  misc_feature (355)..(355): n is a, c, t, g, unknown, or other
  misc_feature (356)..(356): n is a, c, t, g, unknown, or other
  misc_feature (364)..(364): n is a, c, t, g, unknown, or other
  misc_feature (365)..(365): n is a, c, t, g, unknown, or other
  misc_feature (604)..(604): n is a, c, t, g, unknown, or other
  misc_feature (607)..(607): n is a, c, t, g, unknown, or other
tccccgcggtggcggccgctctagaactagtggatcccccgggctgcaggaattcgcacgagaccattacctagaacatcctaatcgaaaaagaagcgagagagatccggagcagccgcagtcccaccgaccccgccgccggtcgccctccatctcctcgccgctgcctctcgtttctcttttcaataatcaagatgagccgtggtggtagtgccggtggtggtcaaagttctctgggttatctcntttggaagcggtgagccccccaaaccagcagtggcaccagctgcaagtgctccacctggtgagaaccatctgctgcaagactgatgcggncaagcaggttgctgctggnngtaccagnncaaaccataactacccacagggctgatggtcagaacactggcaactttcctttacggacggtcttttcaccaaggggccaggtgggttccctggggggggggtcctcccctggggttaccctgggttcggggggaaattggatgggccccccgggggggtggggggggcccccccccaaaaagaaaatacccccccccccccggggggggggggggggggggtgttttttttttaaagnggnggggggggaaaaaccaccg

SEQ ID NO: 28324 - protein, 99 aa, Zea mays
  misc_feature: Ceres CLONE 1402393-F
  misc_feature (3)..(3): Xaa is any aa, unknown, or other
  misc_feature (9)..(9): Xaa is any aa, unknown, or other
  misc_feature (12)..(12): Xaa is any aa, unknown, or other
  misc_feature (92)..(92): Xaa is any aa, unknown, or other
  misc_feature (93)..(93): Xaa is any aa, unknown, or other
MRXSRLLLXVPXQTITTHRADGQNTGNFPLRTVFSPRGQVGSLGGGSSPGVTLGSGGNWMGPPGGWGGPPPKKKIPPPPRGGGGGGCFFFKXXGGEKPP

SEQ ID NO: 28325 - DNA, 725 bp, Zea mays
  misc_feature: Ceres CLONE 1402394-F
  misc_feature: Encodes the peptide sequence at SEQ ID NO. 28326
cgctctagaactagtggatcccccgggctgcaggaattcgcacgagaccattacctagaacatcctaatcaaaaaacacgcgcgcacgtaaaaacgaaaaaaggtccccggccgagaccgagagccgcggtccagagcggggggcggccggcaaggacgaaacggcccaacgccaccacctccaccacctcgtcctcgatcgacacctcccccgtcgccgtcccgtgactccccgtccagccgtccaggcccagctgcccccgcgacccagacgaccacgtccgcctcggcctgcgcctccccgctacaagagtccgtccgcccgccagcgctgcggtgccagcgagcccctccctcctccactctctgcggcgcggagatcccgtcctttctctgtgcccccggtaccgcgaggagccactgcccaggcgccggcgtttttggaactgggcatggaggcggcggcggcggcttcggcggcggtccgggggttcgggcgctggactgaccaggtggcaggcggcgggctttggcggcggtgggcggctggggtgtgggcggcctccttctacgacctcacgcgccgggcgcgcgcgctcgtccagccgtgggtcaccgcgccggtgcacgccgagacgccggccatcctcagggtccagaaagtggagcacaagttgctggacaatttcttctccgtgctggcatggcggtgcctcggtgccctc

SEQ ID NO: 28326 - protein, 91 aa, Zea mays
  misc_feature: Ceres CLONE 1402394-F
MEAAAAASAAVRGFGRWTDQVAGGGLWRRWAAGVWAASFYDLTRRARALVQPWVTAPVHAETPAILRVQKVEHKLLDNFFSVLAWRCLGAL

SEQ ID NO: 28327 - DNA, 692 bp, Zea mays
  misc_feature: Ceres CLONE 1402396-F
  misc_feature: Translation starting site: 234
  misc_feature (291)..(291): n is a, c, t, g, unknown, or other
  misc_feature (314)..(314): n is a, c, t, g, unknown, or other
  misc_feature (345)..(345): n is a, c, t, g, unknown, or other
  misc_feature (396)..(396): n is a, c, t, g, unknown, or other
gctctagaactagtggatcccccgggctgcaggaattcgcacgagaccattacctagaacatcctaatcgaaaaacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcgnttgacgcggaggaggggcggcgncggcgcgaggacatatggtggagatccgcangagcccgcgtgaggagagcctccctcagaggcgccgtgagggggctccagnccaggtcctgccccctcctccgggtcaagagaagcttgaaagctctcagctatggtaggggggttaatccgatggaaataccttcagctgaggcaccacccggtcccgaattgcttcctatatggagggagccccccttcgaaaagttttcaaacgggggagtcccaaatttgggggcttccccgaaggggttcccccgggtggtttgagcgtggggggctccaaaattggcttgggctcgaaaaccaagggggttttggctgggagttgccctatttgggaactttgggggggag

SEQ ID NO: 28328 - DNA, 561 bp, Zea mays
  misc_feature: Ceres CLONE 1402401-F
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
tggagctcaccgcggtggcggccgctctagaatagtggatcccccgggctgcaggattcgcacgagacattacctagaacatcctaatcgaaaacatcgatcagtcgcgtgtctaggtttcctctctcacatagcgcccgctctgtcgccctttcgtcactctttttcctctcctcctggctgggcaggaaaggggaaatcagagccccgattgggccaaaacaaaccccgggaacaattgaatggccctggggcccccccccccnnnaaaaaacccccaagggaagggggggaaaaaacccccctccccttaaaagggaaaaaattcgggggcccctttggggagggcccttcccaaggggggaaccgggagaaaccccgggggggggggggggggggccttagggttccccaaagaaaaagggggggggggggcctttttttcacaacaaaagggggggggtttttcttgggggggcccccccgcccccacccccgggggttttttttggggggggggggcccaccaaaaaaaaaaaatttttctgggggggggggggg

SEQ ID NO: 28329 - DNA, 611 bp, Zea mays
  misc_feature: Ceres CLONE 1402402-F
  misc_feature (55)..(55): n is a, c, t, g, unknown, or other
  misc_feature (225)..(225): n is a, c, t, g, unknown, or other
  misc_feature (261)..(261): n is a, c, t, g, unknown, or other
  misc_feature (302)..(302): n is a, c, t, g, unknown, or other
  misc_feature (312)..(312): n is a, c, t, g, unknown, or other
  misc_feature (315)..(315): n is a, c, t, g, unknown, or other
  misc_feature (356)..(356): n is a, c, t, g, unknown, or other
aaagctggagctccaccgcggtgggcggccgctctagaaactagtggatcccccngggctgcaggaattcgcacgagaccattacctagaacatcctaatcaaaaaccaaaccagcgaggcagctaccgttttgtcgccatagcactcccgccgaccccctcgccgccgcctggaatggagaccagcaccaagaagcttagcagcccttcgtatcacctccctgnacgacgatgacgacgagaccgagatcccgcaccagncccctcaagcaggcctctccaccgctgaagcggattatgangacgacgacnatnaggaggaaaaagcccgagtggactctgggggtctttacaancccgaagcaccaggcctccctctccgccactggttccccagaagggccgggggaattctcgggtgggctaaacccgggaaacttgcccgcggaaaagcccaccaacgggggtttttggggggaaaccccccgaaattccccccccccgggggtttttttttttgtggaaaaaaaattcccccaacccccccggcggtattttgtgggaaaaaaaaccacctggccacaaaaaaaggttgtgggggggtttaaaat

SEQ ID NO: 28330 - DNA, 739 bp, Zea mays
  misc_feature: Ceres CLONE 1402404-F
  misc_feature: Encodes the peptide sequence at SEQ ID NO. 28331
  misc_feature (347)..(347): n is a, c, t, g, unknown, or other
  misc_feature (475)..(475): n is a, c, t, g, unknown, or other
  misc_feature (594)..(594): n is a, c, t, g, unknown, or other
  misc_feature (677)..(677): n is a, c, t, g, unknown, or other
  misc_feature (716)..(716): n is a, c, t, g, unknown, or other
ggagctccccgcggtggcggccgctctataactagtggatcccccgggctgcaggaattcgcacgagaccattacctagaacatcctaatcgaaaatttttctcggccgggagccgcaattccatcctgctgctagagttacatactcacccaatagaacaattctatgcccggtgattgtacctcctgaagtagaagagcatactgaagcagaactcgagtggtgttggatcgaaatggaaggcgggatgtcaagtttggaagccgccatgaaagcttcttcatcgatggcaagcagcatggcaaggaatgctgaccctaaccaacagactctccgccccaatttnagtggagcagttctattttccaagacctggtcaatctttgccaggcattcctccattttttgggcctccctctagtttgtatcttcctaatgacaatgaagctaaatttggcaacaactttgaatcanatccttcacagaatacagattggaacccacaggcaatagtgagcaacctaaccttccttgagcagaagatcaagcaggtaaaggatattgtgcagtccatgagtaaccgagagaacagnttagctgggtgtttccctgtgaggtagctgcaaagcagcagctcataaccgctgacctcactagcattataatcagctctatncctactggcgggttcgctgctccccttcatggagaaccnactttctagcagcaatcagcagg

SEQ ID NO: 28331 - protein, 103 aa, Zea mays
  misc_feature: Ceres CLONE 1402404-F
  misc_feature (13)..(13): Xaa is any aa, unknown, or other
  misc_feature (56)..(56): Xaa is any aa, unknown, or other
  misc_feature (95)..(95): Xaa is any aa, unknown, or other
MLTLTNRLSAPIXVEQFYFPRPGQSLPGIPPFFGPPSSLYLPNDNEAKFGNNFESXPSQNTDWNPQAIVSNLTFLEQKIKQVKDIVQSMSNRENXLAGCFPVR

SEQ ID NO: 28332 - DNA, 599 bp, Zea mays
  misc_feature: Ceres CLONE 1402412-F
  misc_feature (175)..(175): n is a, c, t, g, unknown, or other
  misc_feature (237)..(237): n is a, c, t, g, unknown, or other
  misc_feature (240)..(240): n is a, c, t, g, unknown, or other
  misc_feature (247)..(247): n is a, c, t, g, unknown, or other
  misc_feature (273)..(273): n is a, c, t, g, unknown, or other
  misc_feature (275)..(275): n is a, c, t, g, unknown, or other
  misc_feature (282)..(282): n is a, c, t, g, unknown, or other
  misc_feature (292)..(292): n is a, c, t, g, unknown, or other
  misc_feature (299)..(299): n is a, c, t, g, unknown, or other
  misc_feature (303)..(303): n is a, c, t, g, unknown, or other
  misc_feature (350)..(350): n is a, c, t, g, unknown, or other
aaagctggagctccccgcggtggcggccgctctagaactagtggatcccccgggctgcaggaattcgcacgagaccattacctagaacatcctaatcgaaaacactaaacgcagatttcctcggttccttgtacgttcagggccggacgacggggacagacagcggtgtcgcggnggcacctgcttcccaacgccgtccgcacctgctgccctgtcgtccgcccctctttccttctnccntccctcnactggtttcctcaacctcccgacccnancacgggncgtgccccgncaaagcngccnacccgcacacagcaacaactgggggtggctttacttggcttgggggngggggtttctggttgtccccgggggccggaaactctcacaggttggccaaatttcccacaaggggttttcccgggataaatggggaatgggcaaaacccccgggttttggggttggaaaccctggccagggggggaaattgggaggccccccctgggggggccctgtggtgccccaggggggataagagggctcttttttttccaaaaaaaaaaagggggtttttttttgccccccaaaaaaaaaaaaa

SEQ ID NO: 28333 - DNA, 619 bp, Zea mays
  misc_feature: Ceres CLONE 1402413-F
  misc_feature (297)..(297): n is a, c, t, g, unknown, or other
  misc_feature (331)..(331): n is a, c, t, g, unknown, or other
  misc_feature (362)..(362): n is a, c, t, g, unknown, or other
  misc_feature (382)..(382): n is a, c, t, g, unknown, or other
  misc_feature (402)..(402): n is a, c, t, g, unknown, or other
  misc_feature (471)..(471): n is a, c, t, g, unknown, or other
  misc_feature (516)..(516): n is a, c, t, g, unknown, or other
aaagctggagctccccgcggtggcggccgctctagaactagtggatcccccgggctgcaggaattcgcacgagaccattacctagaacatcctaatcgaaaaaccatcccggaggtaatcttgcgccgattcggtgccgatttgcgccatccgcgaccggaggctccgccgggtcttgtgttcttgcggggcgggggctcaggacaacctggcctctgcttgattggattcggggcgttcggcgcctccagctcgcgatctttcctggcggtttcgtcgaccgctggtcaacctggncgggtcggtccgggggctctttcactccgtgctngctgggcacgtcgctttagtcaagtcttggnccagattttagctatctccnggtcaaaaaggctttacccngattcttgggattgggtggcttcttgggggcaagaagccggttccctgtttcgtcccctgggctccagnatgttctgtaaaaaaccgggtccccatctcccggggaaggggttncgggggctctttgggttttggggcctcccggaatcgttcccggaaaagttatttttggcccttgggggaaaagggcccaagaacccccaaaaatggcccaagg

SEQ ID NO: 28334 - DNA, 684 bp, Zea mays
  misc_feature: Ceres CLONE 1402416-F
  misc_feature: Encodes the peptide sequence at SEQ ID NO. 28335
  misc_feature (537)..(537): n is a, c, t, g, unknown, or other
  misc_feature (571)..(571): n is a, c, t, g, unknown, or other
  misc_feature (572)..(572): n is a, c, t, g, unknown, or other
cgcggtggcggccgctctagaactagtggatcccccgggctgcaggaattcgcacgagaccattacctagaacatcctaatcaaaaaacaacactcgcctgccctgccctctcatctcgcttcgcttccattccatcgcgccagtcgccagactcaccagggagacagggagagtagggggaaatatcaattagaaacaacgaggaactagcaaagaaagaaggataactcccataagaaaaatcgccaaatacgccattcatcttctccgcccgggtttcagaacgtgcggcagtttagccaggatggtggcgatcgagaaccagaaccagagccaggccgcggtggcggtggcggcggaggcggtgccggcgccggcgtcgcggatccccagggaggcgcggcgcctgctgcacgagctggcggcggcgtgggcggacgtggccgactgccgccgcgctggaggtcgtgccgctcaagggggcctggaccaacgaggtctaccaggcgcgctggctcactggcaggcctggcggnccagaaagaggagcccagggcggaagagggaagnngaggaaggggctcgggggggatttacggcggacggggtcgacctcttcttcgaacggcggggacgagggggccaacctttcgagtgcatgttcacgcccatgggccagggtc

SEQ ID NO: 28335 - protein, 126 aa, Zea mays
  misc_feature: Ceres CLONE 1402416-F
  misc_feature (1)..(52): Pfam Name: Choline_kin_N Pfam Description: Choline kinase N terminus
  misc_feature (78)..(78): Xaa is any aa, unknown, or other
  misc_feature (89)..(89): Xaa is any aa, unknown, or other
MVAIENQNQSQAAVAVAAEAVPAPASRIPREARRLLHELAAAWADVADCRRAGGRAAQGGLDQRGLPGALAHWQAWRXRKRSPGRKREXEEGARGGFTADGVDLFFERRGRGGQPFECMFTPMGQG

SEQ ID NO: 28336 - DNA, 646 bp, Zea mays
  misc_feature: Ceres CLONE 1402417-F
  misc_feature: Encodes the peptide sequence at SEQ ID NO. 28337
aaagctggagctccccgcggtggcggccgctctcgaatagtggatcccccgggctgcaggaactcgcacgagaccattacctagaacatcctaatcgaaaaagagcagccgacaactctctaccgtccgagaccccaagcaccagcgcggcggcggcggcggcggcgaccatggctgtcgggaagaacaagaggatctccaagggaaagaagtttaagatctgttccacagatcacgcgtgcgcgctcgcgaatcgggggttccacacatagcttcggcgttttgaatttgatgtactaatggagtctaagggtggcaagaagtctagcaggtagtccgtttccctggatgtatggaaaggtccccccttgggttacccgattttggggggcggtttcccccccccccgcccggggggggggcgacaaaaaaaaaaacccccccccgggggtggtgtttatttttctccccccccgccgggggggcacaacaaaaacacccccccccggaccgacccccccccttgttgtgcggccccccccctccccccgcgcagcggggggcggattttttttttttgtggtgggccccgcgcgttattatatcccccccccccccccggggggggggggggcgtgttcacaca

SEQ ID NO: 28337 - protein, 89 aa, Zea mays
  misc_feature: Ceres CLONE 1402417-F
SWSSPRWRPLSNSGSPGLQELARDHYLEHPNRKRAADNSLPSETPSTSAAAAAAATMAVGKNKRISKGKKFKICSTDHACALANRGFHT

SEQ ID NO: 28338 - DNA, 673 bp, Zea mays
  misc_feature: Ceres CLONE 1402418-F
  misc_feature: Encodes the peptide sequence at SEQ ID NO. 28339
gctctacaactagtggatcccccgggctgcaggaattcgcacgagaccattacctagaacatcctaatcgaaaacgaaaaattcgaaagatccctccaggaaagatttttcttccctcctccgacgccccagcccaccaacacactctataaagcagccctcagtcacacacagaacgcacaagcgcaagccgggcaagaaaactccgtaggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctggcgagcccggaagcggcgcggttcgtgctggtgacgcaggcgcacctgttcaagccgacctacccgcggagcaaggagcgcatgatcgggccgtcggctctcttcttccaccagggcggactacacctccgcctccggaaggtcgtccagggcgcgcttcggcccgacgatg

SEQ ID NO: 28339 - protein, 148 aa, Zea mays
  misc_feature: Ceres CLONE 1402418-F
  misc_feature: SWISSPROT Homolog: EC 1.14.13.93 (+)-abscisic acid 8'-hydroxylase
MAFFLALVCILILLAIASYVQYTRWQKGKGRFGGHGRSAPLKLPPGSMGWPYLGETLQLYSQDPSFFFASKQKRYGEIFKTHLLGCPCVMLASPEAARFVLVTQAHLFKPTYPRSKERMIGPSALFFHQGGLHLRLRKVVQGALRPDD

SEQ ID NO: 28340 - DNA, 758 bp, Zea mays
  misc_feature: Ceres CLONE 1402419-F
  misc_feature: Encodes the peptide sequence at SEQ ID NO. 28341
  misc_feature (416)..(416): n is a, c, t, g, unknown, or other
  misc_feature (446)..(446): n is a, c, t, g, unknown, or other
  misc_feature (465)..(465): n is a, c, t, g, unknown, or other
  misc_feature (484)..(484): n is a, c, t, g, unknown, or other
  misc_feature (489)..(489): n is a, c, t, g, unknown, or other
  misc_feature (562)..(562): n is a, c, t, g, unknown, or other
  misc_feature (583)..(583): n is a, c, t, g, unknown, or other
tccccgcggtggcggccgctctagaactagtggatcccccgggctgcaggaattcgcacgagaccattacctagaacatcctaatcgaaaaaggctccaattggcatctcgtctcgcgctcgctttccccagtccactcgcgctctcgtttcccggagcttcgcgatgcagcgccttctcgcgctggtggcagccctgctggtgctgctggcgtcgcgtccagcgctggccaccgacccctacgccttcttcgactgggacgtctcctacgtcactgcggcgccgctcggcgtcaagcagcaggtgataggcatcaacggcaagttcccagggcccgtcgtgaacgtcagcaccaactggaacgtcgtcgtcaacgtgctcaacgacctcgacgagccccctccctcatcactggnaaacggatccagcaccggaagaactgctgncaggaccggggtgctcggnaccaactggcccatcccgnccggntggaaactggacgtacgagttcccaggtgaagggaccaaaagggaaggtttcttctaattccccttccacggnctgaaaggggccccggggggntttcggggggatttttgtaaaaaaccgggaagtttttcgccgggcctttgcccccccgaaggggaattccactttttacgggggagggaaaaaaaaaccccccggttttgggaaaaattgtgaaaagggaaaaacccttttttcccccggggtggtttaaaaaagagagggcccc

SEQ ID NO: 28341 - protein, 117 aa, Zea mays
  misc_feature: Ceres CLONE 1402419-F
  misc_feature (32)..(118): Pfam Name: Cu-oxidase_3 Pfam Description: Multicopper oxidase
  misc_feature: SWISSPROT Homolog: EC 1.10.3.3 L-ascorbate oxidase
  misc_feature (84)..(84): Xaa is any aa, unknown, or other
  misc_feature (94)..(94): Xaa is any aa, unknown, or other
  misc_feature (107)..(107): Xaa is any aa, unknown, or other
MQRLLALVAALLVLLASRPALATDPYAFFDWDVSYVTAAPLGVKQQVIGINGKFPGPVVNVSTNWNVVVNVLNDLDEPPPSSLXNGSSTGRTAXRTGVLGTNWPIPXGWKLDVRVPR

SEQ ID NO: 28342 - DNA, 730 bp, Zea mays
  misc_feature: Ceres CLONE 1402421-F
  misc_feature: Encodes the peptide sequence at SEQ ID NO. 28343
  misc_feature (453)..(453): n is a, c, t, g, unknown, or other
  misc_feature (617)..(617): n is a, c, t, g, unknown, or other
  misc_feature (635)..(635): n is a, c, t, g, unknown, or other
  misc_feature (690)..(690): n is a, c, t, g, unknown, or other
tccccgcggtggcggccgctctagaactagtggatcccccgggctgcaggaattcgcacgagaccattacctagaacatcctaatcgaaaagattcctctccccgtgattccccgtcccgtggccgcagcccccgtcggcgtcctcgcggctgcagccgaccatagccgccgcgcccgcaaatcacgcgcccccttccatccatggcaggtccgcgcccctgcggcccaaatcgcgcggatggaaggtacgcgcgtccgctaggcctacaactcctcctcctctccccattgctcagtgtaggcagtccccaaatccacgcgtccgcgccctcatcctctccccagcaatgcgccgccacctcctcctcggacgcgcggtggaaggttcgcgcctttgcgccccccaaatcgcgcggatggaaggtccgtggtgtggggaaggcctgggcggnggtgctcatcctgctcatcgttgtgtacgggggccgggttcggctggtcctggggcccccctcgggtggctggtccccaacgagatttcccgctggaggtgcgcgctgccgggcaagcgtcccgcttggaggtgcggttgccatgcctggaccctcgtcgccgncataagaagtaacggccnaccgattgaagtacctcccctagggctgactcgtcggcttcgtcccgcaaacggnaagctgcgacgcctgtccttgcatacacggctctcaaagg

SEQ ID NO: 28343 - protein, 138 aa, Zea mays
  misc_feature: Ceres CLONE 1402421-F
  misc_feature (84)..(84): Xaa is any aa, unknown, or other
MAGPRPCGPNRADGRYARPLGLQLLLLSPLLSVGSPQIHASAPSSSPQQCAATSSSDARWKVRAFAPPKSRGWKVRGVGKAWAXVLILLIVVYGGRVRLVLGPPSGGWSPTRFPAGGARCRASVPLGGAVAMPGPSSP

SEQ ID NO: 28344 - DNA, 657 bp, Zea mays
  misc_feature: Ceres CLONE 1402422-F
  misc_feature: Encodes the peptide sequence at SEQ ID NO. 28345
  misc_feature (329)..(329): n is a, c, t, g, unknown, or other
  misc_feature (371)..(371): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (429)..(429): n is a, c, t, g, unknown, or other
  misc_feature (440)..(440): n is a, c, t, g, unknown, or other
  misc_feature (500)..(500): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (520)..(520): n is a, c, t, g, unknown, or other
  misc_feature (521)..(521): n is a, c, t, g, unknown, or other
  misc_feature (561)..(561): n is a, c, t, g, unknown, or other
  misc_feature (578)..(578): n is a, c, t, g, unknown, or other
  misc_feature (582)..(582): n is a, c, t, g, unknown, or other
  misc_feature (591)..(591): n is a, c, t, g, unknown, or other
  misc_feature (621)..(621): n is a, c, t, g, unknown, or other
ggagctccccgcggtggcggccgctctagaactagtggatcccccgggctgcaggaattcgcacgagaccattacctagaacatcctaatcgaaaacccaagggtcggctaggtctaggtggtctccaagctttccgcctttccacgccaccattctccccacccgcgcgcctcagcaatccccatccagcatcgccgtttcgccgcggcaccgacacctcgccggccatgggcgcgtcctcctcgactggcaacccgtccccagaggcgcacgagcagcgggagcaggagactctcgcctccgccgccctctccctccgctcctccgngccgccttctcccgctccgccgccaacgcgctgccggatggncctcgcgcgccgcccgcctcctttcgtctgcccgggatcccggnnngccgcgcgccgnacttccacggnatcctcgggggggtcggcccccgcatcgcctcccaatcttttcgccacgagctgccgcgntgaacgacgnnnggcgccgnntgggtccagttcctcagggggttcaaccgctgctgcgcgngggtgaagggctcccgntcgntcgactggntcctcgggggtacgctgccgctggcgccgngcgggggcaacctgcggggtcagtccaggcgaagag

SEQ ID NO: 28345 - protein, 112 aa, Zea mays
  misc_feature: Ceres CLONE 1402422-F
  misc_feature (34)..(34): Xaa is any aa, unknown, or other
  misc_feature (48)..(48): Xaa is any aa, unknown, or other
  misc_feature (63)..(63): Xaa is any aa, unknown, or other
  misc_feature (71)..(71): Xaa is any aa, unknown, or other
  misc_feature (91)..(91): Xaa is any aa, unknown, or other
  misc_feature (95)..(95): Xaa is any aa, unknown, or other
  misc_feature (98)..(98): Xaa is any aa, unknown, or other
MGASSSTGNPSPEAHEQREQETLASAALSLRSSXPPSPAPPPTRCRMXLARRPPPFVCPGSRXAARRTSTXSSGGSAPASPPNLFATSCRXERRXAPXGSSSSGGSTAAARG

SEQ ID NO: 28346 - DNA, 651 bp, Zea mays
  misc_feature: Ceres CLONE 1402424-F
  misc_feature: Translation starting site: 237
  misc_feature: Pfam Name: Sucrose_synth Pfam Description: Sucrose synthase
  misc_feature: SWISSPROT Homolog: EC 2.4.1.13 Sucrose synthase
  misc_feature (651)..(651): n is a, c, t, g, unknown, or other
gctctagaactagtggatcccccgggctgcaggaattcgcacgagaccattacctagaacatcctaatcaaaaacccatccattccacctccgttcaccccgtccatttgatttgcgttcactgcgttgcgtttccttggaggggattgttctctcctctcctttggattggaggtccctccttcttctcctctctctctcagaggaaggcctgaggatccaggaagaggacagcaatgggggaaggtgcaggtgaccgtgtcctgagccgcctccacagcgtcagggagcgcattggcgactcactctctgcccaccccaatgagcttgtcgccgccttcaccaggctgaaaaaccttgggaaagggtatgctgcagccccaccagatcattgccgagtacaacaatgcgatccctgaggctgagcgcgagaagctcaagggatggtgttttttgaggatgtcctgagggcagctcagggaggcgattgtcatcccccccatgggttgcacttgccatccgccttaggcctggggggtctggagaataatgggggggcccaacggtcagggagctccgctggtggggagacttgaggagttcctggaggtacctggcagttcaagggaacagctttggtggaaaaaaagn

SEQ ID NO: 28347 - DNA, 712 bp, Zea mays
  misc_feature: Ceres CLONE 1402425-F
  misc_feature: Encodes the peptide sequence at SEQ ID NO. 28348
  misc_feature (666)..(666): n is a, c, t, g, unknown, or other
tccccgcggtggcggccgctctagaactagtggatcccccgggctgcaggaattcgcacgagaccattacctagaacatcctaatcaaaaatcgagctgagctgagcatcatggggtagtgtgtgtgtgaggcgatagagaagctagtgctcataaccaaccaccactcagtcctcctcctctaccctttcccttccgccgcgttcctacttggtcctagagggagagagatctcgaactccaagggcgcatgctccggttgctagctacgatgccgtgtgcgtagctgcggcagcccttgatcgatcaatcgatcgcttgtgcggaatgagccggatcgagtggagtcagctagctagatactccgtggtcgtcgtcgtcgttggacgtacgccagaagagggagctagagaagaataccgtacagctgcttccaacatggcagctgcctcgtctgcccacctgttcggactcggcgacgggcagatgcagatgcagccgcagcagcagcaggcgccgcctcctcctcttgtgacaacccggccgcgccgccgcccaagaagaagcggaaccaacccggtaaccaaaccctgacgcggaggtgatcgcgctttcccccagacgctgatggcgacgacccggttcgtgtgcgagtgtgcaacaggntttcccagcggagcagacctgcagctgcaccggcgcggcacaacct

SEQ ID NO: 28348 - protein, 28 aa, Zea mays
  misc_feature: Ceres CLONE 1402425-F
MATTRFVCECATGFPSGADLQLHRRGTT

SEQ ID NO: 28349 - DNA, 606 bp, Zea mays
  misc_feature: Ceres CLONE 1402426-F
  misc_feature: Encodes the peptide sequence at SEQ ID NO. 28350
  misc_feature (486)..(486): n is a, c, t, g, unknown, or other
tccccgcggtggcggccgctctagaactagtggatcccccgggctgcaggaattcgcacgagaccattacctagaacatcctaatcgaaaagggtctccgtgtcgtctctgcgactccacttgctcttttcgctggccctggctacttgcggcaactcccatctccacgcgctctcccatccgagatctcaaccgcctcgccggcgagcgactgacgggcggacggtcccgccggctatggggaactgctgctccgatgaggtgagccacgccggtgctcatcccgtcggctccgccaccgccaaagccgcctccgcagcctccgccgcggccgatcgctttctccgctcccgtggtgccggcgcgtccacgcagatcgagttatctctctctgcatcaaatttgggtgatcaagaaattttcccaagagattcccatgggtggttgtgtattccaaaagagagatggacactagaagaatttggncgcagtggagtaattttaaattcattgaacccattttggacgacaaattcaggtgcagaccccgggttggaggtctcaggcattgggggggtttcaaggctttgactcccaccagcaggt

SEQ ID NO: 28350 - protein, 117 aa, Zea mays
  misc_feature: Ceres CLONE 1402426-F
MGNCCSDEVSHAGAHPVGSATAKAASAASAAADRFLRSRGAGASTQIELSLSASNLGDQEIFPRDSHGWLCIPKERWTLEEFGRSGVILNSLNPFWTTNSGADPGLEVSGIGGVSRL

SEQ ID NO: 28351 - DNA, 716 bp, Zea mays
  misc_feature: Ceres CLONE 1402427-F
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (347)..(347): n is a, c, t, g, unknown, or other
  misc_feature (348)..(348): n is a, c, t, g, unknown, or other
  misc_feature (373)..(373): n is a, c, t, g, unknown, or other
  misc_feature (375)..(375): n is a, c, t, g, unknown, or other
  misc_feature (385)..(385): n is a, c, t, g, unknown, or other
  misc_feature (386)..(386): n is a, c, t, g, unknown, or other
  misc_feature (431)..(431): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (448)..(448): n is a, c, t, g, unknown, or other
  misc_feature (451)..(451): n is a, c, t, g, unknown, or other
  misc_feature (455)..(455): n is a, c, t, g, unknown, or other
  misc_feature (456)..(456): n is a, c, t, g, unknown, or other
  misc_feature (459)..(459): n is a, c, t, g, unknown, or other
ggagctccccgcggtggcggccgctctagaactagtggatcccccgggctgcaggaattcgcacgagaccattacctagaacatcctaatcaaaaaaaactttagtctactcgtcctcggtcctcctcttctcgcagcagccagcagaccaatcgggacaagcaaactcccccgattagtttaagcagcccgggcccggcgacgaccagctccgttccgcgcggggatttaaacgcgcgaagcgagaaggcacgcagcaggcggcagcggcaagcaacgaacgcgatcgcgcgccgacgacgacgcgcggtgccggcgcctgggtggtgccgtggttnnnnnccggnnaaaacttttccccggggcttggggncnaattccgggnnttcctttccgggtcgggtcgtcgcgttaattcatggggtgtccgnctgccnnnntggnnntntgntccnnccnttcctcggtcctccctcgtgggggaacgggcccgggggccggcggaaagtaacggggaaccatctttaaaatttgcgggggattccccccgggggggaagcccggaaaaaccggggggggggggggaggggattctcccggggattaaaccgggggcccagggggggggcgcgggggcctttaaggggagtgggcccccctttttgggggtaacccccacccggggcggggttgttttccgggagggggtcctcttc

SEQ ID NO: 28352 - DNA, 682 bp, Zea mays
  misc_feature: Ceres CLONE 1402429-F
  misc_feature: Translation starting site: 175
  misc_feature: SWISSPROT Homolog: EC 1.11.1.6 Catalase
  misc_feature (259)..(259): n is a, c, t, g, unknown, or other
  misc_feature (397)..(397): n is a, c, t, g, unknown, or other
  misc_feature (414)..(414): n is a, c, t, g, unknown, or other
  misc_feature (456)..(456): n is a, c, t, g, unknown, or other
  misc_feature (539)..(539): n is a, c, t, g, unknown, or other
caaagctggagctccccgcggtggcggccgctctagaactagtggatcccccgggctgcaggaattcgcacgagaccattacctagaacatcctaatcgaaaaatgtaaaccacactccactccagcactgaacacttgattgattcagtgggtagctagctagctgaatcacaatggatcctaccaagttccgtccgtccagcagccacgacacgacggtgacgaccactaacgcgggcgctcctgtgtggaacgacnacgaggcgctgactggggggcctcgcggtcccactcctgctggaggactaccacctgatctgagaaggtggcgcacttcgcgcgcgagcgcatcccgggagcgcgtggtgcacgcgcgcggggcctccgccaagggcnttcttcgagtgcacccnacgacgtggacgtcgcttgacgtgcgccgacttcctgcgcgncgccccggcgtgcggacgccccgtgatcgtggcctttctcgacggtgatccacggagcgggtgtcccccggagacgatccgcnatcccggcggggtttcctccgtgaagttctaccaccccgcgagggcaactggggaccctgctgggccaacaactttcccgttcttcttcatccgcgacgggctcaggtttcccccgacgtggatccacgcgttcaagccccca

SEQ ID NO: 28353 - DNA, 669 bp, Zea mays
  misc_feature: Ceres CLONE 1402430-F
  misc_feature: Encodes the peptide sequence at SEQ ID NO. 28354
  misc_feature (416)..(416): n is a, c, t, g, unknown, or other
  misc_feature (544)..(544): n is a, c, t, g, unknown, or other
  misc_feature (658)..(658): n is a, c, t, g, unknown, or other
cggtggcggccgctctagaactagtggatcccccgggctgcaggaattcgcacgagaccattacctagaacatcctaatcgaaaacgggatcgctctctctttgggctaccggctccgccgccgctccgccgccctaagccaggtgctgaaggccttcgtcggtcttttcaccggcgacgacgacccactaggaaaagaattttcctggcatatttttgtttccagaaatattcgtgtcaagttggtatgtcagggatcacagcaatttggcgtcggtcatgtccattagctgctagtcagattctaatggagacatattttggcccatctgtatcttctggtggtctgaggtggttcagcagcggcactaagcactcaagaaaacctgaattttctgttgtaaccatatcagggntgggtggatttgcattctgcttctgcagttaattatgtgtcaacgattcagaaggttgcccctttcatgccgatggacacctaattggttgattacttcaaagtccagacatggtgcattgcaggaantccttagggtgtttcaagcttctatcgtggatactcttcagatactggaaatcagccgaagcttccccaggagtggtgtctctaatcttccttcacagaaagctctgagtgggnactgcaggggg

SEQ ID NO: 28354 - protein, 66 aa, Zea mays
  misc_feature: Ceres CLONE 1402430-F
  misc_feature (57)..(57): Xaa is any aa, unknown, or other
MSGITAIWRRSCPLAASQILMETYFGPSVSSGGLRWFSSGTKHSRKPEFSVVTISGXGGFAFCFCS

SEQ ID NO: 28355 - DNA, 668 bp, Zea mays
  misc_feature: Ceres CLONE 1402431-F
  misc_feature: Encodes the peptide sequence at SEQ ID NO. 28356
  misc_feature (614)..(614): n is a, c, t, g, unknown, or other
tggagctccccgcggtggcggccgctctagaactagtggatcccccgggctgcaggaattcgcacgagaccattacctagaacatcctaatcgaaaaacatcgatcagtcgcgtgtctaggtttcctctctcaccatagcgcccgctctgtcgcccttcgttcacctctccttcctctcctccctgcctgccaggggagaggggaagtcagaggcacggagtggcgcagagcagacgcacgtgaaccattgtagctgtccctgtcgtcgtcgtcgtcgtcaacgaatccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccaccccaacgtcgtgcacctgcacgaggtgatggccagcaagagcaagaatacttcgccatggagtacggtccggggcggcgagctcttcgcccgcgtcgcccgcggncgggttcagggaggacggccgcggagaaggtacttccaccagcttcgtcggggg

SEQ ID NO: 28356 - protein, 122 aa, Zea mays
  misc_feature: Ceres CLONE 1402431-F
  misc_feature: SWISSPROT Homolog: EC 2.7.11.1 Non-specific serine/threonine protein kinase
MEKKPTILMNRYELGRTLGQGTFAKVYHGRNLASGESVAIKVIDKEKVMRVGMIDQIKREISVMRLVRHPNVVHLHEVMASKSKNTSPWSTVRGGELFARVARGRVQGGRPRRRYFHQLRRG

SEQ ID NO: 28357 - DNA, 669 bp, Zea mays
  misc_feature: Ceres CLONE 1402433-F
  misc_feature: Encodes the peptide sequence at SEQ ID NO. 28358
  misc_feature (625)..(625): n is a, c, t, g, unknown, or other
  misc_feature (637)..(637): n is a, c, t, g, unknown, or other
  misc_feature (650)..(650): n is a, c, t, g, unknown, or other
  misc_feature (654)..(654): n is a, c, t, g, unknown, or other
  misc_feature (666)..(666): n is a, c, t, g, unknown, or other
tggagctccccgcggtggcggccgctctagaactagtggatcccccgggctgcaggaattcgcacgagaccattacctagaacatccgaatcgaaaaatcgcagaaattctccgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaaggccaaggcggagaagcggctacctgcgggcaagtccgccggcaaggagggcggcgacaagaaggggaggaagaaggcgaagaagagcgtggagacctacaagatctacatcttcaaggtctccgttctcccccaattcgccttcacctcgccgcttcctccttgaccgccaccgttgacgtcgtctttccggcgaggtagctcgccggaagacctcacctggacttttccgacgcaccctccacacactctttaaccctccggaatggccgcctgcttctagctcgtcgacgccccaatctccgcttgcttcctcgacagccccatcccgctcttctcgntctcgctacggntcctctggctgtncggncatggcgatccngat

SEQ ID NO: 28358 - protein, 88 aa, Zea mays; identical to SEQ ID NO: 7324
  misc_feature: Ceres CLONE 1402433-F

SEQ ID NO: 28359 - DNA, 705 bp, Zea mays
  misc_feature: Ceres CLONE 1402435-F
  misc_feature: Encodes the peptide sequence at SEQ ID NO. 28360
  misc_feature (430)..(430): n is a, c, t, g, unknown, or other
  misc_feature (536)..(536): n is a, c, t, g, unknown, or other
  misc_feature (597)..(597): n is a, c, t, g, unknown, or other
  misc_feature (604)..(604): n is a, c, t, g, unknown, or other
  misc_feature (624)..(624): n is a, c, t, g, unknown, or other
  misc_feature (625)..(625): n is a, c, t, g, unknown, or other
  misc_feature (705)..(705): n is a, c, t, g, unknown, or other
tccccgcggtggcggccgctctagaactagtggatcccccgggctgcaggaattcgcacgagaccattacctagaacatcctaatcgaaaagctagggtttactgcttgtcttcctttctcggcagtcggcaccttcgcggcttcgcctgatcgcctacgccgcttcgtcctgattctgattctctggtgctcccaagaagaaagtcagggaatgaaggaccgccacctctcgctgaaccagacccagcgggtccgcctcgaggccgcgcttcaagagctccagtccgttgcgcccgccgccgcgtccgccgccgccgtcaccgtcgcggacaccattcccgtcaatcaagaggacaacatcctcaaggggcatgggacgtcggatcaggacggggaggtggttgcgacgctctgcggggtggtggagcnggtcaacagctggtctacgtccgcactcttcgcgcgagatacaagccggaggttggtgatatcatagttggccgtgtgattgagattgctcctaagcgatggaggntggagaaaattttacgccagatgctgttctgatgctttcatctatgaacttgcctgatggnattcganaaagagaactgctggtgatnnaaaactataatggcgagtactttgaagaaatgaagttatcctcggggcgatgagtccagggctcccaaaggatgatcccn

SEQ ID NO: 28360 - protein, 94 aa, Zea mays
  misc_feature: Ceres CLONE 1402435-F
  misc_feature (73)..(73): Xaa is any aa, unknown, or other
MKDRHLSLNQTQRVRLEAALQELQSVAPAAASAAAVTVADTIPVNQEDNILKGHGTSDQDGEVVATLCGVVEXVNSWSTSALFARDTSRRLVIS

SEQ ID NO: 28361 - DNA, 709 bp, Zea mays
  misc_feature: Ceres CLONE 1402436-F
  misc_feature: Translation starting site: 233
  misc_feature (496)..(496): n is a, c, t, g, unknown, or other
  misc_feature (497)..(497): n is a, c, t, g, unknown, or other
  misc_feature (514)..(514): n is a, c, t, g, unknown, or other
  misc_feature (704)..(704): n is a, c, t, g, unknown, or other
acagctggagctccccgcggtggcggccgctctacaactagtggatcccccgggctgcaggaattcgcacgagaccattacctagaacatcctaatcgaaaaattccaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggcgcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggaagaaggagtggtacttcttctcgccgcgcgaccgcaagtacccgaatggctccaggcctaaccgggcggcggaaggggnnaaaatgggaagggcacnggcgccgacgaagcccggtagggtcgccgcgccccgtggccatcaagaaggcgctcgtcttctacgccgggaagccgcccaagggcgtcaagaccaactggatcatgcacgagtaccgcctcgcggacgtcgaccgctcggccgccgcacgcaagaagacaacaacgcgcttcaggctggaatgactggntgctg

SEQ ID NO: 28362 - DNA, 787 bp, Zea mays
  misc_feature: Ceres CLONE 1402446-F
  misc_feature: Encodes the peptide sequence at SEQ ID NO. 28363
  misc_feature (12)..(12): n is a, c, t, g, unknown, or other
  misc_feature (15)..(15): n is a, c, t, g, unknown, or other
  misc_feature (44)..(44): n is a, c, t, g, unknown, or other
  misc_feature (629)..(629): n is a, c, t, g, unknown, or other
  misc_feature (787)..(787): n is a, c, t, g, unknown, or other
tgcccccccccnccnccccccttccccccaccgccccacccccncaaaaaaactggagctcaccgcggtggcggccgctctagaactagtggatcccccgggctgcaggaattcgcacgagaccattacctagaacatcctaatcgaaaaataaataacacacaaagttgtccgatcaaagtttgcgcgtttacaatgtctggacgatcaaggtacttcacgatgtccacccttctcgctaccagcttcttctttgtactcctatgcagctcgctacaagtacgtggcgtgaactacacgttcgagaaggacgcggcgctggcgcccagcgtgtcgtactacaactacatcatcgtgggtgtgggcacgaccgggtgcccgctggccgccacgctgtcggatagcttccgcttgctgctgctggagtgcggcgcctcgccttatgacgacgaccgcctcggggacatggcccgcttctcggacacgctgtcgaaaaaccttccgggctcgaccgcgcagcgcttcgtgtcggaagacggcgtcaatccactcgacgcccgccgatggcatgggtggccgaaaagtgcataaactccggccttctacaagcgccctccgcgacgactacntgcgcacccgcacagtgggaacctgggcgcccccacagtcggcctaaccactgcgagaaaccccctcgataggctttcccaacccgcaactaggggtccactgacagcgccgtgctatgaacgttcgcccaagttccaaggctccattactctcgccn

SEQ ID NO: 28363 - protein, 122 aa, Zea mays
  misc_feature: Ceres CLONE 1402446-F
  misc_feature: SWISSPROT Homolog: EC 4.1.2.10 Mandelonitrile lyase
MSTLLATSFFFVLLCSSLQVRGVNYTFEKDAALAPSVSYYNYIIVGVGTTGCPLAATLSDSFRLLLLECGASPYDDDRLGDMARFSDTLSKNLPGSTAQRFVSEDGVNPLDARRWHGWPKSA

SEQ ID NO: 28364 - DNA, 777 bp, Zea mays
  misc_feature: Ceres CLONE 1402448-F
  misc_feature (11)..(11): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (777)..(777): n is a, c, t, g, unknown, or other
gtacccccccnccccncnnncccccctccccttcccccccctcgtggtataatattgtagctccccgcggtggcggccgctctagaatagtggatcccccgggctgcaggaattcgcacgagaccattacctagaacatcctaatcgaaaaagttcagtggcgccgtcgtgcctcgacgacggcgggagaccccgcaagcaggtgagagtgagacgggcggtgactagcgggcgcttaggccgacatcggccccgcagcggcggggtagggtgcgtcgacacgcgggactgcgacttgggggggattgattcccttcgctgttctctcttctccggcgcgtgcgcgcgtgatcgaaggtagggtttggggcccccaaagttcgtgtctttggggacagcgggcggggttggactacaccaacgccatccacatcattccgggacgccgcgggccccgacgcctgtgcccaacggcgggcgtcaggccccggagggcccgacacccaccatcctgggcccacccgaaggacgtacttccgccccggtggactgtgtgaaaccagggttaccggggaaccggcaatcacctctcttcccgggtgtttgacgcccccccctccggaccggtccgacctaccccaccctctcgcgggtcagtctcctccgcgcccctgccctcctcccgcccgccccttcgtcactccctctcgcaggggcgcgcttcaatatgaccaaccaacagtcacagccatgaacacacacctcaatccccccacn

SEQ ID NO: 28365 - DNA, 720 bp, Zea mays
  misc_feature: Ceres CLONE 1402449-F
  misc_feature: Encodes the peptide sequence at SEQ ID NO. 28366
  misc_feature (351)..(351): n is a, c, t, g, unknown, or other
agagctggagctccccgcggtggcggccgctcttcaactagtggatcccccgggctgcaggaattcgcacgagaccattacctagaacatcctaatcgaaaaaaaccctaccctttggcttctccgtcctcgcccccgcccccgccccgcccccgcctatccgcgcaccagccgaatgtcgtcgggaggcggtggggggcagcagttccgctacacgcagacgccgtccaaggtgctgcacctgcggaaccttccgtgggagtgcgcggaagaggagctcgtcgagctctgcaagcctttcggccgcatcgtcaacaccaagagcggcgtcggcgccaaccacaactaggncctttgtcgagttcactgacgttaatcaggcaatctcgatggtttcttatttcgcatcatcttcagaaccagcacagatacgagggcagactgtttatattcagtattccaatagggcagaaataattaaccaccagagtcctggaaagactgctggaaatgtcttgcttggtaccaataaaggggggtaattctaggggtggccccattggtgggatcccaaggggtttttccgggttttggggttggttcaaaaaaagcccccttttgaaagggggggggggttttcggattggtccccgaacatggggggggttaatggttttccttgtgttaagatcctttaaagggggaggggctccccccttt

SEQ ID NO: 28366 - protein, 57 aa, Zea mays; identical to SEQ ID NO: 24835
  misc_feature: Ceres CLONE 1402449-F

SEQ ID NO: 28367 - DNA, 715 bp, Zea mays
  misc_feature: Ceres CLONE 1402451-F
  misc_feature: Encodes the peptide sequence at SEQ ID NO. 28368
  misc_feature (531)..(531): n is a, c, t, g, unknown, or other
  misc_feature (532)..(532): n is a, c, t, g, unknown, or other
  misc_feature (553)..(553): n is a, c, t, g, unknown, or other
aaagctggagctccccgcggtggcggccgctctagaactagtggatcccccgggctgcaggaattcgcacgagaccattacctagaacatcctaatcgaaaagttcccctttccctcctgcgcacccgtcttctcctccccgcgtcaaaccccagcacaaaaagcaaccgcccgccgcctcctcgctcctctcccgaatcagccgtcgcggtgcctaatccggccgatcccccctccgatccgcgggtgcccgccgcagaggcggcgcctccgggcctcccccgatgtatagcaacttcaaggagcaggcgatcgagtacgtcaagcaggcggtccaggaggacaatgccggcaactacgtcaaggcgttccctctctacatgaacgcgctcgagtacttcaaaacccacctcaagtacgagaagaaccccaagatcaaggaggccatcaccgccaagttcaccgagtacctccgccgcgccgaggagaatccgggcggtcctccgatgaggggtggcgcagggcctgggnnccaacgggtggcggacgcagnctgtcgccacgcgccccaagaccaaggggcaagggacggggacggaggcaacgggaggggatgaactccgagcagtccaagcttgagggcggggctcaactccgccatcatcaccgagaagccccacattaagtggaaacgacgtttgccgggcctcgagaa

SEQ ID NO: 28368 - protein, 110 aa, Zea mays
  misc_feature: Ceres CLONE 1402451-F
  misc_feature (5)..(68): Pfam Name: MIT Pfam Description: MIT (microtubule interacting and transport) domain
  misc_feature: SWISSPROT Homolog: EC 2.7.11.1 Non-specific serine/threonine protein kinase
  misc_feature (83)..(83): Xaa is any aa, unknown, or other
  misc_feature (90)..(90): Xaa is any aa, unknown, or other
MYSNFKEQAIEYVKQAVQEDNAGNYVKAFPLYMNALEYFKTHLKYEKNPKIKEAITAKFTEYLRRAEENPGGPPMRGGAGPGXQRVADAXCRHAPQDQGARDGDGGNGRG

SEQ ID NO: 28369 - DNA, 676 bp, Zea mays
  misc_feature: Ceres CLONE 1402452-F
  misc_feature (515)..(515): n is a, c, t, g, unknown, or other
  misc_feature (538)..(538): n is a, c, t, g, unknown, or other
  misc_feature (674)..(674): n is a, c, t, g, unknown, or other
  misc_feature (675)..(675): n is a, c, t, g, unknown, or other
cgcggtggcggccgctctagaactagtggatcccccgggctgcaggaattcgcacgagaccattacctagaacatcctaatcgaaaaagtgcctcctcgcctataaacaaggggccggggtctctctcctacggcgtgcgcatgctttggcttggcaaacccgattggatcttcagaaaaatcgccatcccctctccctcttctcgtgtccatcgctcctctacccattcttacttgaatcttttctgaagaggaaatctgacttcgggagcggctcctccgcgttgcctggatcgcccgggatcagtattttgcttccagtcagaggtccaaaatatcaaagggatgcagaaagatgtggttgcatgatggagtaccttgcctggaaattggcaggatacacaaacataattgtactttacttgatctcgatgacattggagtgcaaatatatgcacaacgattgcctcatgcacacacacataatgggggccgcgagttgtagctcaaccatncatctctggtttctttctaaggnggagatgggttaaaattgctggtcacttataattaccagcatcttacccggtcattgctgttcatcgcaactttatccaagttttgaagtaaacacctgagaagatggctgagaaagagaatatctatggagaagnng

SEQ ID NO: 28370 - DNA, 703 bp, Zea mays
  misc_feature: Ceres CLONE 1402453-F
  misc_feature: Encodes the peptide sequence at SEQ ID NO. 28371
  misc_feature (703)..(703): n is a, c, t, g, unknown, or other
ggagctccccgcggtggcggccgctctagaactagtggatcccccgggctgcaggaattcgcacgagaccattacctagaacatcctaaaaaaaaaaaacaatgagttccattcagcagcaccggcggcaccccgcagtcccggcgtcccgcacccacgccctacaggcagaccaagcaaatggcgatctcgatctcgcaggaggccttcgactccatggtccgggagaacatggaggacctcggcatggaccccgatgaggccctcgctgacgccgttgaggcgctcaccctccagggcgccgatctctcaggtatcgttaagcgcgtgccggaagaggccaccgcggcggaggtgagcccggtggtgcgggttctggacgaactgaaggcctctctcagcgccagcggcgggtcggagcaggatctcgacggactcgtctctctgttcgatgagttgcgcaatctgtgctgctccggcgagggttcggagaatgcagcgatcgcggtacggaatggcgtcgcggaggcgctcgtcgccctgtgcgcgtccgctcgggccgagcaggagagggtgcttgcttcggctttggaagagcctgagatccgcactccgcgacgtgccccgtaatgacaagttatcccgaagcgcgggccccaaccttgcccgggccttcttgcatgcaggcccaaccatctcacan

SEQ ID NO: 28371 - protein, 149 aa, Zea mays
  misc_feature: Ceres CLONE 1402453-F
MAISISQEAFDSMVRENMEDLGMDPDEALADAVEALTLQGADLSGIVKRVPEEATAAEVSPVVRVLDELKASLSASGGSEQDLDGLVSLFDELRNLCCSGEGSENAAIAVRNGVAEALVALCASARAEQERVLASALEEPEIRTPRRAP

SEQ ID NO: 28372 - DNA, 704 bp, Zea mays
  misc_feature: Ceres CLONE 1402455-F
  misc_feature: Translation starting site: 232
  misc_feature: SWISSPROT Homolog: EC 3.4.11.18 Methionyl aminopeptidase
  misc_feature (332)..(332): n is a, c, t, g, unknown, or other
  misc_feature (704)..(704): n is a, c, t, g, unknown, or other
aagctggagctccccgcggtggcggccgctctagaactagtggatcccccgggctgcaggaattcgcacgagaccattacctagaacatcctaatcaaaactcgctccatttctaatccggtaatcccccctcccgagtccaaaccctaaacctaaacctctcaccgccgccaccgccgccgccccgaggccccatcccagcgcaaccgacttccgcctcggattgaagcaatgtcgtcggacgacgaggtcagggaggagaaggagctcgacctctcctccaacgatgtcgtcaccaagtacaagactgccgccgaaatcctgaacaacgnctctgaagctggttgtgtctgagtgcaagccaaaagcaaagattgttgacctttgtgagaagggtgactctttcataagagagcaaactgggaatgtctacaagaatgcaaagaggaagattgaaaggggcattgctttcccaacctgtgtttctgtgaacaacacagtctgccacttctccccgcttaccacaggatgatgcagttctggaagaaaatgatatggttaaaattgacatggggtgtcatattgatggctttattgctgtggtggcacatacacatgtaattgcaaatgggcctgtcacaggaagagcagctgatgttcttgctgctgccaaacagcagcagaagttgcaatgaggcttgtan

SEQ ID NO: 28373 - DNA, 732 bp, Zea mays
  misc_feature: Ceres CLONE 1402456-F
  misc_feature: Translation starting site: 376
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (437)..(437): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (455)..(455): n is a, c, t, g, unknown, or other
  misc_feature (456)..(456): n is a, c, t, g, unknown, or other
  misc_feature (459)..(459): n is a, c, t, g, unknown, or other
  misc_feature (466)..(466): n is a, c, t, g, unknown, or other
  misc_feature (477)..(477): n is a, c, t, g, unknown, or other
  misc_feature (484)..(484): n is a, c, t, g, unknown, or other
  misc_feature (514)..(514): n is a, c, t, g, unknown, or other
  misc_feature (515)..(515): n is a, c, t, g, unknown, or other
  misc_feature (533)..(533): n is a, c, t, g, unknown, or other
aagctggagctccccgcggtggcggccgctctagaactagtggatcccccgggctgcaggaattcgcacgagaccattacctagaacatcctaatcgaaaaaccgctctcccatcccacccaaatcgccgaccgataggagagaactcgagctgaggagagagagagcagcaggcggcggcgcggagtaacacgcggaggggaatgcgcagcccgtgtgagcctctcgcccccgcgaaaccccaccgattctgattccgccggcgaaatcgggcgcctcgcggctcggccggctaagcggtggacggcggcgccgaggggttcgttcgatacggtgagggtgaggccgtgaggagcagcagccacggcgacggggatgatgaannnnnnnnnnnnnnnnnnnnnnnnnnnnnnnnnnnnnnnnngnnnngnnnnngngnnnnnnnnncgaggggnnggnggccggnggcgggcgcgncggggcnccctccccccggcgggggcccacccgcgcnnagagggggagggaggcanagggcgacgcccacccccggccacctcacaggcggccagaacggcaggccaaggcgagcgactccgccgccggggggggcaaggccaaaacggggcgctcggcgccggggccggcgggaatccaaaaaatcgccgacgccccgccggcggtattgtgcgcggcccaccggccggtaagcatccggcccggcggcgctaa

SEQ ID NO: 28374 - DNA, 685 bp, Zea mays
  misc_feature: Ceres CLONE 1402458-F
  misc_feature: Encodes the peptide sequence at SEQ ID NO. 28375
  misc_feature (487)..(487): n is a, c, t, g, unknown, or other
  misc_feature (608)..(608): n is a, c, t, g, unknown, or other
  misc_feature (618)..(618): n is a, c, t, g, unknown, or other
  misc_feature (619)..(619): n is a, c, t, g, unknown, or other
cgctctataactagtggatcccccgggctgcaggaattcgcacgagaccattacctagaacatcctaatcgaaaaataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacacctccccgggctcgcccgcgcagcgcttcgtgtcggaggacggcgtcatcaactcgcgcccgcggntgctgggcggcggcagctgcatcaacgccggcttctacacgcgggccagcgacgactacgtgcggggcgtccggtgggacctgggcgccgcgcgggcggcgaccgccgttgtatcccctgngccggcgccnncccgcttttcactcctgggaggcaatatgtgccgggcttctcccggcttgcggcgggcccgcaaat

SEQ ID NO: 28375 - protein, 188 aa, Zea mays
  misc_feature: Ceres CLONE 1402458-F
  misc_feature: SWISSPROT Homolog: EC 4.1.2.10 Mandelonitrile lyase
  misc_feature (123)..(123): Xaa is any aa, unknown, or other
  misc_feature (163)..(163): Xaa is any aa, unknown, or other
  misc_feature (167)..(167): Xaa is any aa, unknown, or other
MSGRSRHFTMSTLLATSFFFVLLCSSLQVRGVNYTFVKDAALAPSVSYYDYIIVGGGTAGCPLAATLSERFRVLLLERGASPYDDDRIGDMARFADTLSDTSPGSPAQRFVSEDGVINSRPRXLGGGSCINAGFYTRASDDYVRGVRWDLGAARAATAVVSPXPAPXRFSLLGGNMCRASPGLRRARK

SEQ ID NO: 28376 - DNA, 542 bp, Zea mays
  misc_feature: Ceres CLONE 1402460-F
  misc_feature (244)..(244): n is a, c, t, g, unknown, or other
cgctctagaactagtggatcccccgggctgcaggaattcgcacgagaccattacctagaacatcctaatcgaaaagagctcaaacacacatcaagaaagcaagaaagaaaagactgtagctagctagccaccgcgcgcgcgcacgagtagtctagctagatacactcgcgttaaaacaacacacagcgtcgtgctgcgtgatctctgacgcgtcgacactaccgagcaccagcagtgatgcggncacgtatctccctgctgagctcgtcccacggggaccaccggggccggggggtccccagaaggggggaatgaggaaaaacgttttaagggccgggggggtttttccccggtttttttggcccccccccggaaaaaaaaccaaaaaggaggccccccccctggggaaaaataaaggagggggggcccccttttttttttttaaagggcgcgggggcccaaaaaaaagaagaatccccccccgccgggggggggggggggggctcccccccccaaaaaaaaaaatgggggggggggggtgg

SEQ ID NO: 28377 - DNA, 698 bp, Zea mays
  misc_feature: Ceres CLONE 1402466-F
  misc_feature: Encodes the peptide sequence at SEQ ID NO. 28378
  misc_feature (298)..(298): n is a, c, t, g, unknown, or other
  misc_feature (551)..(551): n is a, c, t, g, unknown, or other
  misc_feature (593)..(593): n is a, c, t, g, unknown, or other
  misc_feature (648)..(648): n is a, c, t, g, unknown, or other
  misc_feature (690)..(690): n is a, c, t, g, unknown, or other
caccgcggtggcggccgctctagaactagtggatcccccgggctgcaggaattcgcacgagaccattacctagaacatcctaatcgaaaaatttttctctctccccgtctgcctcgccctccacaccaggccacgccacacacaggatagcgagcgggagcgacggcggcggcggaggagctagggttttgatccggcctcgccggctaggctgcgccgccccgacgccgaagccatggacagggagcttctagagacgtttgacgcggccaagaaggcggccgacgaggcggcaggngacggcaactcgccggaggctggccgctgcctcgacgcgctgcggcggctgcgcgacattcgcgtcaacaccgacatcctcgtctcgacgcaggttgggcaacgccttcgaccccttactaagcatcctcactcaggcattcaagcagttgctgcagacctttttgggtactggaaaaaaggttgtccttgagagtcagggaagaaaatgggcgctcagagaatgaaaagatcagtgactcttcaggaaaggntgagaaggtgagccccgtgaagattggaaagaactctgcatncagcagcatgaagcttgagaaaagagatgtggatggtaggggtcagaagcctaancatgtcaaaagtgagaagactactagtaatgggtccaagctncatctgtg

SEQ ID NO: 28378 - protein, 84 aa, Zea mays
  misc_feature: Ceres CLONE 1402466-F
MDRELLETFDAAKKAADEAAGDGNSPEAGRCLDALRRLRDIRVNTDILVSTQVGQRLRPLTKHPHSGIQAVAADLFGYWKKGCP

SEQ ID NO: 28379 - DNA, 676 bp, Zea mays
  misc_feature: Ceres CLONE 1402471-F
  misc_feature: Encodes the peptide sequence at SEQ ID NO. 28380
  misc_feature (528)..(528): n is a, c, t, g, unknown, or other
  misc_feature (529)..(529): n is a, c, t, g, unknown, or other
cgctctcaactagtggatcccccgggctgcaggaattcgcacgagaccattacctagaacatcctaatcgaaaattcacttgctaaaccctctccagcccgcgttcctcgctttccctcccaaaaccctagcgctgcttccaccagccacccagatcccatggcgcgctcgacctcactctccgaggcggaggcgggcatctcctgctttgcctcctccctcccttgattccgcggcgtcctcaagcaccgctatgccgacttcatcgtccatgaggttgcccgcgatggcgctctcgtccagctcacctcgttcgacctccccaccgagagcgttggtttgaacgaagaggacaaggcggccccgtcggctgaagcggatcactcgcaggccctcgagtcgttccgttcgctctgcggcgatgccgattgcaacgcattgaggggtctcctggagaaggtgtcgggcgagggtggcggtgatgtctcgcctgtcattctatcgcctgatgccgacaaagcacaccgnntcggaggtgcataacttctttaagaagaccttcaagttcctggtcacggacacgggggaacacagtgatggggtccagaagtgcatcagggtgcggttcgggcaagaagcaggtgttcgccaggggtgttgtcccccctccccccac

SEQ ID NO: 28380 - protein, 65 aa, Zea mays
  misc_feature: Ceres CLONE 1402471-F
  misc_feature (16)..(16): Xaa is any aa, unknown, or other
MSRLSFYRLMPTKHTXSEVHNFFKKTFKFLVTDTGEHSDGVQKCIRVRFGQEAGVRQGCCPPSPH

SEQ ID NO: 28381 - DNA, 699 bp, Zea mays
  misc_feature: Ceres CLONE 1402474-F
  misc_feature: Encodes the peptide sequence at SEQ ID NO. 28382
  misc_feature (482)..(482): n is a, c, t, g, unknown, or other
  misc_feature (610)..(610): n is a, c, t, g, unknown, or other
  misc_feature (690)..(690): n is a, c, t, g, unknown, or other
gctctagaactagtggatcccccgggctgcaggaattcgcacgagaccattacctagaacatcctaatcgaaaactctcgatccggaaacctctcaaaccctagccgcctcctcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcagggtcgagagtctcactgacaagagcaagctcgatgcgcagcctgagcttttcatccaccttgtcccagacaagggcacgagaacgctctcccttatcgaaaagcggcatcgggattgaccaagtccgaccttgtcaacaaacctcggtaccattcgcccaggtccggggaacaaagaggtcatggaagcccttgctgnccggcgctgatgtgtccatgattgggccagttcggcgtcggtttctactctgcctacctcgtcgccggatagagttgtcgtgaccaccaagcacaacgatgacgagcagtacgtgtgggagtcccaangcgggcgggtcggtcactgttactcgtgacacgtcaggggagcagcttggcaggggcactaagatcacactggtcctcanggacgatca

SEQ ID NO: 28382 - protein, 86 aa, Zea mays
  misc_feature: Ceres CLONE 1402474-F
MASETETFAFQAEINQLLSLIINTFYSNKEIFLRELISNSSDALDKIRVESLTDKSKLDAQPELFIHLVPDKGTRTLSLIEKRHRD

SEQ ID NO: 28383 - DNA, 676 bp, Zea mays
  misc_feature: Ceres CLONE 1402477-F
  misc_feature: Encodes the peptide sequence at SEQ ID NO. 28384
gctctagaactagtggatcccccgggctgcaggaattcgcacgagaccattacctagaacatcctaatcgaaaaaaaatcgggtttgccgtgcggcacttgcgtttcgggtcgggtacggacccgcaaaaagagctccgtcagttcctctacctcctctgtaggagcacacttgtttcggaaaggaacgcagattcacgccacgccgccgcctcaattatatggcgccggcgttctcggcacaggtccccgcgctccgacgggcagcactgcgcgtgcggtgggtcacggctgcgctgttctcatcggggattctcgccggcaacaagccgattctggtgcgtgacttcgtgaggtcagcgttgtacgaccccaaccatggctactttctccagcgggcggggccggtgggcgttcttgacgccagcatccgcttcaacagctcggaggggaggatgcatatatacagcacctttgaatagctgataaaagcatgaaatcgctgggttactcccggggagctcttaaagcatggaatgcctaccaataagaagatccaattttgggaacaggaatctttcagcccctttgaaaataacaaaatggggggggttttggaaatgggccaagggcaacctggaaacgggggggggaagggcccccaaaagttaaaagga

SEQ ID NO: 28384 - protein, 86 aa, Zea mays
  misc_feature: Ceres CLONE 1402477-F
MAPAFSAQVPALRRAALRVRWVTAALFSSGILAGNKPILVRDFVRSALYDPNHGYFLQRAGPVGVLDASIRFNSSEGRMHIYSTFE

SEQ ID NO: 28385 - DNA, 652 bp, Zea mays
  misc_feature: Ceres CLONE 1402481-F
  misc_feature: Encodes the peptide sequence at SEQ ID NO. 28386
ggagctccccgcggtggcggccgctctagaactagtggatcccccgggctgcaggaattcgcacgagaccattacctagaacatcctaatcgaaaaccggaatggtatcgtgcgacctgtagtcgtcgccagccacctcgctccctcctagacgacacccagctagtgctcccttccacacccaggaaccagccacctaaccccgcccgccatgccgggcctcgccgcctccgacaactcgcccccggcgccggcgccgccgccgcgccggctctcgtcgccgctaccccgtcgcgcgccgtcgtccccgtcgccgtccgcctcctcgcgcgccaagcctcggaagccctcgccctctcccgcggccttccccaccgacgccgacgactcgctcgacaacccggatctggggcccttcctcctcaagcaggcgcgcgacgccatggtgtcgagcgagggcggtggccccgcgcgcgcactcgagttcgccgagcgcgccgccatggcgctcgagcgacgcggcgagggcgccgaagctcgagctcgccctggagcctcaaagtcggctgcggccggttcactggggggcttagacgggacgggggggagggccattccggggccccgcggggggccgggcgacggaatgtcg

SEQ ID NO: 28386 - protein, 147 aa, Zea mays
  misc_feature: Ceres CLONE 1402481-F
MPGLAASDNSPPAPAPPPRRLSSPLPRRAPSSPSPSASSRAKPRKPSPSPAAFPTDADDSLDNPDLGPFLLKQARDAMVSSEGGGPARALEFAERAAMALERRGEGAEARARPGASKSAAAGSLGGLDGTGGRAIPGPRGGPGDGMS

SEQ ID NO: 28387 - DNA, 681 bp, Zea mays
  misc_feature: Ceres CLONE 1402482-F
  misc_feature: Encodes the peptide sequence at SEQ ID NO. 28388
  misc_feature (261)..(261): n is a, c, t, g, unknown, or other
  misc_feature (457)..(457): n is a, c, t, g, unknown, or other
tccccgcggtggcggccgctctagaactagtggatcccccgggctgcaggaattcgcacgagaccattacctagaacatcctaatcgaaaaaaacaatcgacctagctaggcacaagagcgctagacgccgcagcgcagcacgcaccacccaccgagcggcggcggaggcagggcaatccgcagggagcagaggccgcgcgcgcaggcatgggcgcgccggtgcacggcgccctcgccttgttcctcctgctcctggtggnggcaggggcggcgcccgaggagacggcgccgcaggaacccacattgccagccaccggctccggcgctaccggcgcgccggcggtcggggtcaactccaactccgtgctggtggcgctgctggattcgcactacacggagctggcggagctggtggagaaggcgctgctcctgcagacgctggaggacgccgtcggnaagcacaacgtcaccatcttcgcgccgcggaacgaggcgctggagcgggacctgtacccggagttcaagcgcttcctggtgaagccgcgcaacctcagggcgctggaggggctgctgttctaacaagtcctcccctcgcgcctgccctccgaatcctggcccgcggcgcgccccccccaccttgtcccgggcgaggaggcagagctcagcgcccgactgacccc

SEQ ID NO: 28388 - protein, 123 aa, Zea mays
  misc_feature: Ceres CLONE 1402482-F
  misc_feature (18)..(18): Xaa is any aa, unknown, or other
MGAPVHGALALFLLLLVXAGAAPEETAPQEPTLPATGSGATGAPAVGVNSNSVLVALLDSHYTELAELVEKALLLQTLEDAVGKHNVTIFAPRNEALERDLYPEFKRFLVKPRNLRALEGLLF

SEQ ID NO: 28389 - DNA, 720 bp, Zea mays
  misc_feature: Ceres CLONE 1402484-F
  misc_feature: Encodes the peptide sequence at SEQ ID NO. 28390
  misc_feature (515)..(515): n is a, c, t, g, unknown, or other
  misc_feature (585)..(585): n is a, c, t, g, unknown, or other
  misc_feature (628)..(628): n is a, c, t, g, unknown, or other
  misc_feature (632)..(632): n is a, c, t, g, unknown, or other
  misc_feature (636)..(636): n is a, c, t, g, unknown, or other
  misc_feature (644)..(644): n is a, c, t, g, unknown, or other
  misc_feature (647)..(647): n is a, c, t, g, unknown, or other
  misc_feature (671)..(671): n is a, c, t, g, unknown, or other
aaagctggagctccccgcggtggcggccgctctagaactagtggatcccccgggctgcaggaattcgcacgagaccattacctagaacatcctaaaaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacaccttcccgggctcgcccgcgcagcgcttcgtgtcgggaggacggcgtcatcaactcgcgcccgcggntggctgggcggcggcagctgcatcaacgccggcttctacacgcgggccagcgacgactacgtgcgggggncggtcggtgggaacctggggcgccgcccgggcggcgtaacggntggntggnaagcaccntgntggccgtccagccgagcggggggncccccctggcaaggcccggctctgcagggcggccctggttccaaaggcg

SEQ ID NO: 28390 - protein, 158 aa, Zea mays
  misc_feature: Ceres CLONE 1402484-F
  misc_feature: SWISSPROT Homolog: EC 4.1.2.10 Mandelonitrile lyase
  misc_feature (123)..(123): Xaa is any aa, unknown, or other
MSGRSRHFTMSTLLATSFFFVLLCSSLQVRGVNYTFVKDAALAPSVSYYDYIIVGGGTAGCPLAATLSERFRVLLLERGASPYDDDRIGDMARFADTLSDTFPGSPAQRFVSGGRRHQLAPAXGWAAAAASTPASTRGPATTTCGGRSVGTWGAARAA

SEQ ID NO: 28391 - DNA, 710 bp, Zea mays
  misc_feature: Ceres CLONE 1402485-F
  misc_feature (528)..(528): n is a, c, t, g, unknown, or other
  misc_feature (596)..(596): n is a, c, t, g, unknown, or other
  misc_feature (705)..(705): n is a, c, t, g, unknown, or other
aaagctggagctccccgcggtggcggccgctctagaactagtggatcccccgggctgcaggaattcgcacgagaccattacctagaacatcctaatcgaaaagaaaggtagatattttttcccgtctcgctcaatgattcaccccatcgcagccatcgatcagaaaatttacggctcataattctcgtctgcttatccgctcccttctctccctcaacttcagcaagttccccgcaaaaccgcagccggaggtcgccggtcgccaccaccaatggggccacccgccatggcgttccaagccctcaccctcacgccactccccttctcactccacagctcgagccgccgcgtccgcgtgcttgccgttgcggccgaccagactcctccgcccgcccccccttcggagccggcgaacagccctagccgcctccttcgcgagctcgcgcagcggaagaaggccgtatcccctaagaagaagcatccgccgcgtcgcttcatcctgaagccacctctcgatgacgagcgccntaacccggcggttcctcagcagcccgcagctgtcgctcaaggcgctcccgctgctctcttcctgcctnccctccgcgccgctctccaccgccgaagggacctggatggacgagtacctctgaagggcccagcaagggcgctcgggtacccgctcgcgcccctcggagacctctcggncgaag

SEQ ID NO: 28392 - DNA, 696 bp, Zea mays
  misc_feature: Ceres CLONE 1402486-F
  misc_feature: Encodes the peptide sequence at SEQ ID NO. 28393
aaagctggagctccccgcggtggcggccgctctagaactagtggatcccccgggctgcaggaattcgcacgagaccattacctagaacatcctaatcaaaaagatctacctgtctgttcttcgatcgagtctgagagatttgggaggaggagggaaacaaagcgaaagagcccatcttttttgtctttttggttcggtttcgtggttgcttcttttggaccccgcggaggagcccaccgtttctacaaaaacccaatctttgctgccttctcagcggtcgagatcgataggtttccagatctgaggctccgtgttctggctgtgagatcggaggcgcagcaatccgagcacgcagctagtagggaaagtatccgagaaaagttgcagattttgctgggggcaacggagcgagaacaagttactgcagaaggaaagggcaaaggtgggggaggcgccggagatgagggatgctatcagctctgatggattatttgaaatcttggctcgggtccggcatcaccggctgggcgtccccgcaaaggatcggatgccaccggccgccaggacgggctcctgtggtacaagggacgcgggcaggtcgtccgatggtgagttctcccttgcccgtggtccaggccaataaccctattgggagaccatagcccggttgaatccggggcgcttagcaccatcggg

SEQ ID NO: 28393 - protein, 60 aa, Zea mays
  misc_feature: Ceres CLONE 1402486-F
MRDAISSDGLFEILARVRHHRLGVPAKDRMPPAARTGSCGTRDAGRSSDGEFSLARGPGQ

SEQ ID NO: 28394 - DNA, 671 bp, Zea mays
  misc_feature: Ceres CLONE 1402487-F
  misc_feature: Encodes the peptide sequence at SEQ ID NO. 28395
  misc_feature (452)..(452): n is a, c, t, g, unknown, or other
  misc_feature (555)..(555): n is a, c, t, g, unknown, or other
  misc_feature (556)..(556): n is a, c, t, g, unknown, or other
aaagctggagctccccgcggtggcggccgctctagaactagtggatcccccgggctgcaggaattcgcacgagaccattacctagaacatcctaatcgaaaacccctaccccatcgatccccgccgcccgcctttccccgccattcttctagaacctacccagctctcggggaccttctctcccagcccgagatccctccccaccgagatcccgcgccgccatggtgtcgtgacggcggcggaggcggcgtcatggagcgggagcccaagtcccccgacgaccgccctgagcccgctgcggcggcggcgcagccgcagccgctggagtggcggtttgcgcaggtcttcggcgagcgcgccgcgggagaagatgtgcaagatgtggacataatctctgcaattgagtttgacaaatctgggaatcatcttgctactggagatagaggtggacngtgtggttttgttcgaaagaacagacattgctgataatgcttgtcgaagagaacttgagagggcagaatatcttgtttctaggcatccctggagtccgttacnnagaccgattttcagagtcatgaaaccctgagtttgacttacctaaaaaggttgggaaaatagaggggagagattaccggggttccggggggggcccaaaaaccaaaaatggcctt

SEQ ID NO: 28395 - protein, 77 aa, Zea mays
  misc_feature: Ceres CLONE 1402487-F
  misc_feature (67)..(67): Xaa is any aa, unknown, or other
MEREPKSPDDRPEPAAAAAQPQPLEWRFAQVFGERAAGEDVQDVDIISAIEFDKSGNHLATGDRGGXCGFVRKNRHC

SEQ ID NO: 28396 - DNA, 719 bp, Zea mays
  misc_feature: Ceres CLONE 1402489-F
  misc_feature: Translation starting site: 190
  misc_feature (548)..(548): n is a, c, t, g, unknown, or other
  misc_feature (550)..(550): n is a, c, t, g, unknown, or other
  misc_feature (569)..(569): n is a, c, t, g, unknown, or other
  misc_feature (575)..(575): n is a, c, t, g, unknown, or other
  misc_feature (645)..(645): n is a, c, t, g, unknown, or other
  misc_feature (696)..(696): n is a, c, t, g, unknown, or other
  misc_feature (700)..(700): n is a, c, t, g, unknown, or other
  misc_feature (712)..(712): n is a, c, t, g, unknown, or other
aaagctggagctccccgcggtggcggccgctctagaactagtggatcccccgggctgcaggaattcgcacgagaccattacctagaacatcctaatcgaaaaaaaccgatcgagcctcgacgagccagcagagaggactcatcctagctagctaagctgtccgacacagcacagcagaccgatacgacgatgatgagtagcaccggcggcgagagcaagctggagagcccgctgctgggcctgcccgcgccgggctcgtcggccggcagcgggcacagccacggcgaggcggtgagcgggcagctggagagcatcctcagcgacgcctccctgccgtggaggcagcggatgctgtcagcgtccatggttgagatgcggctgctcgtgcgcctggccgcgcccgccgtgctcgtctacatgatcaactacctcatgtccatgtccacgcagatcttctcgggacacctcggcacgctcgagctcgccgccgcgtcgctcggcaacaccggcatccaggtcttcgcctatggcctcatgctgggcatggngnagcgcgggggagacgctgntgcggncaggcgtacggcgcgcacaagtacgacatgctgggcatctacttgcagcgctccccatcctgtgaggggnccacgggggtgccctctgaccgtgctctacgccttctcccgcccatctggncccntcctcgggaagntcccccg

SEQ ID NO: 28397 - DNA, 738 bp, Zea mays
  misc_feature: Ceres CLONE 1402494-F
  misc_feature: Encodes the peptide sequence at SEQ ID NO. 28398
  misc_feature (190)..(190): n is a, c, t, g, unknown, or other
  misc_feature (379)..(379): n is a, c, t, g, unknown, or other
  misc_feature (521)..(521): n is a, c, t, g, unknown, or other
aaagctggagctccccgcggtggcggccgctctagaactagtggatcccccgggctgcaggaattcgcacgagaccattacctagaacatcctaatcgaaaactttctcgagcctgacccttacgccttcgctcgcgccgccgccgccgccgccgctacgccccgcacctcgcttcatttcgtgtcgccnagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtggtaagngtgaaggctggtggtgcttacaccatgaacactgctagtgcggtcaccgtcaggagcacgatccgccgcctggagggagcagactgaagcatgatatagctctttttaatttaatggggttttcctgtagttgctcttgtcnagcatgggtttgtgggggccttatcttagtgaaaatgtggaatcctggggaactgggctgtttttgccgagacaatgtccccttaaatatttggtttatgctctgggatttctccaaagttggtgtcaaaaaaaaaaaaaaaaaagcttatcgataccgtccaaccctccgaggggggggggccggggaacccaattcgcccttaaaaggggagtct

SEQ ID NO: 28398 - protein, 74 aa, Zea mays
  misc_feature: Ceres CLONE 1402494-F
  misc_feature (2)..(72): Pfam Name: Ribosomal_L37ae Pfam Description: Ribosomal L37ae protein family
  misc_feature (63)..(63): Xaa is any aa, unknown, or other
MTKRTKKAGIVGKYGTRYGASLRKQIKKMEVSQHSKYFCEFCGKFAVKRKAVGIWGCKDCGKXEGWWCLHHEHC

SEQ ID NO: 28399 - DNA, 717 bp, Zea mays
  misc_feature: Ceres CLONE 1402496-F
  misc_feature: SWISSPROT Homolog: EC 2.7.11.1 Non-specific serine/threonine protein kinase
  misc_feature (481)..(481): n is a, c, t, g, unknown, or other
  misc_feature (564)..(564): n is a, c, t, g, unknown, or other
  misc_feature (583)..(583): n is a, c, t, g, unknown, or other
  misc_feature (651)..(651): n is a, c, t, g, unknown, or other
  misc_feature (654)..(654): n is a, c, t, g, unknown, or other
  misc_feature (673)..(673): n is a, c, t, g, unknown, or other
  misc_feature (676)..(676): n is a, c, t, g, unknown, or other
aaagctggagctccccgcggtggcggccgctctagaactagtggatcccccgggctgcaggaattcgcacgagaccattacctagaacatcctaatcgaaaaagtttcagaccccgtgtggattagtcgctgtcacgatcgaggcggggcgccaattgcggtggccaccacctccaatccactccccgcggtggcctcgccgagctgttcttgctccgtcctccctccaactccaagatttgtttcgcacccgattcctgagcttccgcggcgcttcttgctgaaaagaaagctccgagttcttcagttctggatcgatagagaggcggttcctttgcgggctctgaggttcagctctcgctcttgatttgtctcatcgacgcatcagttgggctgcaggcttagagctggaaggaataatttgactagagaaaatggggcagtgttgtagcagagctcccgccccggactctgggacggngaggcaccaaatggttatggctattctaaccaggcaaagccagcgcaaacaccttcgagttacaaccctcctcagcagccggnccggaggtgaggtacacgnccgccggcgacgaacccctccggtagtccccacctgtggcctgtgcctgtgccaccgaagcccacggncgnacacgattcttggcaaacnggntaccgaggacgtacgctctgtctactcctcggggaaggagc

SEQ ID NO: 28400 - DNA, 714 bp, Zea mays
  misc_feature: Ceres CLONE 1402497-F
  misc_feature: Encodes the peptide sequence at SEQ ID NO. 28401
  misc_feature (611)..(611): n is a, c, t, g, unknown, or other
aaagctggagctccgcggtggcggccgctctagaactagtggatcccccgggctgcaggaattcgcacgagaccattacctagaagatcctaatcgaaaaaaccgacttccagttccactctcgcttccttccctccctccctcccacgcaaatggtggccgctcgcctccgcctcgcgctgctactctccgtctgcctctgctccgcgtgggcgcgcccacgcctcgagacggccatccgcctgccgtcgcagcgcgcggcggcggccgacgaaacggacgacggcgccgtcgggacccgctgggctgtgctcatcgcaggctccagcggctactacaactaccgccaccaggcggacatctgccatgcataccagatcatgaagaagggcggactcaaggatgagaacatcattgtcttcatgtacgatgacatcgcgcatagcccggagaatccgaggcctggtgtcatcatcaaccatccccggggtggcgacgtctaatgctggggtgccaaaggattacactggggcgagatgtcaacgtcgacattttccttcgctgttctgcttggcaacaaaatgctctccaggggtggaatcgggcaaggnttgtggacagtggccccgatgatcattatctttgttttctacggggaacatgggggggtcctggtggtctttggaatgcctacgtatccatatcttctatggg

SEQ ID NO: 28401 - protein, 116 aa, Zea mays
  misc_feature: Ceres CLONE 1402497-F
  misc_feature (50)..(117): Pfam Name: Peptidase_C13 Pfam Description: Peptidase C13 family
  misc_feature: SWISSPROT Homolog: EC 3.4.22.34 Legumain
MVAARLRLALLLSVCLCSAWARPRLETAIRLPSQRAAAADETDDGAVGTRWAVLIAGSSGYYNYRHQADICHAYQIMKKGGLKDENIIVFMYDDIAHSPENPRPGVIINHPRGGDV

SEQ ID NO: 28402 - DNA, 708 bp, Zea mays
  misc_feature: Ceres CLONE 1402500-F
  misc_feature: Encodes the peptide sequence at SEQ ID NO. 28403
  misc_feature (334)..(334): n is a, c, t, g, unknown, or other
  misc_feature (350)..(350): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (498)..(498): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccattacctagaacatcctaaaaaaaaaggaattctgccttcttctctcatcttcctgctcaacatcagtagcagctttagctgtagcagcgccaccggccaccgccacgccatggccaccacgttgcacaagcccctgggggcgatcaccgttgacgacctcgccgcggcggcgcctgggtcggacgccaccgcgctccacgcagcgctccggcgcgcgctcgactcgcacggacccaccgaagtgtggggcgagctcntgccggtccgtgctcntgtccgtctgtccccttcgccgtccaccggatgctctactacggnnntgcttcgccgggttcccgtctcccacgccgccgcctggacgcccgaccctcaaggaggctgtcttgaccaatggtcggccgtgtccttcgaggcgcgtggntagggacttcatcggcgacgcgtacaaggatcccatcaccagcttcccagacctccacaagttctccacgagaatccagaggcgtactggaagatggtatttgaggatatgggtatccaattcagcgtagagccatcctgcatctggagagagaaactgcatatcntgggtggcgagtggctaccaggcgccgagctcacgctgctgcta

SEQ ID NO: 28403 - protein, 104 aa, Zea mays
  misc_feature: Ceres CLONE 1402500-F
  misc_feature (50)..(50): Xaa is any aa, unknown, or other
  misc_feature (55)..(55): Xaa is any aa, unknown, or other
  misc_feature (70)..(70): Xaa is any aa, unknown, or other
  misc_feature (71)..(71): Xaa is any aa, unknown, or other
MATTLHKPLGAITVDDLAAAAPGSDATALHAALRRALDSHGPTEVWGELXPVRAXVRLSPSPSTGCSTTXXLRRVPVSHAAAWTPDPQGGCLDQWSAVSFEARG

SEQ ID NO: 28404 - DNA, 720 bp, Zea mays
  misc_feature: Ceres CLONE 1402504-F
  misc_feature: Encodes the peptide sequence at SEQ ID NO. 28405
  misc_feature (394)..(394): n is a, c, t, g, unknown, or other
  misc_feature (420)..(420): n is a, c, t, g, unknown, or other
  misc_feature (436)..(436): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (498)..(498): n is a, c, t, g, unknown, or other
  misc_feature (506)..(506): n is a, c, t, g, unknown, or other
aaagctggagctccccgcggtggcggccgctctagaactagtggatcccccgggctgcaggaattcgcacgagaccattacctagaacattctaatcgaaaaatcaccgccgcggcctctatttctcccccatcccccctcgcatgccccgctcgccgccgctacctcctcccgcccctaggtgacggtgactcactgactccctacttccgtcgcccaaatttctatctcactatctccgccgcgagatctccggctgcccgcccatggtcgccgcctccggcctcgcgctgccgcgggtatccgcaccatgcccggtgcgcacgcgtggtggcctccgccccgccttcctccgagtcgcgcagcccgtgacgctgccaccgccccagctccngtgctgcgcgtccaccgtcgacgatngcgtggtgtccgctgncgcttccagccccnnnctccagggtgttgggtatggggtcaagctcggtggatgtggatcangcatcccnacacttagcgttcaaatgatgactttccgaagaaggtgaaactcaaaagaatgaattgggctcgaactgggatcgaaacaggcgagtctttcaggaaagaaaaattggcggggatctcaaacaggagttcaagcacctggaagggcggagaaaagttgaaaaggcaccccgtccttttttgattaccccaaagaaattttttggggggggcctt

SEQ ID NO: 28405 - protein, 92 aa, Zea mays
  misc_feature: Ceres CLONE 1402504-F
  misc_feature (43)..(43): Xaa is any aa, unknown, or other
  misc_feature (52)..(52): Xaa is any aa, unknown, or other
  misc_feature (57)..(57): Xaa is any aa, unknown, or other
  misc_feature (62)..(62): Xaa is any aa, unknown, or other
  misc_feature (78)..(78): Xaa is any aa, unknown, or other
MVAASGLALPRVSAPCPVRTRGGLRPAFLRVAQPVTLPPPQLXCCASTVDDXVVSAXASSPXLQGVGYGVKLGGCGSXIPTLSVQMMTFRRR

SEQ ID NO: 28406 - DNA, 703 bp, Zea mays
  misc_feature: Ceres CLONE 1402505-F
  misc_feature: Encodes the peptide sequence at SEQ ID NO. 28407
  misc_feature (454)..(454): n is a, c, t, g, unknown, or other
  misc_feature (467)..(467): n is a, c, t, g, unknown, or other
  misc_feature (519)..(519): n is a, c, t, g, unknown, or other
  misc_feature (538)..(538): n is a, c, t, g, unknown, or other
  misc_feature (629)..(629): n is a, c, t, g, unknown, or other
  misc_feature (678)..(678): n is a, c, t, g, unknown, or other
aaagctggagctccccgcggtggcggccgctctagaactagtggatcccccgggctgcaggaattcgcacgagaccattacctagaacatcctaatcgaaaatcacgttcaaatcagagacaaatgcttcctttagagcagcaaattcttttaggccttcagcatgagcatgaacaacaacttcagtcccaacaattggcaaatgctctgcggcaacattcaggcagggaagaagaaaggcacttaagtggggtctggccaatggatgatgctgcccagtttatccgctcaggaaccagtccaaatcagagacacggtcgtttcgatctactggagaaccttcagagatcgtcatcgtttgatcatcatgaccatctagaccgcagcttatcgttacaggaacgattgcatatgggtggtctaggtattcactccctagaacgatctgattctntgcccctggtggntggtcctggaccaaacacagatgtcataaatgccctatcacgccatcatggnacttgggcagttggaaaancatgggtgatgtattattacccttttgggtcaaatgcctatgcttccccttcagggtgttcatcctcagcaacataggcatcaggaccagncttcctggttctccacataggaaagggcttgaaaggcactggtcagatncccaatgggtcagttgcaaaatagt

SEQ ID NO: 28407 - protein, 204 aa, Zea mays
  misc_feature: Ceres CLONE 1402505-F
  misc_feature (152)..(152): Xaa is any aa, unknown, or other
  misc_feature (156)..(156): Xaa is any aa, unknown, or other
  misc_feature (180)..(180): Xaa is any aa, unknown, or other
KAGAPRGGGRSRTSGSPGLQEFARDHYLEHPNRKSRSNQRQMLPLEQQILLGLQHEHEQQLQSQQLANALRQHSGREEERHLSGVWPMDDAAQFIRSGTSPNQRHGRFDLLENLQRSSSFDHHDHLDRSLSLQERLHMGGLGIHSLERSDSXPLVXGPGPNTDVINALSRHHGTWAVGKXWVMYYYPFGSNAYASPSGCSSSAT

SEQ ID NO: 28408 - DNA, 736 bp, Zea mays
  misc_feature: Ceres CLONE 1402507-F
  misc_feature: Encodes the peptide sequence at SEQ ID NO. 28409
  misc_feature (549)..(549): n is a, c, t, g, unknown, or other
  misc_feature (688)..(688): n is a, c, t, g, unknown, or other
  misc_feature (707)..(707): n is a, c, t, g, unknown, or other
aaagctggagctccccgcggtggcggccgctctagaactagtggatcccccgggctgcaggaattcgcacgagaccattacctagaacatcctaatcgaaaaaccacgggcagaccagaccaccagagtgcctccaccctcgaggcctccagtgtccactgcctactcgccccacgccacccaaatcccgtcggcacgaccaagaatccaagccggtgcgccgtataaatctaaccaatcgccatccgcccaccccccaaatcccaccacccttttccccttccaaccctcggttatctctccgtgccgtcatggaagtgttctactacctcgtgttcggcgcgctcgccgccatcgtggcggcgctggagctcgccgagtccggcaaggaccgcgtcgccacctccccggtcttcaactcatttaagaacaactacatcctcgtttactccctcatgatgtctggggactggctgcaggggccctacgtgtactacctctacagccagtacggcttcgacaagggcgacattggccgcctcttctcgnccggcttcggttcctccatgctcttcggcaccatcgtcggatccctcagcggataagcacggcggaagaagggcgtgtgtcacgtactgcatcacctacatcctcagctgcatcaccaagcactctccccagtacaagntttcttattgattgagcgntgtcctttggtgggcattgccacttcgct

SEQ ID NO: 28409 - protein, 97 aa, Zea mays
  misc_feature: Ceres CLONE 1402507-F
  misc_feature (80)..(80): Xaa is any aa, unknown, or other
MEVFYYLVFGALAAIVAALELAESGKDRVATSPVFNSFKNNYILVYSLMMSGDWLQGPYVYYLYSQYGFDKGDIGRLFSXGFGSSMLFGTIVGSLSG

SEQ ID NO: 28410 - DNA, 704 bp, Zea mays
  misc_feature: Ceres CLONE 1402508-F
  misc_feature (270)..(270): n is a, c, t, g, unknown, or other
  misc_feature (492)..(492): n is a, c, t, g, unknown, or other
  misc_feature (569)..(569): n is a, c, t, g, unknown, or other
  misc_feature (580)..(580): n is a, c, t, g, unknown, or other
  misc_feature (657)..(657): n is a, c, t, g, unknown, or other
  misc_feature (658)..(658): n is a, c, t, g, unknown, or other
  misc_feature (679)..(679): n is a, c, t, g, unknown, or other
  misc_feature (692)..(692): n is a, c, t, g, unknown, or other
  misc_feature (693)..(693): n is a, c, t, g, unknown, or other
aaagctggagctccccgcggtggcggccgctctagaactagtggatcccccgggctgcaggaattcgcacgagaccattacctagaacatcctaatcgaaaaggacgcaccggccatggcatctgcacgggctgctgctgcctgctgatagagtggacaatgcatgagctgctgcagatagaatagaacgctgccggcagggtctgctgctgatagatgcatgtatagatagagacgctgctgctagctgccggccggtgcagactgcanaccacgggaggcgcgggcgcgcgctataaaagccgagccagtgggcgcggccagtgtcacaactcacatcgaggtctcagcttcaggaaagggaaggaagcatgttcgggcaccaccacggccacggcgggcaccaccaggccccgccgccgcacgagcagaacgctgttcaggatcttctggccgcgccgacgaggcgtactgcctcaccggcgttcacgnaacgcccgtcgtcctcgcgcccaccaaccccccgcgacgagtaccagcactggtacaaggacatgaggacagcaccnaaggtgagggnacgcggagggccagccagcgttcgcgctcatcaacagggccaccggcctcgccataagcactcgctcggcagccatnnccccgggaagctgggcctaanacgcgagtacggnnacgaatcggtg

SEQ ID NO: 28411 - DNA, 675 bp, Zea mays
  misc_feature: Ceres CLONE 1402509-F
  misc_feature: Encodes the peptide sequence at SEQ ID NO. 28412
aagctggagctccccgcggtggcggccgctctagaactagtggatcccccgggctgcaggaattcgcacgagaccattacctagaacatcctaatcgaaaaactactagtgatcagaccagtgagctagcgactgtaccatgcagcagctgtaggagagcctggtggtaggtaggataggagtagcgccagccgccaagtgcgcgtccgggctggctgcttcgacgagcaggagggagccgcaccgccgggctcccgcaatgtcgcctcctccgcccccgccgctgctgcgcaacgagctgtcgcgcaggacggcggtgctgggcctgcgcctgtgggtgctggtgggcatcgccgtcggggccgccttcgtgctgctcctcgtgctcatctccctccacctcgccgcggtgcggcggaggcggcccaggaagggcgtcgcgcacgcgcacgcgcccgcgccggcgggggcgccgccgctgtccacgtccaccatcccgcccgtgtccaaggagatccaggaggtggccgtccacgacggctcgctccgccactacctcgagacggggtacgcgttcctcaaggacggtggacgcgacgagcactgcgacggtgagcccgtggctcaggggtcgcagcgcgtccacatcgaggctgagaaggaccggtgctggtc

SEQ ID NO: 28412 - protein, 138 aa, Zea mays
  misc_feature: Ceres CLONE 1402509-F
MSPPPPPPLLRNELSRRTAVLGLRLWVLVGIAVGAAFVLLLVLISLHLAAVRRRRPRKGVAHAHAPAPAGAPPLSTSTIPPVSKEIQEVAVHDGSLRHYLETGYAFLKDGGRDEHCDGEPVAQGSQRVHIEAEKDRCW

SEQ ID NO: 28413 - DNA, 709 bp, Zea mays
  misc_feature: Ceres CLONE 1402510-F
  misc_feature: Encodes the peptide sequence at SEQ ID NO. 28414
  misc_feature (484)..(484): n is a, c, t, g, unknown, or other
  misc_feature (579)..(579): n is a, c, t, g, unknown, or other
  misc_feature (685)..(685): n is a, c, t, g, unknown, or other
  misc_feature (703)..(703): n is a, c, t, g, unknown, or other
aaagctggagctccccgcggtggcggccgctctagaactagtggatcccccgggctgcaggaattcgcacgagaccattacctagaacatcctaatccaaaagaaataaaggactatctcagcgatttccgaaccctccccacccccacacccacccgatccaaccgagtcccggcggcgatggcggcggcggcgacgaacgccgatgtggaggtggtcgacttcgacctcgatgacgacgacctcatggacgaggacgccgggccggatccagcaccgccccccgcctcccgcctccgctccaccatcgcgggcgacgacgcgccgcgtaggaccaagggccgcggcttccgcgaggaccctaactcctccgcgacccgcgactcgcggtttgggcgcggggggacgcgccgacctcgactcgcttggcggccctggacccatccagtgtacgtctacccttctctttcaatttttttctcanagatttgcttgaaccgattattattttcttttggcaacgtagtactgaggctgaggaagtaatacttcgttttgggtgactgaatgcctatgtangttagtatttgtgctgcctagacatattgccttctctgtgtgatttgcgggatatggggtattccaacaactgaacaacctaaagattcgcatggtatcggttagntccatggcggacttagcnaaactt

SEQ ID NO: 28414 - protein, 121 aa, Zea mays
  misc_feature: Ceres CLONE 1402510-F
  misc_feature (102)..(102): Xaa is any aa, unknown, or other
MAAAATNADVEVVDFDLDDDDLMDEDAGPDPAPPPASRLRSTIAGDDAPRRTKGRGFREDPNSSATRDSRFGRGGTRRPRLAWRPWTHPVYVYPSLSIFFSXICLNRLLFSFGNVVLRLRK

SEQ ID NO: 28415 - DNA, 720 bp, Zea mays
  misc_feature: Ceres CLONE 1402511-F
  misc_feature: Encodes the peptide sequence at SEQ ID NO. 28416
  misc_feature (477)..(477): n is a, c, t, g, unknown, or other
  misc_feature (532)..(532): n is a, c, t, g, unknown, or other
  misc_feature (536)..(536): n is a, c, t, g, unknown, or other
  misc_feature (575)..(575): n is a, c, t, g, unknown, or other
  misc_feature (669)..(669): n is a, c, t, g, unknown, or other
  misc_feature (670)..(670): n is a, c, t, g, unknown, or other
aaagctggagctccccgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggnacgaaggagttcatggaagcccttggctgccggcgctgatgtgtccatgattggncagntccggggcgtcggtttctactctgcctacctcgcgcccnaaaaggagttgtcgtgaccaccaagcacaacgatgagagccagtaccggtgtgggagtccccaagcgggggcgggtcgttcacctgttactcgnntgacacgtcaggggagccagccttggcagggggcactaaagatcacactg

SEQ ID NO: 28416 - protein, 118 aa, Zea mays
  misc_feature: Ceres CLONE 1402511-F
  misc_feature (103)..(103): Xaa is any aa, unknown, or other
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGXEGVHGSPWLPALMCP

SEQ ID NO: 28417 - DNA, 720 bp, Zea mays
  misc_feature: Ceres CLONE 1402514-F
  misc_feature (407)..(407): n is a, c, t, g, unknown, or other
  misc_feature (607)..(607): n is a, c, t, g, unknown, or other
  misc_feature (637)..(637): n is a, c, t, g, unknown, or other
  misc_feature (638)..(638): n is a, c, t, g, unknown, or other
aaagctggagctccccgcggtggcggccgctctagaactagtggatcccccgggctgcaggaattcgcacgagaccattacctagaacatcctaatcgaaaaaaaatagcaatttttccccctgggagcccgagacgcagcgcgaggtgcggccccgtcccctcgccaccggaggagcaggacgacgaggtggcgtcggcgcgaggtagtcgcgcgcctggaagagcggcggcatcggagtcgcaggcggaggcgaggaagtgaggggagagccctatgccaccgccgcggggcgtcgtgctcgctgcacgcactcccaccattttgtcccaactcgaagctcagactcgtggctgtcgtgctgtgcacgacccctcccctagcatcccaagctcctaactgagaanacaggagatggggaagagacggggaacagactaggcgccggagccgcaagagatcccgcgacgcctccccctcctcgtcggattccgattccttcgactccccatcctctccgagcagtagccctgagcgacggagccgcagcagtaagcggaatagatcatcctcatcgcaccgccacagccgcagaaagcgacggggntcgcggagatcccgcgacgaggaccgccgnncgcggaaaagacgggccaggagagaagcgccccccgggggggaattgtggcagggtcttcgactccaaaccggcggaggagg

SEQ ID NO: 28418 - DNA, 737 bp, Zea mays
  misc_feature: Ceres CLONE 1402518-F
  misc_feature: Encodes the peptide sequence at SEQ ID NO. 28419
cccagctggagctccacgcggtggcggccgctctagtactagtggatcccccgggctgcaggaattcgcacgagaccattacctagaacatcctaaaaaaaaaaccgagtcgagtccacagtccacaccaccaccgcgaggtccactaaaaaaacaagagcattaccggcaccaatcaatcaggctggcagtggagtgacagcggcggcaacaccacgcccacgcggcgccggagccgatcccccgatggatctcccgccgctctcccaccaggccctcttcgccgccgtccgatccgccgacgcgcccgccgtccgcgcggtcctggtctacgccgaggcgccggcctcctcctgggccgtgctcgtctccgcttccacggagggcttgcacctccctctttttgttgcccccggatgccaccgcggggagcacgagccacgaaccccacccgtggtgcgctgtgcggtagtccccgctcgacccggcctcgtttcctacttctgttccccgcccccctcctatacttctctcttcccttcccgcccacatacttttttattcattccacccttactcgtgcgttttccccccccgctttcctaatccaattctcccccctcttcccctcgccgttcgcctagtccccccgttttcctaatttcctccgctctatttttcgttcccacttcttcggccaattatccggggggacgcgaagcaccaacatccccctt

SEQ ID NO: 28419 - protein, 119 aa, Zea mays
  misc_feature: Ceres CLONE 1402518-F
MDLPPLSHQALFAAVRSADAPAVRAVLVYAEAPASSWAVLVSASTEGLHLPLFVAPGCHRGEHEPRTPPVVRCAVVPARPGLVSYFCSPPPSYTSLFPSRPHTFLFIPPLLVRFPPPLS

SEQ ID NO: 28420 - DNA, 704 bp, Zea mays
  misc_feature: Ceres CLONE 1402522-F
  misc_feature: Encodes the peptide sequence at SEQ ID NO. 28421
  misc_feature (470)..(470): n is a, c, t, g, unknown, or other
  misc_feature (473)..(473): n is a, c, t, g, unknown, or other
  misc_feature (475)..(475): n is a, c, t, g, unknown, or other
  misc_feature (476)..(476): n is a, c, t, g, unknown, or other
  misc_feature (482)..(482): n is a, c, t, g, unknown, or other
  misc_feature (483)..(483): n is a, c, t, g, unknown, or other
  misc_feature (515)..(515): n is a, c, t, g, unknown, or other
aaagctggagctccccgcggtggcggccgctctagaactagtggatcccccgggctgcaggaattcgcacgagaccattacctagaacatcctaatcgaaaactctcttcttccaccaccacctcctactccgctgcaaccccaaatctctccttcctcgcatacgcgcgcagcggaggagctgagaccaacgaagaagaagaagaacaaccgagcaagcacaagcttagctagcgtgtaggtgtccaaggcgacgacggccgccgcgccaggctagccaaccagctgctcatcgctcctagctgcggagccgatatggctggcgccgacgtcgacgtcgggacggagctccgtctcggcctgccgggaggaggcgccgatgcggccaaggctgccaagaggggcttcgaggacaccatcgaccctcagctgaagctgcccaccgccggcatggagaaagctgggcgcgncgncnngcgcgnncgcaagcccgagccggcaggcgagaaggccangaaggcccgccgaggcgccgggcgctgatgccgaaaaagcacccgcacccaagcaacaagttggggggtggcccaacaggtcgggtcataccgaagggaccgcatgaccggccagtccgggaaaagacagaaggaaaaggggcctggaaaagcaatagtcccggtggcaaacccggggggaaagggcca

SEQ ID NO: 28421 - protein, 75 aa, Zea mays
  misc_feature: Ceres CLONE 1402522-F
  misc_feature (52)..(52): Xaa is any aa, unknown, or other
  misc_feature (53)..(53): Xaa is any aa, unknown, or other
  misc_feature (54)..(54): Xaa is any aa, unknown, or other
  misc_feature (56)..(56): Xaa is any aa, unknown, or other
  misc_feature (67)..(67): Xaa is any aa, unknown, or other
MAGADVDVGTELRLGLPGGGADAAKAAKRGFEDTIDPQLKLPTAGMEKAGRXXXRXRKPEPAGEKAXKARRGAGR

SEQ ID NO: 28422 - DNA, 673 bp, Zea mays
  misc_feature: Ceres CLONE 1402523-F
  misc_feature: Encodes the peptide sequence at SEQ ID NO. 28423
  misc_feature (335)..(335): n is a, c, t, g, unknown, or other
  misc_feature (455)..(455): n is a, c, t, g, unknown, or other
  misc_feature (483)..(483): n is a, c, t, g, unknown, or other
  misc_feature (487)..(487): n is a, c, t, g, unknown, or other
  misc_feature (488)..(488): n is a, c, t, g, unknown, or other
aagctggagctccccgcggtggcggccgctctagaactagtggatcccccgggctgcaggaattcgcacgagaccattacctagaacatcctaatcgaaaaattcttttctgctgctgcgaccgtaggatcggcgtccagcagcctcgccgcgtcggtatggttttcccttggcccacacatcctagctcttccgcattcttgaatttcgtggtcgaggattagggggtttctcgtgcgctggtccaatttcgcgctaatcgtcctgttcctgcctcggattactcgccttctcgtggtccccatctgttcttggcgttcgcacgcttgccgtgncgcgggcagggctgcagcagcagccggcagcgcgtgcatcttgcgaccccctttccagaccagctgcaagctttggccttttccccgctgcgtacccgaaatccccgcagaactccaccnagaaaaaaagcgcccctttttggctggntggnntgcattctcaggccccccgagttttggggagctttgaaacgagccccgttccaaaacggaggttggggggggggtgttcccccgcggggaagggagggaaatttgccgccgaaacagggccccaggggaggccccttggatggggggggaccgtttacattttcccgtcaaccccgggggttcag

SEQ ID NO: 28423 - protein, 73 aa, Zea mays
  misc_feature: Ceres CLONE 1402523-F
AGAPRGGGRSRTSGSPGLQEFARDHYLEHPNRKILFCCCDRRIGVQQPRRVGMVFPWPTHPSSSAFLNFVVED

SEQ ID NO: 28424 - DNA, 712 bp, Zea mays
  misc_feature: Ceres CLONE 1402524-F
  misc_feature: Encodes the peptide sequence at SEQ ID NO. 28425
  misc_feature (616)..(616): n is a, c, t, g, unknown, or other
  misc_feature (650)..(650): n is a, c, t, g, unknown, or other
aagctggagctccccgcggtggcggccgctctagaactagtggatcccccgggctgcaggaattcgcacgagaccattacctagaacatcctaatcgaaaaacggaagggcccggacagttttgcgcacaagccccccattcccattctaccaccgacccgtcccgtcccactgcctgccagcgtctcccccgctccctctcctcgagagatctcgcgctccggcgatcgggcgcggcgggcggagggtcgcgaagtgccctgcccacccccgatgctcttcccgaagcgcatcaactacgtggccccgatgctcgcctccgccgccatcctgctcctcctcctctcgggctacttcgagctcccctccatctccaccccggcgccgctcctcgcgggcgcagcgcgcttccccaccgcgctcgactccgtcggatcgcgcgaccgcgaccccttcacctcgctcctcgaggccttcgcgtcctgggacgccgccgtcggctgcccccgcgtccgcgccaagctcgccgccgcggggctggggctgagcccgggcctgccgctgccgagtgcgagcgccagcgccagcgctaccgccaccgcgaaggaccctgcgncggcgtccgtcagcgccgacgccgcgtggcgcgnacccgccagggcgcaagaacctgcacacttcccacctcggggtgtccgtcaggggttggaca

SEQ ID NO: 28425 - protein, 146 aa, Zea mays
  misc_feature: Ceres CLONE 1402524-F
  misc_feature (115)..(115): Xaa is any aa, unknown, or other
  misc_feature (126)..(126): Xaa is any aa, unknown, or other
MLFPKRINYVAPMLASAAILLLLLSGYFELPSISTPAPLLAGAARFPTALDSVGSRDRDPFTSLLEAFASWDAAVGCPRVRAKLAAAGLGLSPGLPLPSASASASATATAKDPAXASVSADAAWRXPARAQEPAHFPPRGVRQGLD

SEQ ID NO: 28426 - DNA, 682 bp, Zea mays
  misc_feature: Ceres CLONE 1402527-F
  misc_feature (361)..(361): n is a, c, t, g, unknown, or other
  misc_feature (477)..(477): n is a, c, t, g, unknown, or other
  misc_feature (488)..(488): n is a, c, t, g, unknown, or other
  misc_feature (489)..(489): n is a, c, t, g, unknown, or other
  misc_feature (495)..(495): n is a, c, t, g, unknown, or other
  misc_feature (506)..(506): n is a, c, t, g, unknown, or other
  misc_feature (517)..(517): n is a, c, t, g, unknown, or other
  misc_feature (576)..(576): n is a, c, t, g, unknown, or other
  misc_feature (598)..(598): n is a, c, t, g, unknown, or other
  misc_feature (624)..(624): n is a, c, t, g, unknown, or other
  misc_feature (625)..(625): n is a, c, t, g, unknown, or other
  misc_feature (627)..(627): n is a, c, t, g, unknown, or other
  misc_feature (632)..(632): n is a, c, t, g, unknown, or other
aagctggagctccccgcggtggcggccgctctagaactagtggatcccccgggctgcaggaattcgcacgagatcattacctagaacatcctaatcgaaaaagaggcttttctcaaaaacgcgccgtcgccgtttcttccccctttttctttgagaaaattcgcccgcgagatctttagtttcagaccccgtgtggattagtcgctgtcacgatcgaggcggggcgccaattgcggtggccaccacctccaatccactccccgcggtggcctcgccgagctgttcttgctccgtcctccctccaactccaagatttgtttcgcacccgattcctgagcttccgcggcgcttcttgctgaanagaaagtccgagttctcagttctggatgatagagaggcggttcctttgcgggctctgaggttcagctctcgctcttggattgtctcatcgacgcatcagttgggctgcaggcttanagctggaaggnnatattngactagagaantggggcagtgntgtaccagagctcccgccccggactctggacggggaggcaccatggttatggctattcntaccaaggaaaggcagggcaancccctttcgagtacaaccctcctcannanccggncgggggtgaagtaccagccgcccgggaccgacccttccggaagccccacc

SEQ ID NO: 28427 - DNA, 628 bp, Zea mays
  misc_feature: Ceres CLONE 1402545-F
  misc_feature: Encodes the peptide sequence at SEQ ID NO. 28428
caaagctggagctccccgcggtggcggccgctctagaactagtggatcccccgggctgcaggaattcgcacgagaccattacctagaacatcctaaaaaaaaccttaatcctatactttcatcgggcgcggcgtgccccctcgcctccaaggctccaacgcatcaatcaatagagcgagcgcgctgtggcatggagcacaaggatgggggcacagcttctgctggtggtctgcccgccggaagcagcttgtgctcgggctcgccgttgctcgacgcgccgatcctccgccgcctctacgccgggcaaatccttgccagatggggcgcgagacatcctctctcgtggtgctcggtcccgtggtggggacgctcgttggaagggccacataccttcaggttttgggcatctggctgctgtcgcaaagcatatccttgattgtcgctggaacctcggtgaccaccctgctcatgtatgccaacctgagagccacaagcttcccggcattcatggcgctggtcgccgttaccaacgtctccggcgctctagctgccctctcagctctcgccggcaccatactgatcgagagagaatgggtggtggtgatctcgagcgggcatcctccgtcgg

SEQ ID NO: 28428 - protein, 103 aa, Zea mays
  misc_feature: Ceres CLONE 1402545-F
MGRETSSLVVLGPVVGTLVGRATYLQVLGIWLLSQSISLIVAGTSVTTLLMYANLRATSFPAFMALVAVTNVSGALAALSALAGTILIEREWVVVISSGHPPS

SEQ ID NO: 28429 - DNA, 639 bp, Zea mays
  misc_feature: Ceres CLONE 1402556-F
  misc_feature: Encodes the peptide sequence at SEQ ID NO. 28430
aaagctggagctccccgcggtggcggccgctctagaactagtggatcccccgggctgcaggaattcgcacgagaccattacctagaacatcctaatcgaaaaagatttggatgtggactagatgcttaaggtgtgaacgtgaaagtggggtccccagatcatcacgaagggtgataatgtcagctgaagcacactacctttcatttgggaagttccttgaacttagtttttcaagccactcaaccgctagaaggctgccaatatgcgggcattcactcaatacggattgtctgcgctttttttgggttgggctccaaagttgcaatgttccagtattcctcagtcgaaatttacaatgcctgcaaaccacagcctactcttgagattcacaaccccgatatgcacaaagatgccccaaggttgctgccctcgtgtttcgtgctctgattgttgagtcttcaatgagagctgattccagttatatagaggtgaacaagcttttgattatttcttttgttaatttggtgcaacatatagaggtgaacaagcttattaaaggaagatccttgtacaatcaagagttcatacaatagatgaaacgatattgtgattctctcaatggtggcttcatgagcaagc

SEQ ID NO: 28430 - protein, 90 aa, Zea mays; identical to SEQ ID NO: 11994
  misc_feature: Ceres CLONE 1402556-F

SEQ ID NO: 28431 - DNA, 643 bp, Zea mays
  misc_feature: Ceres CLONE 1402557-F
  misc_feature: Encodes the peptide sequence at SEQ ID NO. 28432
aaagctggagctccccgcggtggcggccgctctagaactagtggatcccccgggctgcaggaattcgcacgagaccattacctagaacatcctaatcgaaaaacttcttttcccccagttgcgttgcgtgcccctcgtttccacactttgttgcgctcctttagcgccggcggcccgtagcctcaatcatcatttccattccatccggtttcttccgacgacggtgtgtacagagagcaggatcggacaagtctctgctggtagaagcatggcgcagcgccggctgttgggcacggcgccggcgcccgcgggcgatgcggcgtcgcacggctcgggctccagccccgacgcgatgcggatcatggtgggcgtgctggtaacggtcatcgtctgcacgctgctctactgcgtctactctggcggtggcggaagcgcaatgccatccggagatccctgctggacagcctatggcggcggtcgagctcggacctgccgctcatggacctcgcctccatcctcgctgccaccgacaacttctccaaggccaacaagctcggcgagggcggcttcggccccgtctacagagtgagaaatcaacccaaggtcgatggatgtggccacagctagctgttttgttactcta

SEQ ID NO: 28432 - protein, 106 aa, Zea mays
  misc_feature: Ceres CLONE 1402557-F
MAQRRLLGTAPAPAGDAASHGSGSSPDAMRIMVGVLVTVIVCTLLYCVYSGGGGSAMPSGDPCWTAYGGGRARTCRSWTSPPSSLPPTTSPRPTSSARAASAPSTE

SEQ ID NO: 28433 - DNA, 634 bp, Zea mays
  misc_feature: Ceres CLONE 1402558-F
  misc_feature: Encodes the peptide sequence at SEQ ID NO. 28434
aaagctggagctccccgcggtggcggccgctctagaactagtggatcccccgggctgcaggaattcgcacgagaccattacctagaacatcctaatcaaaaaatctcacggctagctagcacaagcatagtgcaggggcttgccacctaagtaaggcccgcctgagagccatggcatccaaggccgtcctcttcttggctctcaacctcctgttcttcacggtggccaacgcctgcggcaactgcccgaccccaacgcccccggtcgagccaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggcggtggaggatcccatgttgatccatttgacatcttctcatcattttttggaccctcttttggaggaggtggtggaagcagcaggggaagaaag

SEQ ID NO: 28434 - protein, 114 aa, Zea mays
  misc_feature: Ceres CLONE 1402558-F
  misc_feature (13)..(71): Pfam Name: DnaJ Pfam Description: DnaJ domain
MFGRAPKKSDNTKYYEILGVPKSASQDDLKKAYRKAAIKNHPDKGGDPEKFKELAQAYEVLSDPEKREIYDQYGEDALKEGMGGGGSHVDPFDIFSSFFGPSFGGGGGSSRGRK

SEQ ID NO: 28435 - DNA, 633 bp, Zea mays
  misc_feature: Ceres CLONE 1402567-F
  misc_feature: Encodes the peptide sequence at SEQ ID NO. 28436
  misc_feature (136)..(136): n is a, c, t, g, unknown, or other
  misc_feature (283)..(283): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (534)..(534): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
caaagctggagctccccgcggtggcggccgctctataactagtggatcccccgggctgcaggaattcgcacgagaccattacctagaacatcctaatcgaaaaatattccgggtcggactttcccagcttaacatnttatggttcacgcaaaacaccatggttgaggactatgtggaagctgcagtgaagcaggccatgactatccacataaccagcggccttggtgatatcctaatcttcatgactgggcacgaagaaattgaggctacctgctatgcgccnttgctgaacgcatggaacagttaatatcgtcatccaccaagactatcccccaagctagagattctgcccatctactcacagttgccctgctgactttgcagcccacatttttcccaaagctgaaaaagggcgctccaaagcggaattggtggttaccaatttttccttgggacctcctttaaaagggtggaggggaactctctagggccattgggnnnccggtatttggggaaaggagaaagggggaccanacccccccnnnctggggttttgggaagccctcccccaaaggtttttttcccccttaaaaccccggggaaacacctgccacaaacaccacaaccaccnnn

SEQ ID NO: 28436 - protein, 101 aa, Zea mays
  misc_feature: Ceres CLONE 1402567-F
  misc_feature (45)..(45): Xaa is any aa, unknown, or other
KAGAPRGGGRSITSGSPGLQEFARDHYLEHPNRKIFRVGLSQLNXLWFTQNTMVEDYVEAAVKQAMTIHITSGLGDILIFMTGHEEIEATCYAPLLNAWNS

SEQ ID NO: 28437 - DNA, 470 bp, Zea mays
  misc_feature: Ceres CLONE 1402571-F
  misc_feature: Encodes the peptide sequence at SEQ ID NO. 28438
  misc_feature (255)..(255): n is a, c, t, g, unknown, or other
aaagctggagctccccgcggtggcggccgctctagaactagtggatcccccgggctgcaggaatcgcacgagaccattacctagaacatcctaatcgaaaagtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacnaacgagcgctgactgtggggcctcgcggtccccatctggctggaggactaccacctgatcgaaaaggtgggccaacttcccggggggaacgcatcccggaaccgggggggccccccccccggggcccccccccaagggcttttcttctaaggggcccccccccaacgggggaacccccttttgaaaggggggggcaaatattttttggggggggg

SEQ ID NO: 28438 - protein, 100 aa, Zea mays
  misc_feature: Ceres CLONE 1402571-F
  misc_feature: SWISSPROT Homolog: EC 1.11.1.6 Catalase
  misc_feature (29)..(29): Xaa is any aa, unknown, or other
MDPTKFRPSSSHDTTVTTTNAGAPVWNDXRALTVGPRGPHLAGGLPPDRKGGPTSRGERIPEPGGPPPRGPPPRAFLLRGPPPTGEPPFERGGQIFFGGG

SEQ ID NO: 28439 - DNA, 672 bp, Zea mays
  misc_feature: Ceres CLONE 1402572-F
  misc_feature: Encodes the peptide sequence at SEQ ID NO. 28440
  misc_feature (318)..(318): n is a, c, t, g, unknown, or other
  misc_feature (359)..(359): n is a, c, t, g, unknown, or other
  misc_feature (369)..(369): n is a, c, t, g, unknown, or other
  misc_feature (385)..(385): n is a, c, t, g, unknown, or other
  misc_feature (397)..(397): n is a, c, t, g, unknown, or other
  misc_feature (399)..(399): n is a, c, t, g, unknown, or other
  misc_feature (404)..(404): n is a, c, t, g, unknown, or other
  misc_feature (407)..(407): n is a, c, t, g, unknown, or other
  misc_feature (468)..(468): n is a, c, t, g, unknown, or other
ccaagctggagctcaccgcggtggcggccgctctagtctagtggatcccccgggctgcaggaatttgcacgagaccattacctagaacatcctaatcaaaatcttctgaactctgaactatgttatccaataccgttggtggtgggccgcagaaccgcgcgcacgggggagccaatggcgatcgtggccattctcgtcgcgcccaccgccagctacgtcgggccgcgccgccggtggcgcgccgcggcagcctcgtcttcggcggcgtccggggtggacctcaaagcgctgcaggccgccatcgataagaaaagcagngatgatgttaggcaggcgctggaccagctgaaaaagagcgnatgggacaancggtggggtttgtagncctatgtgtcgngncgganganatctctactggaactcactacccttggaatcaagaatggtgagaatttagcaatttccagngttaaaaatgatgcagaatttcttgtttacaggtgaggcgaaccctggcactctttacccgcccttggaggcccaccttccctgggaaatttgggcctttctttgcccccctaacttggattggaaaacattttcaattcgatcggaattggggtggccgggaacaccctccgctttcaaagttcttctctgccaaaaaaaaaa

SEQ ID NO: 28440 - protein, 69 aa, Zea mays
  misc_feature: Ceres CLONE 1402572-F
  misc_feature (48)..(48): Xaa is any aa, unknown, or other
  misc_feature (62)..(62): Xaa is any aa, unknown, or other
  misc_feature (65)..(65): Xaa is any aa, unknown, or other
MAIVAILVAPTASYVGPRRRWRAAAASSSAASGVDLKALQAAIDKKSXDDVRQALDQLKKSXWDXRWGL

SEQ ID NO: 28441 - DNA, 657 bp, Zea mays
  misc_feature: Ceres CLONE 1402580-F
  misc_feature: Encodes the peptide sequence at SEQ ID NO. 28442
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
aaagctggagctccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacgggcttcgtgtggctccggcagcgccgcaaggtggaccactacttcgccaaggccggccgccacgtgtcctacggcgccgaggtgtcggcggtggccgacaagggccggctcaagaagatcacgggcgtcaaggccaaggagatgctgctgtgggtcaccctccacgagatctgcgtcgacgacccgcccactggtaagctccactgcaaggccatcggcggcctgtcccgcagcttccccgtcgaggccttcgaggccgaggagccggcgccgccggagccggggctcccagggacgggggggggggnnnnnttttttttg

SEQ ID NO: 28442 - protein, 161 aa, Zea mays
  misc_feature: Ceres CLONE 1402580-F
  misc_feature (2)..(149): Pfam Name: DUF538 Pfam Description: Protein of unknown function, DUF538
  misc_feature (157)..(157): Xaa is any aa, unknown, or other
  misc_feature (158)..(158): Xaa is any aa, unknown, or other
MTLTIPDEVRAKAEVYVGDAAGQEKTRLLLQETGLPSGLLPLRDIIECGYVEETGFVWLRQRRKVDHYFAKAGRHVSYGAEVSAVADKGRLKKITGVKAKEMLLWVTLHEICVDDPPTGKLHCKAIGGLSRSFPVEAFEAEEPAPPEPGLPGTGGGXXFFL

SEQ ID NO: 28443 - DNA, 606 bp, Zea mays
  misc_feature: Ceres CLONE 1402596-F
  misc_feature: Encodes the peptide sequence at SEQ ID NO. 28444
cgctctagaactagtggatcccccgggctgcaggaattcgcacgagaccattacctagaacatcctaatcgaaaactctcgattcggaaaaccctccaaccctagccgggatccgacaacgcctccatccctagccgcctcctgcaagtttcagagctcaagagtcggggcgccatggcgacagagacggagactttcgcctttcaggctgagatcaaccagctgctctcactcatcatcaataccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgctctccatcatcgacagcggcatcggcatgaccaagtccgaccttgtcaacaaccctcggtaccatcgccaggtccggggaccaaggagttcatggaagcccttgctgctggcgctgatgtgtctatgattgggcagttcggtggcggtttccactccggctacctcggccgcgagagggtcggcgggaccaccaggcataccg

SEQ ID NO: 28444 - protein, 118 aa, Zea mays
  misc_feature: Ceres CLONE 1402596-F
MATETETFAFQAEINQLLSLIINTFYSNKEIFLRELISNSSDALDKIRFESLTDKSKLDAQPELFIHIVPDKASNTLSIIDSGIGMTKSDLVNNPRYHRQVRGPRSSWKPLLLALMCL

SEQ ID NO: 28445 - DNA, 671 bp, Zea mays
  misc_feature: Ceres CLONE 1402599-F
  misc_feature: Encodes the peptide sequence at SEQ ID NO. 28446
  misc_feature (416)..(416): n is a, c, t, g, unknown, or other
  misc_feature (538)..(538): n is a, c, t, g, unknown, or other
  misc_feature (591)..(591): n is a, c, t, g, unknown, or other
  misc_feature (671)..(671): n is a, c, t, g, unknown, or other
ctggagctccccgcggtggcggccgctctagaactagtggatcccccgggctgcaggaattcgcacgagaccattacctagaacatcctaatcgaaaaacttccaccgccaccgccgagcgcggtggcaccgacacgacacacgtagctgcagacctgcagtgccagcacggctgccaatccctgctggcgctgttcccggctccgagatcatttggactcggcactcggcagggatggggatggggacggaatggccgccgacgcctgcgcagcagaggaaagcggtggtgagcgccgggtcggcgctgaagctggtactgttcgggattctcgcgggcctcgcactgcggctggctggtggggcccccagcctacctcctgccgcccaccgccgcgccagagggggccgctcgntcttttcgcggtgccggagagggaaagaaccgccggcggcggcggcggcgggataccttccgtcgaacgggatggatgcggtttttactttgaccgattcagaacctctaacagctttaggncaagaaggaaggttccacaaaccagaagaaaagttgtgatcttttccatgggncgagtgggttcccaattcatcaggaccagcttatactaatggcagctgcccgcttcattgagtctcctcaggactgtagn

SEQ ID NO: 28446 - protein, 113 aa, Zea mays
  misc_feature: Ceres CLONE 1402599-F
  misc_feature (61)..(61): Xaa is any aa, unknown, or other
MGMGTEWPPTPAQQRKAVVSAGSALKLVLFGILAGLALRLAGGAPSLPPAAHRRARGGRSXFSRCRRGKEPPAAAAAGYLPSNGMDAVFTLTDSEPLTALGQEGRFHKPEEKL

SEQ ID NO: 28447 - DNA, 850 bp, Zea mays
  misc_feature: Ceres CLONE 1402605-F
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (78)..(78): n is a, c, t, g, unknown, or other
  misc_feature (79)..(79): n is a, c, t, g, unknown, or other
  misc_feature (850)..(850): n is a, c, t, g, unknown, or other
cggacatagtaacctccataacggccagcccccgcgcccgcggaacgcccggggggtggggaggnnnnccctgccccnnccaagctggagctccaccgcggtggcggccgctctagaactagtggatcccccgggctgcaggagttcgcacgagaccattacctagaacatcctaatcaaaaaatcgctccccttcctcgtgtgcggtgagcgtcgaggactcgtgcgtcctggccttgcatacgatttcgagggacagaggcaaagaaacggaccgcgtgcggcgttcgtcggcaacgttggcgtccatggagagcatcgccgctcccagaaagaggcaaaaggtcgcctcgacccctggatccgtgcacccgcacttgcctcaggaatctccggacggaagatgattggtcccgcattggccttccaggtgccggtcgcgccgcttcacgtgtcccttttgtaagggaatggggtccgatattcgtgtaccggaccgggtatttcccccgggccgaaccaccaacccggaccccaccgccggctacaattggcccacgcagtaatccttttcctcctcggtgggcggcctgggtgtttaatccaccctacgccggcccaacaaaggtcaccctggcggcccgatccgaacccaatttttcacgcctcagatggccacaacaagttttcccggggagggtatcgttgcgggggtgggaccctaagaagccgccggacggcttcgtgaggggctccccaccatagaatcgctccacccggggttccgcaagagcgagggggtgcgataccggtatgaacaaaccttaaaggggccgcgattcgtcacacn

SEQ ID NO: 28448 - DNA, 637 bp, Zea mays
  misc_feature: Ceres CLONE 1402606-F
  misc_feature (637)..(637): n is a, c, t, g, unknown, or other
gctctagaactagtggatcccccgggctgcaggaattcgcacgagaccattacctagaacatcctaatcgaaaaattgttttgggtccggaaaataaaatccaattttctcagtctcgagcgcccgcgtccctcgccccgtcccagcctcccagccgtcccggctccccgcgaccccgccctccggcagtccggcgcgggggctcctctccgatccggtgagccgaacgaggatcccaactccccgaagaaagcggccacagccagagccagggtggctcggctctcctctcacagactgcgccgcagcgcctagcgctcggctggcagccgctccggccggtcggccccgcgcccccgcccctgctgcctacatccgcctgcagacagaagatctgcctccagcgaccgccctgcctgccccttgtggcttctgtgggtctgcacaccagcacacgcacttgtccccaaacaacgggggggggcgatgagtatctgaaaaagagctgcccgggcgaaggatctggacgggggaggaggacggccttcatcaacggaggagggaaatcatcccaccgagataacccatccgacggaaaaagattttcccccgaaccgggaacgaccaaacaatggan

SEQ ID NO: 28449 - DNA, 578 bp, Zea mays
  misc_feature: Ceres CLONE 1402609-F
  misc_feature (277)..(277): n is a, c, t, g, unknown, or other
  misc_feature (306)..(306): n is a, c, t, g, unknown, or other
  misc_feature (406)..(406): n is a, c, t, g, unknown, or other
aaagctggagctccccgcggtggcggccgctctagaatagtggatcccccgggctgcaggaattcgcacgagaccattacctaaacatcctaatcgaaaaaccaacccttgtagtctcagtcaatctgtagattgagactacgatgagcctgtcaccgctcgactcctcctccccgccggccgcggctgcggctgctgctacggaggtgcccctcgccccgggcttccgcttccacccaccgacgaggagctcgtctcctactaactccggcggcgngttctcgggcgccggcttcgcgtcgacgncatcggcgagatcgactctaccggctcgaggcctgggacctccctccctctcccgattccgagccggagggccagtggtacttcttccccgtttcaacgnaaagtcccccggcctgggccgggggcccgggccgtccccgaaaaagaccaacggcttaccccaagggggtctggaaaaccccggcaaggacccgggggggacaccgggggaagcccctgggaaagaaaaaagcccctctttccccccgggaagggggctaaagggaaaagac

SEQ ID NO: 28450 - DNA, 634 bp, Zea mays
  misc_feature: Ceres CLONE 1402611-F
  misc_feature: Encodes the peptide sequence at SEQ ID NO. 28451
aaagctggagctccccgcggtggcggccgctctagaactagtggatcccccgggctgcaggaattcgcacgagaccattacctagaacatcctaatcgaaaaactgcgatgtggtcctctcctcctatcacctgacctccacacacacacacagacagacaggcacgcgcaagcaaaaattcattcatatatgcacgctcgttcgttgtcgatctcccccatcactgcacggcgcggcgcaacaagagcgagggattggagctcagctagtcgtctaatcagctagtaggtacgtgtagctaggctgcgctgcaccagctgccgtgcatgcagtgcatggcgcaggagggctctgaggcctccgtcgccagctccccgccgccccagccgccgccgtcggcctcctcctggtggcgcgacatgcagcacccggctgcctacggcgcgtggcctccgtcccccgcggcgaggtggccgcccccggtatcgatggcgccggcagcgacgcagcagcagcagcagcacggcggccgggcgacgacgtcctccgacggtctctcggcctccaacgccaccgtagcgtccttcaccaccactccgggtccgggctcagcctggactccgcggtgacgtt

SEQ ID NO: 28451 - protein, 100 aa, Zea mays
  misc_feature: Ceres CLONE 1402611-F
MQCMAQEGSEASVASSPPPQPPPSASSWWRDMQHPAAYGAWPPSPAARWPPPVSMAPAATQQQQQHGGRATTSSDGLSASNATVASFTTTPGPGSAWTPR

SEQ ID NO: 28452 - DNA, 718 bp, Zea mays
  misc_feature: Ceres CLONE 1402616-F
  misc_feature: Encodes the peptide sequence at SEQ ID NO. 28453
ggagctccccgcggtggcggccgctctagaactagtggatcccccgggctgcaggaattcgcacgagaccattacctagaacatcctaatcgaaaaactgattgtccacccaccactctacgcaagcaatccttcggacttcggtgggggaaatggaggccgccgccgccgccgagacggggctcgcccagaaaccggctgtgctgtacccttcgccggggatgggccacctggtctccatgatcgagcttggcaagatcctcggcgcgcggggactgtccgtaataattgtcgtcgtcgagcctcccttcgacacgggcgctacgtcgcctttcctcggcggcgtctccgcggtcaagccggccatctccttccaccgcctgcccaaagtcgagcgtctcccgcccgtctagaccgagcaccaggaggcgctcaccttcgaggtcacccgcgtctccgacccgcacctccgcgagttcctggccgccgcgtccccagccgtgctcgtcgtcgacttcttctgcagcatcaccctggacgtggaggaggagctccgcgtggccgcctacttcttcttcacctcggacgccgaggtcctggtcttcttcctgcacctcccggagatccacgagtggaccgccgcgagcttccaggacatggggaaggagctcgtgcacctgccgggcatcgcgtcgatcccggtgacgcactgcatcct

SEQ ID NO: 28453 - protein, 86 aa, Zea mays
  misc_feature: Ceres CLONE 1402616-F
  misc_feature: SWISSPROT Homolog: EC 2.4.1.115 Anthocyanidin 3-O-glucosyltransferase
MEAAAAAETGLAQKPAVLYPSPGMGHLVSMIELGKILGARGLSVIIVVVEPPFDTGATSPFLGGVSAVKPAISFHRLPKVERLPPV

SEQ ID NO: 28454 - DNA, 789 bp, Zea mays
  misc_feature: Ceres CLONE 1402617-F
  misc_feature: Encodes the peptide sequence at SEQ ID NO. 28455
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (31)..(31): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (648)..(648): n is a, c, t, g, unknown, or other
  misc_feature (649)..(649): n is a, c, t, g, unknown, or other
  misc_feature (651)..(651): n is a, c, t, g, unknown, or other
  misc_feature (652)..(652): n is a, c, t, g, unknown, or other
  misc_feature (789)..(789): n is a, c, t, g, unknown, or other
ggtgccccccnnnnncttcccccccccctanataaccgtgtttnnnnnnnacaaagctggagctccccgcggtggcggccgctctagaactagtggatcccccgggctgcaggaattcgcacgagaccattacctagaacatcctaatcgaaaaaatcgcggtcactgctccgaagtccgaaccttcatacacatcgtctcgtttccgatttccccaaattcaggccacaggcgctacaggacccaggcaccactcggtcggcggccaccgcgtcgccccgcctgctcgattggggtcgcgtgtgcgataggaagtattgtgttgtgtttgcaacgtgatagcttgtactgggaacaaaggtcaagatgggcgccttggacctacaccttgactttgcttctgctcaacatggacaagccaagttaaaggaatatgccaagagctctttgttgtctgatggaaactacaatacagacaagatcaatgggtcaaccctgatgactatgaaaatttgagaaggataatgactatggtgtccacattataaggagatgccgatagagctctgctgcatgaattttgatgcgacctgccatgactagatcataatgaatgaggatcaagaannnnnnnnnnnnnnnnnnncnngnnggggggggcggggggcgccaaaccggggcccccggggggccaacaacccagagacgagcaaacaaaacacgggcggggggggcgcgaaggacccgcccaccacgcctgcggcagaagaaagccaccccacacccccn

SEQ ID NO: 28455 - protein, 49 aa, Zea mays
  misc_feature: Ceres CLONE 1402617-F
MGALDLHLDFASAQHGQAKLKEYAKSSLLSDGNYNTDKINGSTLMTMKI

SEQ ID NO: 28456 - DNA, 722 bp, Zea mays
  misc_feature: Ceres CLONE 1402618-F
  misc_feature: Encodes the peptide sequence at SEQ ID NO. 28457
gctctagaactagtggatcccccgggctgcaggaattcgcacgagaccattacctagaacatcctaatcgaaaacttgtgaacatcgcagtgctgtagcctccttcgtcttgagcgagcatggagatgtcagccatggaggaagccctccccaaggcgatggagaggaggaagggaggcctcagaaccattccgttcatcatcttaaacgagatattcgagaaggtggccacgttcgggctgtcggccaacatgatcctgtacctcaccgagcggtatctcatgaccaacgcctttgccaccgtcgtcctctacttctggcatgccttctccaacttcctgcccatcttaggcgccgtgctcgccgacgcccgcctcggccggttccgggtcatcaccctcggctcctgcgttagcctcttcgggatgtgcctgctgtggctgacggcgatccttccggtgtacaagaacaccccggagtgcgcgccgggggcgccggtagggtgcgcggtgctgccgtggcagctgccgctcctcttcacgtcgttcgcggtcatgtccccctcggtcgggcggcatcggcccctgcacgctggcgttcgggggcgaaccagctggacagcgggacaccagggcaagaacggaggacgctgcagacttctttcactgggactacacggggctgggcctctcatcggggtcgggtcaccgtcatcgtgaaat

SEQ ID NO: 28457 - protein, 199 aa, Zea mays
  misc_feature: Ceres CLONE 1402618-F
MEMSAMEEALPKAMERRKGGLRTIPFIILNEIFEKVATFGLSANMILYLTERYLMTNAFATVVLYFWHAFSNFLPILGAVLADARLGRFRVITLGSCVSLFGMCLLWLTAILPVYKNTPECAPGAPVGCAVLPWQLPLLFTSFAVMSPSVGRHRPLHAGVRGRTSWTAGHQGKNGGRCRLLSLGLHGAGPLIGVGSPSS

SEQ ID NO: 28458 - DNA, 833 bp, Zea mays
  misc_feature: Ceres CLONE 1402619-F
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
ttttcccccctctcttctttttcaccccaaccacccaccccagaannnctcaaactgcgactcaccgcggtggcggccgctctagaatagtggatcccccgggctgcaggaattcgcacgagaccattacctagaacatcctaatcgaaaaatcgatcgtcgttggaaggtggtccattcgcattggtctgaatactgtagctactatcgcaagcgctattgtgctgtagctgtttgtctgcttttacagcacgctgcgcttgaatagtagataaattatgatcccttctactctcgatacgcctaaccacctagccatgcacctcccgaagggctttggtcagctttctgttataattatcacatgcccccctacccctttttcatattacgcgtatcaaggagtggtctggacattgtcattctaaattgttggataccagctcctcgatgtgttgagctaaatcattgggctagttcccaccccctgcccttcaaaagctggggaaccctatatactctccccctccacgcgcccagaccaatctacccctcataatggccggcgctaaccgtctcatgatctcctctatctcttcgcgcttctaccaaaacccggacacaaatattgattgggcgtaacgccgcttcatcctggttgggctggcggccatctctcctaatcaccccccagagacaacaccccactactctggtatataaaaacaaagtaaaaaaacacaaaacatacctaccgcgggcccatcatgcattggccctccccccgcatcaacacgaaaagtctgtactgtagagatcctgttttctcctgt

SEQ ID NO: 28459 - DNA, 710 bp, Zea mays
  misc_feature: Ceres CLONE 1402625-F
  misc_feature: Encodes the peptide sequence at SEQ ID NO. 28460
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
gctctagaactagtggatcccccgggctgcaggaattcgcacgagaccattacctagaacatcctaatcgaaaaacaccacgcgctgcagctgctcacacacagtgcaacagaccccctccacctccacgcgatcggacgacacgaagcggccatcggggatcccctccgctacgcctctcgatggtctcctccagcgcgccgccgccgcaggcccagtccgacgcggccgggtcgggggaggaagcgagcaagaaggtgcggaagccgtacacaatcaccaagtcccgggagagctggacggagcaggagcacgacaagttcctcgaggccctgcagctctttgatcgtgactggaagaagatagaggcttttggtggctcaagactgtcatccagatttaggagcatgcacagaagtacctttttgaaggttcagaaaaatgggaaccagcgaacatgtcccaccctcacgaccaaagcgaaaagctgcccatccatattctcaggagggctccaaggatggtatgcccaaattttggcgggaggggacagcttcttagggaggggttttcaatccaagaacaaggggcttctgcggaaacttagggatgacatgtagctggggatcccaggnnnnnnnnnnnnnnnnnnnnnnnnnnnnnnnnnnnnnnnnnnnnnnnnnnnnnnnnnnnnnnnnnnnnnnnnnnnn

SEQ ID NO: 28460 - protein, 145 aa, Zea mays
  misc_feature: Ceres CLONE 1402625-F
  misc_feature (36)..(77): Pfam Name: Myb_DNA-binding Pfam Description: Myb-like DNA-binding domain
MVSSSAPPPQAQSDAAGSGEEASKKVRKPYTITKSRESWTEQEHDKFLEALQLFDRDWKKIEAFGGSRLSSRFRSMHRSTFLKVQKNGNQRTCPTLTTKAKSCPSIFSGGLQGWYAQILAGGDSFLGRGFQSKNKGLLRKLRDDM

SEQ ID NO: 28461 - DNA, 856 bp, Zea mays
  misc_feature: Ceres CLONE 1402626-F
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (21)..(21): n is a, c, t, g, unknown, or other
  misc_feature (30)..(30): n is a, c, t, g, unknown, or other
  misc_feature (33)..(33): n is a, c, t, g, unknown, or other
  misc_feature (46)..(46): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (726)..(726): n is a, c, t, g, unknown, or other
tggttgccccnnncnnncncnccccccccnccnctcccccaccccnttnnnccacaaaggtggcactcaccgcggtggcggccgctctagaactagtggatcccccgggctgcaggaattcgcacgagaccattacctagaacatcctaatcgaaaatcgccccgcgaaccctagctcccgcaactgccgccgccactcccacgctcggagccatgccgcccaagctcgacccgtcgcacgtggtggaggtgctcgtccgtgtgaccgccggcgaggtcggagcggtgtcttcccctgccccaagatcggcccgatcggtcttttccccaagaagatcggagaggacctcgccaaggacaccgccaaggaactgcaagggcctccggcgtcacccttcaagctccaccggcccacaaaccggcaggaccaaggtcctccgatggtaccccttcccgccgggggcggcctcgttcttcagaggcgcctcaaagggggccccggaggaggggcaccgggcaggcaagggccccaaaaaaaccttcacagcccaacgacggcccaaagcattcccagccctccccaaacggcgccgtctctcccaggaaataatggacctaggaccccccttggaggggaacaagggggcccgctggggccacaaggggaaaattgggccccggatcccgccggcaccaggggaaaatatcttctgagcacaccttggntaccaaaccctccccccgtggacatcctcccccacaacctaaaggtatacccccagggagacccggtgcaaaaaggtaaattctcccccccccgtgccaggcggggctacatcccccccccccgctatcg

SEQ ID NO: 28462 - DNA, 675 bp, Zea mays
  misc_feature: Ceres CLONE 1402627-F
  misc_feature: Encodes the peptide sequence at SEQ ID NO. 28463
  misc_feature (449)..(449): n is a, c, t, g, unknown, or other
  misc_feature (563)..(563): n is a, c, t, g, unknown, or other
aaagctggagctccccgcggtggcggccgctctagaactagtggatcccccgggctgcaggaattcgcacgagaccattacctagaacatcctaatcgaaaagttctgttctgttctgtcctgtccatcacaattcacgcgacgacgacccggcctgcgggcagatctttcttgacctagccagctcgttcttggcgcactagctagccagccagctagtagctatcctcgctcctccccaccgtcctcagtgctagactattcgtccgatgggcggcgtccaactcgacgacctctccgaattggccgtgctccggccgatccagacagcggcagcggctcggccgccgggcgacgacgccgaagacggcccggacgccgccgacacgggctgcgtcacgccaacggcctcgagctcccggctgatgccgatgccgcgcctggacggncgctgcggcgccctggacagtaccgacgccgccgcccgccgctgcgtcacgccggcggcgtcaccttgcctgctgcggccggccacggtgtgccctccggcgccgcgaaacccngcgaagtccgcccgcgccgccgccgaacaacagaggaaagcgctgctgttgcgcccgcgccttctttcccgtgcgcacgacttctcccgggtggtcgtcgcgcgcaggtccc

SEQ ID NO: 28463 - protein, 135 aa, Zea mays
  misc_feature: Ceres CLONE 1402627-F
MGGVQLDDLSELAVLRPIQTAAAARPPGDDAEDGPDAADTGCVTPTASSSRLMPMPRLDGRCGALDSTDAAARRCVTPAASPCLLRPATVCPPAPRNPAKSARAAAEQQRKALLLRPRLLSRAHDFSRVVVARRS

SEQ ID NO: 28464 - DNA, 697 bp, Zea mays
  misc_feature: Ceres CLONE 1402631-F
  misc_feature: Encodes the peptide sequence at SEQ ID NO. 28465
  misc_feature (544)..(544): n is a, c, t, g, unknown, or other
  misc_feature (585)..(585): n is a, c, t, g, unknown, or other
  misc_feature (586)..(586): n is a, c, t, g, unknown, or other
  misc_feature (640)..(640): n is a, c, t, g, unknown, or other
  misc_feature (659)..(659): n is a, c, t, g, unknown, or other
  misc_feature (672)..(672): n is a, c, t, g, unknown, or other
  misc_feature (675)..(675): n is a, c, t, g, unknown, or other
caaagctggagctccccgcggtggcggccgctctagaactagtggatcccccgggctgcaggaattcgcacgagaccattacctagaacatcctaatcaaaaacatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcatgttccgcgggccgtggctcgcccgcgcggacttcctgctgacgtgcgacccggcggccgtccagcactgcctggcgtccaaccacgggggctacgacaggggccgagactttgcggagatgttcgacctcctgggcgacgggctgcgggttgcgacgcccgcgntcgtgggcgcgccagcggcacgtcgccgccaccgtctcggnnaccccgggcggtcccggtccttcgtcctgtgcaccatggcgcgccaaaaacgcncggcttggctccgtgcggnttcctggatgcgncgncgggggaataaggaaaggggaa

SEQ ID NO: 28465 - protein, 179 aa, Zea mays
  misc_feature: Ceres CLONE 1402631-F
  misc_feature (129)..(129): Xaa is any aa, unknown, or other
  misc_feature (143)..(143): Xaa is any aa, unknown, or other
  misc_feature (161)..(161): Xaa is any aa, unknown, or other
  misc_feature (167)..(167): Xaa is any aa, unknown, or other
MGALRSLAISYPEFLVAGLCFVSLSALRHAMRERRQRAPLSWPVVGMLPFVLANLGRLYDAITDALHGSGCTLMFRGPWLARADFLLTCDPAAVQHCLASNHGGYDRGRDFAEMFDLLGDGLRVATPAXVGAPAARRRHRLGXPGRSRSFVLCTMARQKRXAWLRAXSWMRRRGNKERG

SEQ ID NO: 28466 - DNA, 690 bp, Zea mays
  misc_feature: Ceres CLONE 1402637-F
  misc_feature: Encodes the peptide sequence at SEQ ID NO. 28467
aaagctggagctccccgcggtggcggccgctctagaactagtggatcccccgggctgcaggaattcgcacgagaccattacctagaacatcctaatcgaaaaattattcatgattcgaatcgaggtctcagcttcaggaaaggtaatggagcatgtttagtaataaccactaccacgagtgctgcgctgcatcaccagtacctcccgccgcaagagcagaccctgtatgggatattctgccgcgccgatcatgcgtactgtcttactgtgcgccacgacgccctcgtcctcgggcccaccaacccccgcgacgagtaccagaactgcaacaaggacatgaggtacagcacgaacgtgaaggacgcttaggcacagccgtcgttcgcgctcatcaaccgtggcaccggactcagcatcgagcactcgctcggtagtaccgtctcgtgaagctcgagacctacaacgcgtactacctggacgagtcgtggctgtggacggagatccacgactcggccaaggttttcggctgcatccagcaggtacgacatattcatgtcaacttcgagggcatgcacggcgacgagatcactgatgttgggaacgacggccccacgaggtggttctgggaatggtgggaggggccccaccaaacattgaaagggttgccctggggggaacaagcctatgggc

SEQ ID NO: 28467 - protein, 122 aa, Zea mays
  misc_feature: Ceres CLONE 1402637-F
KAGAPRGGGRSRTSGSPGLQEFARDHYLEHPNRKIIHDSNRGLSFRKGNGACLVITTTTSAALHHQYLPPQEQTLYGIFCRADHAYCLTVRHDALVLGPTNPRDEYQNCNKDMRYSTNVKDA

SEQ ID NO: 28468 - DNA, 679 bp, Zea mays
  misc_feature: Ceres CLONE 1402641-F
  misc_feature: Encodes the peptide sequence at SEQ ID NO. 28469
aaagctggagctccccgcggtggcggccgctctagaactagtggatcccccgggctgcaggaattcgcacgagaccattacctagaacatcctaatcgaaaactcaaacgcaaaccccaatctcggcgtcaccgccccaaatctagcaaacggaaatcccatctcgccgccgccgcgatgtctcgccgctatgacagtcgcacgacgatcttctcgccggaggggcgtctctaccaggtggagtacgcgatggaggcgatcggcaacgccgggtcagccctcgggatcctggcggacgacggcgtaatcctggtcggcgagaagaaggagacctccaagctcctccagacctcccgctccgccgagaagatgtacaagatcgactcccacctggcgtgcgctgtgacagggatcatgtccgacgccaacatcctcatcaacaccgcccgcctccacgaccagggctacgcgctctcctaccatgagcccatccccggcgagcagctcgtgcagtccctctgcgacaccaagcaaggttacacccagtttggtggcctccgcccctttggggtctccttcctatttcgcggatgggacaagcaccacggcttccagctctacatgagcgacccatctggcaactacggagggtggaaggccgccgctgttggggccacag

SEQ ID NO: 28469 - protein, 167 aa, Zea mays
  misc_feature: Ceres CLONE 1402641-F
  misc_feature (28)..(166): Pfam Name: Proteasome Pfam Description: Proteasome A-type and B-type
  misc_feature: SWISSPROT Homolog: EC 3.4.25.1 Proteasome endopeptidase complex
MSRRYDSRTTIFSPEGRLYQVEYAMEAIGNAGSALGILADDGVILVGEKKETSKLLQTSRSAEKMYKIDSHLACAVTGIMSDANILINTARLHDQGYALSYHEPIPGEQLVQSLCDTKQGYTQFGGLRPFGVSFLFRGWDKHHGFQLYMSDPSGNYGGWKAAAVGAT

SEQ ID NO: 28470 - DNA, 657 bp, Zea mays
  misc_feature: Ceres CLONE 1402646-F
  misc_feature: Encodes the peptide sequence at SEQ ID NO. 28471
aagctggagctccccgcggtggcggccgctctagaactagtggatcccccgggctgcaggaattcgcacgagaccattacctagaacatcctaatcgaaaaaatccaacaagcaaacctgcagtcatctcctccatcaccaccaaactcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcctcagcgagaactgcaagaggtcctgcacccctcctccttcttgaagccccttgaaatgaatgaaccatgcaggcgctg

SEQ ID NO: 28471 - protein, 149 aa, Zea mays; identical to SEQ ID NO: 12336
  misc_feature: Ceres CLONE 1402646-F

SEQ ID NO: 28472 - DNA, 670 bp, Zea mays
  misc_feature: Ceres CLONE 1402649-F
  misc_feature: Encodes the peptide sequence at SEQ ID NO. 28473
ggagctccccgcggtggcggccgctctagaactagtggatcccccgggctgcaggaattcgcacgagaccattacctagaacatcctaatcgaaaaaaagcaccacgcacgatcgccttcgccaaccgcgccgctctctctctctttctctctcgcacgagccgcgccggcgccgccaccacgcgcgcgggagacagagaccacagccgcagccaccgacgggcggaataggaatggtggcgccggggggaggagcaggaggaggtccgttgcggtggccggcggcggaggagcttgacactgtacggaagaaggtggtggagattagtggaagggatgaacaagaggttatggttgctgcttgcccctacagaatttgccctttgggggctcatattgatcatcagggtggagtagtcacagctatgaccataaattatggagtactccttggtttcgttccctctaatggttctgagcaacctttatttttctttcaggttttacttcattctggtcagtttgaaggtgctataagattcagagttgatgacttgcaaaagcctattgataaacctgagaacataaactggggaagttatgcaaaaggtgctgttagtgcactgcagaatagtggatatgatctaaggaagggatcataggatatatt

SEQ ID NO: 28473 - protein, 142 aa, Zea mays
  misc_feature: Ceres CLONE 1402649-F
  misc_feature: SWISSPROT Homolog: EC 2.7.1.6 Galactokinase
MVAPGGGAGGGPLRWPAAEELDTVRKKVVEISGRDEQEVMVAACPYRICPLGAHIDHQGGVVTAMTINYGVLLGFVPSNGSEQPLFFFQVLLHSGQFEGAIRFRVDDLQKPIDKPENINWGSYAKGAVSALQNSGYDLRKGS

SEQ ID NO: 28474 - DNA, 735 bp, Zea mays
  misc_feature: Ceres CLONE 1402653-F
  misc_feature: Encodes the peptide sequence at SEQ ID NO. 28475
  misc_feature (458)..(458): n is a, c, t, g, unknown, or other
  misc_feature (487)..(487): n is a, c, t, g, unknown, or other
  misc_feature (632)..(632): n is a, c, t, g, unknown, or other
  misc_feature (665)..(665): n is a, c, t, g, unknown, or other
  misc_feature (716)..(716): n is a, c, t, g, unknown, or other
  misc_feature (735)..(735): n is a, c, t, g, unknown, or other
aagctggagctccccgcggtggcggccgctctagaactagtggatcccccgggctgcaggaattcgcacgagaccattacctagaacatcctaatcgaaaaattcggatttccttccgccttccgacagcggctgtctcggcgacccaaccccagcctgaccccacctcccgccgccgccgccgccgccgccgcgccttcgtcgtcaggagaagggtcccggtggctgcgtctctctcccctgcccccctgctccacactcggttcacgcgtcggctcgctaccgcaggccctcgactcgtacgcccgtccccggcggcgatccggccggcaccgtaaccctaggactccgacggagcaggaatgatgagtcatgaacaacaaattgtccctcctagtaagggttctgtgaatgggttcccccatagaaaactggataaggagggcagtggaacgcanagtagaataaatttggtgaggtcatcctnctggtggttttactaattcagggcatggaagccattccagggaccgctaatctatgttctaacacaacttattgggcatcatgtggacgtgcatgtgaataacggctctataatctctggaattttccatggcacaaaccctgancaagacttttggcgtcgtcttaaaaatgctcangtcaataagggatggttctgccagaggacaagaatatccctgctgttcttngtaaagaacctgagactan

SEQ ID NO: 28475 - protein, 46 aa, Zea mays
  misc_feature: Ceres CLONE 1402653-F
  misc_feature (32)..(32): Xaa is any aa, unknown, or other
  misc_feature (42)..(42): Xaa is any aa, unknown, or other
MMSHEQQIVPPSKGSVNGFPHRKLDKEGSGTXSRINLVRSSXWWFY

SEQ ID NO: 28476 - DNA, 701 bp, Zea mays
  misc_feature: Ceres CLONE 1402656-F
  misc_feature: Encodes the peptide sequence at SEQ ID NO. 28477
aagctggagctccccgcggtggcggccgctctagaactagtggatcccccgggctgcaggaattcgcacgagaccattacctagaacatcctaatcgaaaaaggaccaagaaacatagagagagcggttctacgtccgagtcgtcccatcaggtcccctcgattcgccggcggcgccaccaaccaagctcatacatctgaattgactagtcgaactcagggatctctttggggactaatcagactcaagaactaagtttcatgtctgatctcgacgtccagcttccatctgcttttgatccgtttgcagaggcaaatgctgacgactccagtgctggtgctggatcgaaggactatgtgcacgtgcgtattcagcagcgcaacgtaaggaagagtctgacaactgttcaggtcttgaagaaagagtacagctacaacaagatcctcaaggatctcaaaaaagagttctgctgcaatggtactgtaatccaggatccagaggtaggccaggacattcaactgcaaggtgatcagcgtaaaaatgtcgctacttttctagtccaggccggaatcgcgaaaaaagatagcatcaagattcacggattttacactgcaaattttgagtgcttgtgtgtgcctatcaaatggtaccatatgataccaggtatagaagcttctcaagcttgatggccttcgtaacat

SEQ ID NO: 28477 - protein, 141 aa, Zea mays
  misc_feature: Ceres CLONE 1402656-F
  misc_feature (27)..(108): Pfam Name: SUI1 Pfam Description: Translation initiation factor SUI1
MSDLDVQLPSAFDPFAEANADDSSAGAGSKDYVHVRIQQRNVRKSLTTVQVLKKEYSYNKILKDLKKEFCCNGTVIQDPEVGQDIQLQGDQRKNVATFLVQAGIAKKDSIKIHGFYTANFECLCVPIKWYHMIPGIEASQA

SEQ ID NO: 28478 - DNA, 642 bp, Zea mays
  misc_feature: Ceres CLONE 1402657-F
  misc_feature: Encodes the peptide sequence at SEQ ID NO. 28479
  misc_feature (577)..(577): n is a, c, t, g, unknown, or other
  misc_feature (642)..(642): n is a, c, t, g, unknown, or other
tggagctccccgcggtggcggccgctctagaactagtggatcccccgggctgcaggaattcgcacgagaccattacctagaacatcctaatcgaaaaattacggctgaagggagtcgctcgccgccgcgttcgaggcgttccctcgtcgcgctcgcgccgtcgaccttcaccgctcgctgtcaggtctgcccgccacgacctcgccggccacactcgcagctcgccctcgctcctacgcctcgccggcgaggccttctgccttttcgcgccctctatctgctgcgatctttggagcatcgttctcttctctcacttgagatccagacccctaaaccctagagctcgccgcttccgctcgctcgctccgcgctggcggcgacaatggaggacgaggagatggagaagaaggtgcagcagtacttgcagcgcaagggtttccgcctcactgagcttgcgctccaggaggagtgcaaccgcctctccacctccgccatctccgacgttgcgcttgcacggtctgacaatgatccagcgagatactacgatggatatagcagattaagaacatgggcatancggtctcttggatcattatagcacgaattacttcgcgtcctttatccggttttcatccttagctn

SEQ ID NO: 28479 - protein, 71 aa, Zea mays
  misc_feature: Ceres CLONE 1402657-F
  misc_feature (65)..(65): Xaa is any aa, unknown, or other
MEDEEMEKKVQQYLQRKGFRLTELALQEECNRLSTSAISDVALARSDNDPARYYDGYSRLRTWAXRSLGSL

SEQ ID NO: 28480 - DNA, 646 bp, Zea mays
  misc_feature: Ceres CLONE 1402660-F
  misc_feature: Encodes the peptide sequence at SEQ ID NO. 28481
  misc_feature (351)..(351): n is a, c, t, g, unknown, or other
tggagctccccgcggtggcggccgctctagaactagtggatcccccgggctgcaggaattcgcacgagaccattacctagaacatcctaatcgaaaaaaattatttcttggcacctcagatcagcatattccatctccaatcccccgccgcgttcccccgcacgctttgacccataaagtcgatccatctccgagcaccaagttgaacacgcgatcccattcccattctcttgctcaatacaacctccggctccagcaagccgcagcgccaagcctagaagcggagcgcggaacacacgaggccaggaagaggaggtgctgccgtccccgcgccgccgctgtgggagtgcngggaatggggcggcacggcgtggaccagatcggcgctgtggcagcgttcgtctgggtcaccctccctcccttgcctgctgtgtgcgtcgtgtggccgggcgcccaggccggccatacaagcgagtaccgcggcaactcggctccggcatcgacatgcactcgacggcgatgtcttccgccctcccccgggctacaagcgcccgagcaagttcccatcccccagggaatcatgatggcccagccaggatatctcatgggggcaacaagggaccctggttccagaatggggattaag

SEQ ID NO: 28481 - protein, 97 aa, Zea mays
  misc_feature: Ceres CLONE 1402660-F
MGRHGVDQIGAVAAFVWVTLPPLPAVCVVWPGAQAGHTSEYRGNSAPASTCTRRRCLPPSPGLQAPEQVPIPQGIMMAQPGYLMGATRDPGSRMGIK

SEQ ID NO: 28482 - DNA, 729 bp, Zea mays
  misc_feature: Ceres CLONE 1402662-F
  misc_feature: Encodes the peptide sequence at SEQ ID NO. 28483
  misc_feature (273)..(273): n is a, c, t, g, unknown, or other
  misc_feature (397)..(397): n is a, c, t, g, unknown, or other
  misc_feature (413)..(413): n is a, c, t, g, unknown, or other
gctctagaactagtggatcccccgggctgcaggaattcgcacgagaccattacctagaacatcctaatcgaaaagcgccgctcgccgcaccccgatgtgggccgccgacccctctgcagctccggccgcggccgtggtcgctgacccagatggccctgatgccgtgcggctcacctggaacacctggccacggtcaaagatcgaggccagccgctgcgtcgtgccgctcgccgccaccatctcgcccggtcgcgtcccggacccctccgcggngtccccgccgccgcttccttaccctccgctccgctgcaagggtcccctgctcgcgctcctcaaccccttcgcgcgcgtcgacttcgccgccaagatctggatctgccccgtctgctttctccgnaaccacttccccccgnactactctggcatctctgagtacaacgttcctggcgagctcttcccgcagtgctcccacgtcgagtacatcgtcggcgggagccgcgtcccctggggtgggcagctccgccccctccgccggtatttctcttccgtattgacacctggggtatcgaggagaacctggggcacctcaaaatgggcatggcaaaaggccccccgcctcttggcggagacgcactctgggggccctcgcaccttcgggaacgaaggggaacctggcaagagttcgatttccccgattttagaaggaacaagcttttccgggggaaccaa

SEQ ID NO: 28483 - protein, 211 aa, Zea mays
  misc_feature: Ceres CLONE 1402662-F
  misc_feature (68)..(108): Pfam Name: zf-Sec23_Sec24 Pfam Description: Sec23/Sec24 zinc finger
  misc_feature (60)..(60): Xaa is any aa, unknown, or other
  misc_feature (107)..(107): Xaa is any aa, unknown, or other
MWAADPSAAPAAAVVADPDGPDAVRLTWNTWPRSKIEASRCVVPLAATISPGRVPDPSAXSPPPLPYPPLRCKGPLLALLNPFARVDFAAKIWICPVCFLRNHFPPXYSGISEYNVPGELFPQCSHVEYIVGGSRVPWGGQLRPLRRYFSSVLTPGVSRRTWGTSKWAWQKAPRLLAETHSGGPRTFGNEGEPGKSSISPILEGTSFSGGT

SEQ ID NO: 28484 - DNA, 688 bp, Zea mays
  misc_feature: Ceres CLONE 1402663-F
  misc_feature: Encodes the peptide sequence at SEQ ID NO. 28485
  misc_feature (429)..(429): n is a, c, t, g, unknown, or other
  misc_feature (456)..(456): n is a, c, t, g, unknown, or other
  misc_feature (466)..(466): n is a, c, t, g, unknown, or other
  misc_feature (492)..(492): n is a, c, t, g, unknown, or other
  misc_feature (665)..(665): n is a, c, t, g, unknown, or other
cgctctagaactagtggatcccccgggctgcaggaattcgcacgagaccattacctagaacatcctaaaaaaaatctctcgtctctatcgccgcatcgcttctctgccggagctccaacaacctcgcctcgcgcagcactccgctgaccctccctgactccctccctgccgctgggatggccgggaaacgagttacgggccgcgatgggcaagacgagggcggcgccaaggtcgggctcccggcgatggacctctccctcgcgttcccgcaggccacacctgcctccattttcccgccgtccgcttcggattattaccagtctgatgatttgctgaccagtgaagagcgctctatcaggatgaaggtcaggggtattatggaaaaagaaattgctcccattatgtcagcgtactgggaaaaggcagagnttccatttaatgccattcctaaacttngcagcctggntgttgctggtggggtacataaagggntatggggtgccaaggactttccatttacagcagtgctggtactatgtcagaaattgcacgggtagatgcaagctggtccacatttatactggtgcactccctctccttgcgatgtgacaatagttctttgcggaccggaggtcaaaaaggaaagaacttgccatccctgctcnacttatacgggggggctggtggg

SEQ ID NO: 28485 - protein, 126 aa, Zea mays
  misc_feature: Ceres CLONE 1402663-F
  misc_feature: SWISSPROT Homolog: EC 1.3.3.6 Acyl-CoA oxidase
  misc_feature (85)..(85): Xaa is any aa, unknown, or other
  misc_feature (94)..(94): Xaa is any aa, unknown, or other
  misc_feature (97)..(97): Xaa is any aa, unknown, or other
  misc_feature (106)..(106): Xaa is any aa, unknown, or other
MAGKRVTGRDGQDEGGAKVGLPAMDLSLAFPQATPASIFPPSASDYYQSDDLLTSEERSIRMKVRGIMEKEIAPIMSAYWEKAEXPFNAIPKLXSLXVAGGVHKGXWGAKDFPFTAVLVLCQKLHG

SEQ ID NO: 28486 - DNA, 688 bp, Zea mays
  misc_feature: Ceres CLONE 1402664-F
  misc_feature: Encodes the peptide sequence at SEQ ID NO. 28487
  misc_feature (419)..(419): n is a, c, t, g, unknown, or other
cagagctggagctccccgcggtggcggccgctctagaactagtggatcccccgggctgcaggaattcgcacgagaccattacctagaacatcctaatcgaaaaaaagccgtcccttcccaaccctcccttcgatccctggggcggcggccgggaccatgacgaccggatccaacggcgacggaggcggcgcggggtcctggtacccgcagcgccgcccgcactacggatacggcggggggtccgcctccttccgcggctgctgctgctgcctcttcctgctgctcaccttcctggcgctcctcgctctggacggcgcgctcgtcatcgtgctcgtgatgaagccccgcacaccgcagttcgacctcacccaggtgtccgtgcagcacctcctggtggccacgccgacaacgtccccggncggcgtgccacccggcgccgcctacctctcactcaacatcacgctggtcttcaccgccgagaaccccaacaaagtgggcatccggtacggcgccacggcgttcgacgtcatgtaccacggggtgccacctcggggtggatgggggtgcccgggctccagcagaccgcgcacagaacccgcctgctccagacccgggtcattgtcgaccgcttccacgtgcctccaaaccgacgcgcaggacctcatccgcggacgcggggataaacgag

SEQ ID NO: 28487 - protein, 177 aa, Zea mays
  misc_feature: Ceres CLONE 1402664-F
  misc_feature (88)..(88): Xaa is any aa, unknown, or other
MTTGSNGDGGGAGSWYPQRRPHYGYGGGSASFRGCCCCLFLLLTFLALLALDGALVIVLVMKPRTPQFDLTQVSVQHLLVATPTTSPXGVPPGAAYLSLNITLVFTAENPNKVGIRYGATAFDVMYHGVPPRGGWGCPGSSRPRTEPACSRPGSLSTASTCLQTDAQDLIRGRGDKR

SEQ ID NO: 28488 - DNA, 727 bp, Zea mays
  misc_feature: Ceres CLONE 1402668-F
  misc_feature: Translation starting site: 427
  misc_feature (676)..(676): n is a, c, t, g, unknown, or other
caaagctggagctccccgcggtggcggccgcttctagaactagtggatcccccgggctgcaggaattcgcacgagaccattacctagaacatcctaatcgaaaaaggatgacaaaatttcccactccactcgaattaaaaccctatggtcaaaattttccttctgtcgccgacgtcgcctgctcccgtcccgccaccacattccgcccaggagctcgccttcagtgaggctgctcgaggagccgcgctgtctctcccgcgccgtgaccttcgccctcgccgccgccttgatctgcgcgatctccggtgaggtgccgctactagccggtgatgtcgaagaagtcggcgctctctcttccagcggcggatcatctagcgctacattgaggaccatggcaagtgtcccatcaccaatgatgagcttactatggatgatatcgtgccgatcaataccaacaaggtcgtgaagcctcaggtctttgcatgctgcaagcattccaggactccttggtatttttcataacgagtgggatgctctcatgctttctaatatttgcttatggagcacgcagctacacgcagcaagactagaaacttagtcatgcactctaccagcatgacgctgcctagccgtgttattagccaggattgaagaccgcaagagaatgagtgctagnagcacttcttggatcatgctgagagacagattccagcatctagttgcagga

SEQ ID NO: 28489 - DNA, 665 bp, Zea mays
  misc_feature: Ceres CLONE 1402670-F
  misc_feature: Encodes the peptide sequence at SEQ ID NO. 28490
  misc_feature (527)..(527): n is a, c, t, g, unknown, or other
tggagctccccgcggtggcggccgctctagaactagtggatcccccgggctgcaggaattcgcacgagaccattacctagaacatcctaatcgaaaaaaaccctagaaacgggagccatggattcgggaggcggaggagggagcggcgcgcacaaggcggactcgggctccgcgccctcgccggcgcctaaacccacggtgatgctttcggcggtcatgagcaagcgcgccaagctccaggaggagctccgctccatcgagcgccaggttcatgatatggagaccacctacctacaggagactaatcaatttggaagtgcgctgaagggtttcgaatcttttttgtcatcctcaaaaaacacctctcaccttaagcgctcgcggaaatttcaggctgacgagaggttattctccctgtcatccgttacttctccagcggctgatgaacatttggctggacgagatgatggaagagagcatggagcacggcgttctaagggtggaaacacccctgcgaacgggcaagntacaccgaagaaggtggggcgccctgacgggcgagacgattagagactacggccgtcaaatgacccacacctggacgacgaatatgactactaactcctccatcatgtatgtctactgtagcgcgctaacttcaatgt

SEQ ID NO: 28490 - protein, 150 aa, Zea mays
  misc_feature: Ceres CLONE 1402670-F
  misc_feature (25)..(106): Pfam Name: NuA4 Pfam Description: Histone acetyltransferase subunit NuA4
  misc_feature (137)..(137): Xaa is any aa, unknown, or other
MDSGGGGGSGAHKADSGSAPSPAPKPTVMLSAVMSKRAKLQEELRSIERQVHDMETTYLQETNQFGSALKGFESFLSSSKNTSHLKRSRKFQADERLFSLSSVTSPAADEHLAGRDDGREHGARRSKGGNTPANGQXTPKKVGRPDGRDD

SEQ ID NO: 28491 - DNA, 724 bp, Zea mays
  misc_feature: Ceres CLONE 1402671-F
  misc_feature: Translation starting site: 130
  misc_feature: SWISSPROT Homolog: EC 3.2.1.21 Beta-glucosidase
  misc_feature: SWISSPROT Homolog: EC 3.2.1.85 6-phospho-beta-galactosidase
  misc_feature (409)..(409): n is a, c, t, g, unknown, or other
  misc_feature (427)..(427): n is a, c, t, g, unknown, or other
gctctagaactagtggatcccccgggctgcaggaattcgcacgagaccattacctagaacatcctaatcgaaaaaacttcacaagcagctcacagctctagttctagctagctagcagagggggggaaaatgtctcctgttctcgctgctggcatgaaccacgctgcattccatcgtggccttaggagccacctagtaggacccaacaatgagagtttctcacggcaccacctgccgtcttcttctccacagagcagcaagcgaaggtgtaaccttagctttactacacgatctgcaagagtaggcagccaaaatggactccaaatgttgagcccctcggaaatcccacaaagggactggttcccctctgacttcaccttcggtagcggcacttcagcgtaccaaattngaggtgcttggaatgaanatggaaaggggaaagcaactgggatcacttctgccacaatcatccggaaaggatactggacgggagcaattcagacatgggagcgaattcgtaccatatgtaccaaacggacgtcatatggcttcaggaaaatgggcatgaacgcatataggttctctatctcttggcccaaataactgccgaaggaacccaagaaagaggtattaacccggatgggatcaagtactacggaaaactcatcaccttgtgtgttgaaaacggcataaagcatatggaacaattttcccctgggagggc

SEQ ID NO: 28492 - DNA, 657 bp, Zea mays
  misc_feature: Ceres CLONE 1402673-F
  misc_feature: Encodes the peptide sequence at SEQ ID NO. 28493
aaaagtggagctccccgcggtggcggccgctctagaactagtggatcccccgggctgcaggaattcgcacgagaccattacctagaacatcctaatcgaaaaatacttttcctccttcagcttttatcacacggcaatggagtgtcgctagaaatggaatgataacttttccaatctttttgcattagaaaaaaaatcctaaagaaaaaggattactaaacaagcacgctcgccggcgctggtaccaggatctgggtctcacatcacaatcagatccaatccaaggccgcgccccagcccggcggatggattccgccgccgtggacatcatgacggtgccgttcccggcgcaggggcagctgaaccagctgctgcacctgtccctgctcctgacatcgagggggtttcctgtccacttcgccgcaccggagccgcaactccgggaggcccgcgcgcgcctgcacagctggaggcactaccccgcatgatgtgcttctgcgcgctggacgtggctgctcacgactccacctctcagtaccatcctccccgtgccggtacacatgcagcccctgttcaatgacctctgcaccggcgcacggtcctctctagcctcgactctagtcgaactgtgctgacacagcgacgagctgcagtctt

SEQ ID NO: 28493 - protein, 60 aa, Zea mays
  misc_feature: Ceres CLONE 1402673-F
  misc_feature: SWISSPROT Homolog: EC 2.4.1.215 Cis-zeatin O-beta-D-glucosyltransferase
MDSAAVDIMTVPFPAQGQLNQLLHLSLLLTSRGFPVHFAAPEPQLREARARLHSWRHYPA

SEQ ID NO: 28494 - DNA, 732 bp, Zea mays
  misc_feature: Ceres CLONE 1402674-F
  misc_feature (284)..(284): n is a, c, t, g, unknown, or other
  misc_feature (297)..(297): n is a, c, t, g, unknown, or other
  misc_feature (312)..(312): n is a, c, t, g, unknown, or other
  misc_feature (323)..(323): n is a, c, t, g, unknown, or other
  misc_feature (324)..(324): n is a, c, t, g, unknown, or other
  misc_feature (342)..(342): n is a, c, t, g, unknown, or other
  misc_feature (349)..(349): n is a, c, t, g, unknown, or other
  misc_feature (351)..(351): n is a, c, t, g, unknown, or other
  misc_feature (421)..(421): n is a, c, t, g, unknown, or other
aagctggagctccccgcggtggcggccgctctagaactagtggatcccccgggctgcaggaattcgcacgagaccattacctagaacatcctaatcgaaaaagcctttccctctcttctctgctctttgcatctctctcttgttcctcccttcctctctaaaaaaagggttctgatccctttctagaagctcctgggtttctgttgccgacccgagctccccaggggcgctcaggaggcgccgagccggcgaccgctccggcggatctgaggagccgccgcggncgctccgcctccngggcggccccgcccnggctccttgcnncctcttgcccgcgcggcnctctggngncgcgtttgttccctgcttctccgcctgcggcgggccgctcgcggttttgttcgcccggcccccccccccnttctcgctcgcgctccccgccgccgccgtcggtccttccgggcgcccgcgcgcgccctccccgcgtgggcggtcgtgtctgggcgggtcgttgtctgtttcgcctccgccctctcccctgcccccgctcttctcccccgcctgtcgcgcgttgccggtttgcttttcgcgccgctcggtttccgccgcgcctccgttcccgccccgccgccctgtgtgtctgttttggtggtgtgtccccggggtgtgtgccgctggtcgccgcgccgtgccgccaccgtgctttgccccgcccttttgcttccgccggcc

SEQ ID NO: 28495 - DNA, 715 bp, Zea mays
  misc_feature: Ceres CLONE 1402675-F
  misc_feature: Encodes the peptide sequence at SEQ ID NO. 28496
gctctagaactagtggatcccccgggctgcaggaattcgcacgagaccattacctagaacatcctaattgaaaaacatcgatcagtcgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaggcgcgagatctcggtcatggcgctcgtccgccaccccaacgtcgtgcagctgcacgaggtgatggccagcaagagcaagatatacttcggcatgggagtacgtccggggccggggagctctttcgccggggtcgcccggggcccggctcaaggaggacccccgcagaaaggacttccacccagttcgtgcggggccgttcgatttttggccaaggcgcgggggttctaccccgggacctcaaggcccgaaaacctccttcggggaag

SEQ ID NO: 28496 - protein, 146 aa, Zea mays
  misc_feature: Ceres CLONE 1402675-F
  misc_feature: SWISSPROT Homolog: EC 2.7.11.1 Non-specific serine/threonine protein kinase
MEKKPTILMNRYELGRTLGQGTFAKVYHGRNLASGESVAIKVIDKEKVMRVGMIDQIRREISVMALVRHPNVVQLHEVMASKSKIYFGMGVRPGPGSSFAGVARGPAQGGPPQKGLPPSSCGAVRFLAKARGFYPGTSRPENLLRG

SEQ ID NO: 28497 - DNA, 607 bp, Zea mays
  misc_feature: Ceres CLONE 1402677-F
  misc_feature: Encodes the peptide sequence at SEQ ID NO. 28498
  misc_feature (215)..(215): n is a, c, t, g, unknown, or other
  misc_feature (216)..(216): n is a, c, t, g, unknown, or other
  misc_feature (221)..(221): n is a, c, t, g, unknown, or other
  misc_feature (224)..(224): n is a, c, t, g, unknown, or other
  misc_feature (225)..(225): n is a, c, t, g, unknown, or other
  misc_feature (232)..(232): n is a, c, t, g, unknown, or other
  misc_feature (233)..(233): n is a, c, t, g, unknown, or other
  misc_feature (352)..(352): n is a, c, t, g, unknown, or other
  misc_feature (497)..(497): n is a, c, t, g, unknown, or other
aagctggagctccccgcggtggcggccgctctagaactagtggatcccccgggctgcaggaattcgcacgagaccattacctagaacatcctaatcgaaaaaggcctcgccactcttccgaacctgtagtcgcttacccactgccaactcagcgccaaactgtggagaattttttttttacctatttctatttatggtggtggtggtgtgcaatnncgcanggnnaacaaanntcaccaccgttattaagaagatgatgcgctgcgctgcaacgggcggcgggtgcgtcgcttcgtggagcggcgattggagattgccggcggtcaacccctgcagcgtgcggatgccgacngggcatacgatggggtgggtggcgcccggcctgaggtcgcgggcggcggatctcgccggcctcgagatggacaaccctgcgcggcgggcgtccgggggtctctttccgcgcgaggccgcgctacgggggctttgcaagcccccgnggggaggttgacccctgaaaaattccatttggaaaaaggtcaaggtaaatcctcagaactggtcctgccaaaggtggcgttgcttggttgggggctatttctgttgggtc

SEQ ID NO: 28498 - protein, 104 aa, Zea mays
  misc_feature: Ceres CLONE 1402677-F
  misc_feature (8)..(8): Xaa is any aa, unknown, or other
  misc_feature (10)..(10): Xaa is any aa, unknown, or other
  misc_feature (11)..(11): Xaa is any aa, unknown, or other
  misc_feature (13)..(13): Xaa is any aa, unknown, or other
  misc_feature (14)..(14): Xaa is any aa, unknown, or other
  misc_feature (102)..(102): Xaa is any aa, unknown, or other
MVVVVCNXAXXTXXTTVIKKMMRCAATGGGCVASWSGDWRLPAVNPCSVRMPTGHTMGWVAPGLRSRAADLAGLEMDNPARRASGGLFPREAALRGLCKPPXGG

SEQ ID NO: 28499 - DNA, 695 bp, Zea mays
  misc_feature: Ceres CLONE 1402678-F
  misc_feature: Encodes the peptide sequence at SEQ ID NO. 28500
aagctggagctccccgcggtggcggccgctctagaactagtggatcccccgggctgcaggaattcgcacgagaccattacctagaacatcctaatcgaaaaagaacttccagcatcctatcagataccgaaatctccaactcccgcatcgcatcgcatcgcatcgaaccttcggcctgcaagcgaattcgtcctcccctctcctaccggcgcgaattcaaccgcccgcaaagccctaggccgatgcgtccgatccggctacccgagccgccgggcgtcgacggcatggagacgcccgagatcttctctggcagcggcactggtggcgccgccgtcgttcgccgcgccgtcctcataggcaacggctcccccggcgcagaaaaccagtgtctcggcctcgcccgcgccctcggccttgtcgacaacctcacattctaccgtgtcacgaggccgagaggagggatcaatgagtggctgcactttctccccatttccatgcacaagtttatagaccaaatactcaggcagttcttccggaaacaaaggttcgcaatagtggttccggggaggaggccgcgtgggctgaatgatgcatacgttgcgttgactgacgctccggagctgacggaagaagattggtattgtatcgcccgcaacacatgcgacgcacgcgcccaccctccccctcctctccgc

SEQ ID NO: 28500 - protein, 151 aa, Zea mays
  misc_feature: Ceres CLONE 1402678-F
MRPIRLPEPPGVDGMETPEIFSGSGTGGAAVVRRAVLIGNGSPGAENQCLGLARALGLVDNLTFYRVTRPRGGINEWLHFLPISMHKFIDQILRQFFRKQRFAIVVPGRRPRGLNDAYVALTDAPELTEEDWYCIARNTCDARAHPPPPLR

SEQ ID NO: 28501 - DNA, 874 bp, Zea mays
  misc_feature: Ceres CLONE 1402679-F
  misc_feature (1)..(1): n is a, c, t, g, unknown, or other
  misc_feature (12)..(12): n is a, c, t, g, unknown, or other
nttttttttttnttttttttttttttttttttatattttttggccacgagcccaaagctggagctccacccgggtgggggcccgctctagaactagtggatcccccgggcctgcaggaattcgcacgagaccattacctagaacatcctaatcgaaaaaactcggcggctgccttctgcgcctccatttcgggctctgtcccttgcaagtccaatctcccctccccccaggggtaaggagaagcccacatcttcgttgtggttattggccatgtctactctggcaagtcgaccacccccggacacctcatctacgaggttgaagacaatgacaagtgtgacctcgccgaggctcctacagggcccccgcgtgaaatgtacaagtcggtcctttcagagacgccgtgagtcgctcgacgaggcctcacgcctcgcgccgtgcaaagcggcactcacccgcctgattacccgcccctgcgaacacccgccgccacgcccccggggttcccaccccccaggcgccactggaacggacccccggcgcccgccgcggaagtttgattactcggaaacctggggtctaccctgcccaccccttccccagggcggtggagtggggggaccggcgaccccaacagagacgggagcgccaatgcaacgggggcggcgatgtggggaaagccccgtatatccgtcccccgcgaacgcgcccccccccccctcgcgcaccccctgccccccccactgtggactccaccctcctggtagggggacgcgcagactgatagtttgcatgctcgcgcaccaacacaagccacccgcgaagacccacactcccaaacaaccccccctaagcgaaccagatatgggaggta

SEQ ID NO: 28502 - DNA, 723 bp, Zea mays
  misc_feature: Ceres CLONE 1402681-F
  misc_feature: Encodes the peptide sequence at SEQ ID NO. 28503
  misc_feature (320)..(320): n is a, c, t, g, unknown, or other
cagagctggagctcaccgcggtggcggccgctctagaactagtggatcccccgggctgcaggaattcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatggcggcggcgccagcgctcgcgcgggagctgctggacgcggcgcgggagccggagttcgcggagnggcagcgcggcgtgcggcgccggatccaccagcacccggagctggtcttccaggagtaccgcaccagcgcgctcgtgcgtgtcaagctcgacgcgatcggcggtccgtacgcctggcccgccgcgaagacggggggcgtggccaacttccccgcccccccccgaggccctccccgcgccgcccccccccccaacctgcggatgtccccccccccccgccaccggattacccgggagatcagattcaaggaatacgcggagagcccccccccccgcccccccggggtacccttatgggcgcgccgtttttctccccccccccccgcgcgcctccgcgatggtccccgcccccgcccgcttttgccttcggcctagtcctccgccggcccctatatcgtctcgga

SEQ ID NO: 28503 - protein, 146 aa, Zea mays
  misc_feature: Ceres CLONE 1402681-F
  misc_feature (23)..(23): Xaa is any aa, unknown, or other
MAAAPALARELLDAAREPEFAEXQRGVRRRIHQHPELVFQEYRTSALVRVKLDAIGGPYAWPAAKTGGVANFPAPPRGPPRAAPPPNLRMSPPPRHRITREIRFKEYAESPPPRPPGVPLWARRFSPPPPARLRDGPRPRPLLPSA

SEQ ID NO: 28504 - DNA, 644 bp, Zea mays
  misc_feature: Ceres CLONE 1402682-F
  misc_feature: Encodes the peptide sequence at SEQ ID NO. 28505
ggagctccccgcggtggcggccgctctagaactagtggatcccccgggctgcaggaattcgcacgagaccattacctagaacatcctaatcgaaaaactcgctttccggcgggcgactggcctaaaatcgcctcttgtttgtttgcttccgtcgtcccctctccacgtagagcacgcccccggaccaccttttataagcaccaaccatctggccttgccgcgccgattcgccacgaagccgcactgtgagagagggacgcggcctgttgtcccggcttttagacgcaacttccatcgctgcgaagctatccattcgtgttcgtcatggccgccagcgtcaccgtggaaaacctcaaccccaaggtcttaaaatgtgagtatgcagtccgtggggagattgtcatccatgctcagcgcctgcagcaacaactacaaacacaaccagggtctcttccttttgatgagatcctctattgcaacattgggaatccccaatctcttggtcagcaacctgtgacattcttcagggaggttcttgctctttgtgatcatccgtgcctcttggaaaaagaggaaaccaaatcattgttcagtgctgatgcaatttctcgagcaaagcagattcttgcaactattcctggaag

SEQ ID NO: 28505 - protein, 106 aa, Zea mays
  misc_feature: Ceres CLONE 1402682-F
  misc_feature: SWISSPROT Homolog: EC 2.6.1.2 Alanine transaminase
MAASVTVENLNPKVLKCEYAVRGEIVIHAQRLQQQLQTQPGSLPFDEILYCNIGNPQSLGQQPVTFFREVLALCDHPCLLEKEETKSLFSADAISRAKQILATIPG

SEQ ID NO: 28506 - DNA, 748 bp, Zea mays
  misc_feature: Ceres CLONE 1402683-F
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (24)..(24): n is a, c, t, g, unknown, or other
  misc_feature (31)..(31): n is a, c, t, g, unknown, or other
  misc_feature (34)..(34): n is a, c, t, g, unknown, or other
  misc_feature (748)..(748): n is a, c, t, g, unknown, or other
ttgttgggttttttttttnnnccngccgtgngtngggggcggttcccctcattcaaagctggagctccccgcggtggcggccgctctagaactagtggatcccccgggctgcaggaattcgcacgagaccattacctagaacatcctaatcaaaactctctctctctctgatcgatcgtccttcctccacccgtctgccccctcctccgcgcgcgcctgttcatggacaggaagaggacggcggcgcgccatcagcaccaggaaccaccgccaaaccctaaccctaacctccgccgccgggccgcggccagcgacccggcctcggacgagccgccgccgtcgtcgaagcgcatgctggactttcacttcctccgcgcgctggccaggatccacagcaccaccccggcgccgcgccgcccgcgcaccatccgccgcgcggcctactcgtccatggcgcgcgctgccagcccacgccgggcctggacgcaagcgctgctccgccaggctcgcgcccgcagggcggttgccaggtcctccaggggagccgtcctgctgcggagacgcgtcgccctcgccgcgggcgcctccctcctccgccagctgctccgcgcccagcgtccgggagaagtcgaacggtcggagcacgaacgcccgcttggagggcatcccgggcggcccgagggacggccccccggggacccccgacatccccgaagggccaaggaccggaggggaaacccgcggcccn

SEQ ID NO: 28507 - DNA, 759 bp, Zea mays
  misc_feature: Ceres CLONE 1402685-F
  misc_feature: Encodes the peptide sequence at SEQ ID NO. 28508
  misc_feature (684)..(684): n is a, c, t, g, unknown, or other
  misc_feature (691)..(691): n is a, c, t, g, unknown, or other
  misc_feature (693)..(693): n is a, c, t, g, unknown, or other
  misc_feature (714)..(714): n is a, c, t, g, unknown, or other
  misc_feature (719)..(719): n is a, c, t, g, unknown, or other
aaagctggagctccccgcggtggcggccgctctagaactagtggatcccccgggctgcaggaattcgcacgagaccattacctagaacatcctaatcgaaaaatcccacgctgccctcggcgctgcgcctggccccggcacctacctcccccctccccacctcgccgccggcgggtggagtcgggctggagcagccgctctcctctgttaccccctaaccccctataaagaaaaagaaaaaaacagagagagagcgagcgaccggcggctcggcagccatggggcacggcgtcagctgcgcccgcaccggtgacgagcacgactacttccgcgcggcgcaggtcggggacctcgaggccctggaagcgctcctcgacgctgacccctcccttgcccgccgcgccacgctctacgaccgcctctccgcgctccacatcgccgccgcgaatggccgcctcgaggtgctgtcaatggtcttggatcacggggtgccgccggacgtggtgaagctcctgcaggccggcgccaatatcctcatgttcgactcccagcacgggcggacctgcctgcaccacgcgtcctacttcggccacgtcggctgcctgcaggccatcctcacggcggcgcggaccacgccggtgccaactcatcgggtttcgctcgggtcgtcaacgtgagagacgnacacggngncacgccgctccacctcggcgncaggnagggccgccccggctgcgtgcagcgctggctggagaacgt

SEQ ID NO: 28508 - protein, 132 aa, Zea mays
  misc_feature: Ceres CLONE 1402685-F
  misc_feature (46)..(78): Pfam Name: Ank Pfam Description: Ankyrin repeat
MGHGVSCARTGDEHDYFRAAQVGDLEALEALLDADPSLARRATLYDRLSALHIAAANGRLEVLSMVLDHGVPPDVVKLLQAGANILMFDSQHGRTCLHHASYFGHVGCLQAILTAARTTPVPTHRVSLGSST

SEQ ID NO: 28509 - DNA, 636 bp, Zea mays
  misc_feature: Ceres CLONE 1402686-F
  misc_feature: Encodes the peptide sequence at SEQ ID NO. 28510
  misc_feature (46)..(46): n is a, c, t, g, unknown, or other
  misc_feature (55)..(55): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (318)..(318): n is a, c, t, g, unknown, or other
  misc_feature (360)..(360): n is a, c, t, g, unknown, or other
ggagctccccgcggtggcggccgctctagaactagtggatcccccngggctgcanggaattcnnngcacgagaccattacctagaacatcctaatcgaaaaaaacacgcaaaacgtgcttctgtccctctcctgttataatttcgtcttcttccctctcccaccggtgtcctcgcctcgcctatccgatctgccacctcgccgtctcgcacgttcctttccccaactccccagcgcctctccgcgccgcgatccagatcccagtttgtcagcatgggtctggtgaaggaaggcgtcgacatggtagagggaaccctanagatcggcatggagtacaggactgtatcttgtgtggccgggncctctggttatcctggaaaaaggaaaggggcccaagtacccagaaaatgggaaactccgaatttgaaaaatggaccactcggccggggccaaggcccttgaaatggatggaaaaaaaacttgttttggacggttttttaaaggaatttttgggaaaaaaaaaacaaaaacccaaaccggggaggttaaaagggggagggtttttaaaaacccccgggcccaccccaatagggtgtggggggatttttttaagggtgtctggaaaaccatatagaaa

SEQ ID NO: 28510 - protein, 62 aa, Zea mays
  misc_feature: Ceres CLONE 1402686-F
  misc_feature: SWISSPROT Homolog: EC 3.6.3.14 H(+)-transporting two-sector ATPase
  misc_feature (16)..(16): Xaa is any aa, unknown, or other
  misc_feature (30)..(30): Xaa is any aa, unknown, or other
MGLVKEGVDMVEGTLXIGMEYRTVSCVAGXSGYPGKRKGAQVPRKWETPNLKNGPLGRGQGP

SEQ ID NO: 28511 - DNA, 657 bp, Zea mays
  misc_feature: Ceres CLONE 1402694-F
  misc_feature: Encodes the peptide sequence at SEQ ID NO. 28512
  misc_feature (320)..(320): n is a, c, t, g, unknown, or other
ggagctccccgcggtggcggccgctctagaactagtggatcccccgggctgcaggaattcgcacgagaccattacctagaacatcctaatcgaaaaatcgatctgtacgccctccccaccggtgggtcgcgcacctccaccaacctaccttcccgccccgcccgtcgccgtcgatgactcgccgtccgtttccgccctccaaaaccctactacctcttaccttccagccccgcgtcctccatggccaccaacggcagctctccgagggttcgggacacggagagcagtctggagaaggtgaagcggcagctgtcatcggngtctgggaggtacctgctgcaagggcccctgctcaagcgatctgagacgttacggaaatggaatgagcgttgggtcatattggacccgacatcaggaaagatggaatacaaactccggagaaatgaaactgccattaaggggaccattctgtttgacgcctcgagcaccattactttatctcctggtgactttcaagggatgccaaaaaataatggttggtgcttctacttcggaactcctcaaaagaaggatactttctttgggctgaaactcctggtgctgcgaaagcttggggatctaacttacttgcaactcagttagccttacgagctcata

SEQ ID NO: 28512 - protein, 133 aa, Zea mays
  misc_feature: Ceres CLONE 1402694-F
  misc_feature: SWISSPROT Homolog: EC 3.6.5.5 Dynamin GTPase
  misc_feature (27)..(27): Xaa is any aa, unknown, or other
MATNGSSPRVRDTESSLEKVKRQLSSXSGRYLLQGPLLKRSETLRKWNERWVILDPTSGKMEYKLRRNETAIKGTILFDASSTITLSPGDFQGMPKNNGWCFYFGTPQKKDTFFGLKLLVLRKLGDLTYLQLS

SEQ ID NO: 28513 - DNA, 675 bp, Zea mays
  misc_feature: Ceres CLONE 1402695-F
  misc_feature: Encodes the peptide sequence at SEQ ID NO. 28514
  misc_feature (323)..(323): n is a, c, t, g, unknown, or other
  misc_feature (445)..(445): n is a, c, t, g, unknown, or other
  misc_feature (446)..(446): n is a, c, t, g, unknown, or other
  misc_feature (473)..(473): n is a, c, t, g, unknown, or other
  misc_feature (590)..(590): n is a, c, t, g, unknown, or other
  misc_feature (673)..(673): n is a, c, t, g, unknown, or other
gctggagctccccgcggtggcggccgctctagaactagtggatcccccgggctgcaggaattcgcacgagaccattacctagaacatcctaatcgaaaagagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgnggccggcgggttccccagcagtgtggcactgacgaacacgcttcagcgccgtcgtcgttctcgccgctatcttgtcgtcgcctcggcgacgagagccgaacaggaggtcgcccctgtgacgnnatcgaggacgtggacctcagctctcantcaggccgcggccgacgacggggagcttcgccgcgcggtgggcgggaggtccacggcacacaaacttggggagggtctgctggacccccatcgacggcgtgctcctccaggagctcnatccgctacggcgagttcgcccaggccacctacgacagcttcgactacgaccgcttctccccctactgcggcagctgcaagancc

SEQ ID NO: 28514 - protein, 134 aa, Zea mays
  misc_feature: Ceres CLONE 1402695-F
  misc_feature (59)..(59): Xaa is any aa, unknown, or other
  misc_feature (68)..(68): Xaa is any aa, unknown, or other
MAATVSSCLSLVPTVHHRGRRVPQQCGTDEHASAPSSFSPLSCRRLGDESRTGGRPCDXIEDVDLSSXSGRGRRRGASPRGGREVHGTQTWGGSAGPPSTACSSRSSIRYGEFAQATYDSFDYDRFSPYCGSCK

SEQ ID NO: 28515 - DNA, 820 bp, Zea mays
  misc_feature: Ceres CLONE 1402696-F
aaagctggagctccccgcggtggcggccgctactgaactagtggatcccccgggctgcaggaattcgcacgagaccattacctagaacatcctaatcgaaaaaacacctcgccaattgcgacgccgccgccgtcactgtcgccgcaggagtgcgaaccacgctgccgcccgctcccgccgctcaaatagctttatccgagcccccattccccggatcacatgctgcggtcatctctcaaatgacctctcaactccagagcactttgctcctgctcccgctcttcgccgccgctgccccggctacgtatttttcacgcctccacttccttggcagttcgtttcctcattctccattaactactgttttttcccccaaataccctgcactcatccttttcccttctcccccgtctccccttattcatattctcccttaccccccactatccccataatatgcgtaatccttttcccaccagccacttggcgaactggcctcccggcaatcatccttcccttcctatcaccccgtcccggatcatcttcctgctccaattctcgtctccgacaccactcccgccagaaatatacaactctcacacaaactctccgagcggaacccctaacaattcttataccctcccccccacatatactatcacccaacccaaacagccaacgcccacacatatgcccattggcccgttcacgcccggtcgtcacccgatttcgcgctatattatcacatcgatagcatcgacgccccaccttcccatccctctccacccctactattcctccaccccgccctacacaaccc

SEQ ID NO: 28516 - DNA, 730 bp, Zea mays
  misc_feature: Ceres CLONE 1402698-F
  misc_feature: Encodes the peptide sequence at SEQ ID NO. 28517
  misc_feature (13)..(13): n is a, c, t, g, unknown, or other
  misc_feature (199)..(199): n is a, c, t, g, unknown, or other
  misc_feature (300)..(300): n is a, c, t, g, unknown, or other
  misc_feature (319)..(319): n is a, c, t, g, unknown, or other
  misc_feature (333)..(333): n is a, c, t, g, unknown, or other
  misc_feature (351)..(351): n is a, c, t, g, unknown, or other
  misc_feature (355)..(355): n is a, c, t, g, unknown, or other
  misc_feature (356)..(356): n is a, c, t, g, unknown, or other
  misc_feature (361)..(361): n is a, c, t, g, unknown, or other
  misc_feature (364)..(364): n is a, c, t, g, unknown, or other
  misc_feature (446)..(446): n is a, c, t, g, unknown, or other
  misc_feature (460)..(460): n is a, c, t, g, unknown, or other
  misc_feature (466)..(466): n is a, c, t, g, unknown, or other
  misc_feature (469)..(469): n is a, c, t, g, unknown, or other
cgctctagaactnagtggatcccccgggctgcaggaattcgcacgagaccattacctagaacatcctaatcgaaaaataacacaacaatctctctcccctcactccctctctgcagcgcgcagctttcaaagcgttgggagagatggcagaggagacgcaaccagaggccgccgcagccgccgccgcgcccgccgcggncgaggtagtcgtgaccgaagctgcgccggcggaggcggaggtgcctgcggcggcggaagctgaagccccgagccaggatgagaagaaaggtgacgaggcgnagctcaccgccgatgacgncggggtggggaccngctcgtttcaggagaaangcanncctgntgnagacctgccccgaccggaagaagaaggcgctcgacgagtttcagcagctgatcgctgccgccctcgccgcaggtgagttaancttgcctcccccgncgccgncgncgaaggccaaggaaacaaaggtggaggaagccaaggccgaggaagcccgccaaaaaaaacccagggccggggggggaggcttacgggggaaggactttaaggcccaggtgtcttgcgattgccccggtttagaaaagctaaaaaaagaaggtccccccccccccaggaggcccaaggtttaaacacttggttgtgaaaaaaaaaattttttttaaacccaacgcgggagaaaaaaaaccctttggggtcccttgggggagg

SEQ ID NO: 28517 - protein, 98 aa, Zea mays
  misc_feature: Ceres CLONE 1402698-F
  misc_feature (19)..(19): Xaa is any aa, unknown, or other
  misc_feature (53)..(53): Xaa is any aa, unknown, or other
  misc_feature (59)..(59): Xaa is any aa, unknown, or other
  misc_feature (64)..(64): Xaa is any aa, unknown, or other
  misc_feature (70)..(70): Xaa is any aa, unknown, or other
  misc_feature (71)..(71): Xaa is any aa, unknown, or other
  misc_feature (73)..(73): Xaa is any aa, unknown, or other
  misc_feature (74)..(74): Xaa is any aa, unknown, or other
MAEETQPEAAAAAAAPAAXEVVVTEAAPAEAEVPAAAEAEAPSQDEKKGDEAXLTADDXGVGTXSFQEKXXPXXDLPRPEEEGARRVSAADRCRPRRR

SEQ ID NO: 28518 - DNA, 618 bp, Zea mays
  misc_feature: Ceres CLONE 1402699-F
  misc_feature: Encodes the peptide sequence at SEQ ID NO. 28519
  misc_feature (412)..(412): n is a, c, t, g, unknown, or other
  misc_feature (413)..(413): n is a, c, t, g, unknown, or other
  misc_feature (419)..(419): n is a, c, t, g, unknown, or other
  misc_feature (422)..(422): n is a, c, t, g, unknown, or other
  misc_feature (426)..(426): n is a, c, t, g, unknown, or other
  misc_feature (428)..(428): n is a, c, t, g, unknown, or other
  misc_feature (431)..(431): n is a, c, t, g, unknown, or other
  misc_feature (433)..(433): n is a, c, t, g, unknown, or other
  misc_feature (434)..(434): n is a, c, t, g, unknown, or other
aaagctggagctccccgcggtggcggccgctctagaactagtggatcccccgggctgcaggaattcgcacgagaccattacctagaacatcctaatcgaaaagacccacccatccaaccacttccacgaatggccctcgctctgtgaactcgtcgggttccatggcggcgccgtcgcctaaacccccgacaccacgcgggcgctgccaccacccgcccaacgccacccgccgcctccacgtggccacccgctgcttccccgacccaccaccaccacctgcctccatgccgccgatcccgagtccgaaccctgtgctgtcccttctctccgcggtgcccgactgggccgacgccatccaggagcgccgcgtccgcgaccgccgcccgctctacgaccacgccacctgggcggnnacacgnagntccngncgncnnactggggcactccctcactcgttggtctcccgcggcatcctctccctgggggcccccggtgtcggcccttaacgggcttcgccggccgccattgccccctaaaaaaggtttctatcggggcataggggtttacgggaatccccggtcccctaaaaaaataatggggcccggggttgggttcctc

SEQ ID NO: 28519 - protein, 73 aa, Zea mays
  misc_feature: Ceres CLONE 1402699-F
  misc_feature (43)..(43): Xaa is any aa, unknown, or other
  misc_feature (46)..(46): Xaa is any aa, unknown, or other
  misc_feature (48)..(48): Xaa is any aa, unknown, or other
  misc_feature (50)..(50): Xaa is any aa, unknown, or other
MPPIPSPNPVLSLLSAVPDWADAIQERRVRDRRPLYDHATWAXTRXSXRXTGALPHSLVSRGILSLGAPGVGP

SEQ ID NO: 28520 - DNA, 720 bp, Zea mays
  misc_feature: Ceres CLONE 1402702-F
  misc_feature: Encodes the peptide sequence at SEQ ID NO. 28521
  misc_feature (351)..(351): n is a, c, t, g, unknown, or other
  misc_feature (358)..(358): n is a, c, t, g, unknown, or other
  misc_feature (494)..(494): n is a, c, t, g, unknown, or other
  misc_feature (536)..(536): n is a, c, t, g, unknown, or other
  misc_feature (679)..(679): n is a, c, t, g, unknown, or other
cgctctagaactagtggatcccccgggctgcaggaattcgcacgagaccattacctagaacatcctaatcgaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcantgttccngcgggccgtggctcgcccgcgcggacttcctgctgacgtgcgacccggcggccgtccagcactggctggcgtcaaccacgggggctacgacagggggcgagactttgcggagatgttcgacctcctgggcgacggnctgctggttgcggacgcccgggttcgtggccgccgcaggggnacgtcgccgccaccggtcttcgggacccggggggttccgggcctttcggcctggggaacatgggggcgccaaaagggggggggtgggtctgtgccgttcctgggcgggcgcccccggggatcaaagaaaggtgaaggggaganccggtgttcccagagacgtgtgtaggggggaactcgcgtga

SEQ ID NO: 28521 - protein, 87 aa, Zea mays
  misc_feature: Ceres CLONE 1402702-F
  misc_feature (74)..(74): Xaa is any aa, unknown, or other
MGALRSLAISYPEFLVAGLCFVSLSALRHAMRERRQRAPLSWPVVGMLPFVLANLGRLYDAITDALHGSGCTLXVPAGRGSPARTSC

SEQ ID NO: 28522 - DNA, 678 bp, Zea mays
  misc_feature: Ceres CLONE 1402709-F
  misc_feature: Encodes the peptide sequence at SEQ ID NO. 28523
ggagctccccgcggtggcggccgctctagaactagtggatcccccgggctgcaggaattcgcacgagaccattacctagaacatcctaatcgaaaaaatgtcgcgtgcggccactagatttttcctgacgcggtgtctgctcccacttcccctcctctcccccaggtggcggtagcggcggcgcggtagcatttgtgctacgagggcttttgcaatggcggcttcggggttcggcggcggcgaggcgttccggctctcggccgcgccggtggccggcttactgaacctgcacaagggcgacatcaccctctggtccgtcgactgcggcaccgacgccatcgttaatgctgctaatgaccgaatgttaggtggcggaggtgttgatggagctatacatcaagctgctggaccagagctagtgctagcatgccggaaagttccagaggtcaaaccaggagtccgctgtcctactggagaagctaggattactcctgcttgtgagcttcctgcctctcggatgactcacactgttggacctatatatgatttggacgagaatcctgaggtgtgattaaagaggtctatgtaaatagcttgcagcttgctaaggatcatggaattcagaacatccccattccctgcgatatcttggaggtggtcatcgatatcctcccaaag

SEQ ID NO: 28523 - protein, 118 aa, Zea mays
  misc_feature: Ceres CLONE 1402709-F
  misc_feature: SWISSPROT Homolog: EC 2.4.2.30 NAD(+) ADP-ribosyltransferase
MAASGFGGGEAFRLSAAPVAGLLNLHKGDITLWSVDCGTDAIVNAANDRMLGGGGVDGAIHQAAGPELVLACRKVPEVKPGVRCPTGEARITPACELPASRMTHTVGPIYDLDENPEV

SEQ ID NO: 28524 - DNA, 754 bp, Zea mays
  misc_feature: Ceres CLONE 1402713-F
  misc_feature: Encodes the peptide sequence at SEQ ID NO. 28525
  misc_feature (261)..(261): n is a, c, t, g, unknown, or other
gctggagctccccgcggtggcggccgctctacaactagtggatcccccgggctgcaggaattcgcacgagaccattacctagaacatcctaatcgaaaacagttcgccaccatcgtgctccgtacacgctccgctccggccatggccgccgccgcggcctccttttcggccctgccgttccttctacttttgctgctggtgccgtcgctcgacggcgcctccaatgtgacgtacgaccaccgctccctcatcatctccggncgccgccgcctcgtcatctccacctccatccactacccccgcagcgtccccgagatgtggcccaagctggtggctgaagccaagggaggcgggctccgactgcatcgagacctacgccttttggaagggccttccaatctcccccatcccccccctcccttttagggaacggtttttacctgcccggtctccttttagtgcttatttataacccggcgctgcgctctaggcctgggatttcacctacccttcgtgaccgcggaagtcgcccacagctaatcggcccccgactcgaccccgtataaacatcctcgtctccctccgcgtacccactaaatttaaagcctcgcccccgtatctccgggccattcgggtggtccatcttacccatggccctccacccttcccccgcatcttgcccaatatatcatctactttagaccccccctcctccgacgccccacgttccgcttctccccccccccccccaccc

SEQ ID NO: 28525 - protein, 94 aa, Zea mays
  misc_feature: Ceres CLONE 1402713-F
  misc_feature: SWISSPROT Homolog: EC 3.2.1.23 Beta-galactosidase
MAAAAASFSALPFLLLLLLVPSLDGASNVTYDHRSLIISGRRRLVISTSIHYPRSVPEMWPKLVAEAKGGGLRLHRDLRLLEGPSNLPHPPPPF

SEQ ID NO: 28526 - DNA, 713 bp, Zea mays
  misc_feature: Ceres CLONE 1402715-F
  misc_feature (683)..(683): n is a, c, t, g, unknown, or other
tggagctccccgcggtggcggccgctctagaactagtggatcccccgggctgcaggaattcgcacgagaccattacctagaacatcctaatcaaaaaccggagacgtagcggaccagcagccggacggccgtataaaacataccaaggccgcctcgctcgctcagcatacggaggcagccgccggtaagccgcgcgcgcgtgcagtcacccatccgtccgtccgtccgtccgtcgtccgccgtccaccgccagcgcgcgctcgccaccgcacccagctagcagcacaagaaaagtctggtggcgtcggcggcggcggcggcggccggcttgccacagtccaatccttggaccggccaaaaagcagttgaaggcgcgagcgagcaagctagcgcgcccttcgtcgctacgagcctacgacgcgcgatcgagccgggcattgctgacctcgagttaagttgggcgagggagaggtggttcattccagcagggatccttctcgtgagcccagtcgatctgaccgtccttgtattgggggggggggttgttctgaactctctctttaatttgtgagtcgtgacaggttcttgaagtgcaattgttaagagttttagttgtagaggaagagaaagatttgctaatatggcgttggcagggacctcaaagtagtgctgggatgtatcgnctttgggattttctgggtgatgggcgtctc

SEQ ID NO: 28527 - DNA, 677 bp, Zea mays
  misc_feature: Ceres CLONE 1402717-F
  misc_feature: Encodes the peptide sequence at SEQ ID NO. 28528
aaagctggagctccccgcggtggcggccgctctagaactagtggatcccccgggctgcaggaattcgcacgagaccattacctagaacatcctaatcgaaaaacggaaaatcccttcaaaacccctccggtccctcacccccatccgccgccgctttcctcccacggtcccaccacgcgcgcggccggcgggcggccaacggcggggagcagcaccgcgcgatcgtcaccgacgcttccacctacctgtgtcagaacaaggtagcaaaatgaacaaccacctaagcttcgaggagggctggaaagtcctggaacaggggattgtaaaatgctcgaagattttggagtgcaccagtacaaggcctaccgtgaacgaatacatgaactactatgattgtgcttacaggatggctgtgcagaaacacattactgtccagaatgtacaaggttttcagatgatgcttgcaaaatgggtcgcacaatgggtctgccccatctcatgaccaacaaaatgacgctttttcagagagcctggggaaagggggccaaactattgcctcaggattaaaggggaattggcctcctcaccaattgggacccctgctatgggaaaaaaaacaaataccatcgcttaaaaaaagggagggaacccctttttttgaaccagaccttttccaa

SEQ ID NO: 28528 - protein, 77 aa, Zea mays
  misc_feature: Ceres CLONE 1402717-F
MNNHLSFEEGWKVLEQGIVKCSKILECTSTRPTVNEYMNYYDCAYRMAVQKHITVQNVQGFQMMLAKWVAQWVCPIS

SEQ ID NO: 28529 - DNA, 658 bp, Zea mays
  misc_feature: Ceres CLONE 1402721-F
  misc_feature: Encodes the peptide sequence at SEQ ID NO. 28530
  misc_feature (181)..(181): n is a, c, t, g, unknown, or other
  misc_feature (408)..(408): n is a, c, t, g, unknown, or other
  misc_feature (423)..(423): n is a, c, t, g, unknown, or other
  misc_feature (448)..(448): n is a, c, t, g, unknown, or other
  misc_feature (515)..(515): n is a, c, t, g, unknown, or other
aagctggagctccccgcggtggcggccgctctagaactagtggatcccccgggctgcaggaattcgcacgagaccattacctagaacatcctaatcgaaaaatgccccataaactgagtctgcactgagctactcctggctaccgcaccacgcttcacccggcgtgcactccatctctctngggacgactacggccgccgccgccgccgcccccacctacgccaggtgccgaggccttcgttggcctcttcgccggtgacgagaacctaccagacttggagcaagcctctcaacatgtcgtgggccgcaatcgagaatgatcctggtgtttttacggaactgttgcagcagatgcaactgaagggtcttcaagttgatgaactctactcacttgacctggatgctctncatgatcttcagccnatatatgggctaatattgctatacnaatggcgacctccagaaaaggatgagggtcctgtcatcaaggatgcaatcccaacctttttctttgncaccagataattaacaaagcctgggcacccagtaattcgttcgggtcctctggaactctctgggattacccttagggaggagttaaaaagctcagggattttcaaggatttgcacctgactccagggatgggttaagaaactg

SEQ ID NO: 28530 - protein, 76 aa, Zea mays
  misc_feature: Ceres CLONE 1402721-F
  misc_feature: SWISSPROT Homolog: EC 3.1.2.15 Ubiquitin thiolesterase
  misc_feature (52)..(52): Xaa is any aa, unknown, or other
  misc_feature (74)..(74): Xaa is any aa, unknown, or other
MSWAAIENDPGVFTELLQQMQLKGLQVDELYSLDLDALHDLQPIYGLILLYXWRPPEKDEGPVIKDAIPTFFFXTR

SEQ ID NO: 28531 - DNA, 669 bp, Zea mays
  misc_feature: Ceres CLONE 1402722-R
cgaattgggtaccgggccccccctcgaggtcgacggtatcgataagcttttttttttttttttttgaaaaaaacgagacaataattaacaaaagaggttatgcttgcgcatccccagtcagtttcgcaacagctttgtccatgcaaagacagtgctataactacagcaccgggaccagtgcacatgactcgaatgggtttgaatgtccagaggtgagtaggttccatccatacatatgttttaaataaggtaggtttgttcccgtttcagtgggggagcaaatgagcatcccgaacaggcaagaactttttcctgcctgaatgcaatacacgttgaagcaagctccggtatgtaaagctcagaggtggggcaaaagacctgtacagcttcggatcctcgaatgttgttggttgcaaacgcctactccagtcaagaatggggaacgaagacaccgaggatggcctaggacgcctctctctcagcgctcctttcaccagagggtatttgctgggaatcagagtgggcaatcctcctagaccttccggagccactgtcaggcgatgcttctggatgcaacggtacatgcgcccacatgcgccaaggagttggggcatcgctagctgggaagggagccgggccgtacatggaatttcccattggggggaacaa

SEQ ID NO: 28532 - DNA, 663 bp, Zea mays
  misc_feature: Ceres CLONE 1402722-F
  misc_feature: Encodes the peptide sequence at SEQ ID NO. 28533
ggagctccccgcggtggcggccgctctagaactagtggatcccccgggctgcaggaattcgcacgagaccattacctagaacatcctaatcgaaaaaaaacgactggctggccgaacgcggacgtctggttcctctcattgcccttccacctcgttctctctctctctcctcccactgctcgacctctctctcttacgcgagcgtgacaacctccctccctccactgcgcgcggcgcgggagcagcagcgtcagcacccaccgactgatcgccgttgtccgccgcgggatcgatctgatgcggccgcggaggtgatggcagcgccatccggcgtcggaggcggcggagcgccggagggctcctcctcggccgccgcagctgcgacgataggggaccacggggcggaccaagttgcagaggcgatgtgtcacatgaatttgagaagaagccatggaactgaggccatacccagagcgtgctggtgagccacactgtagctattacatgatgactggcatgtgcaggtatgggatgacctgtagatttaatcactcagcagacaaaaagctgactgttgctgctgcaagaatgaagggagaatatcctcaaagaattgagcagactgaatgtcagtactatctgaagactgggacgtgcaagttt

SEQ ID NO: 28533 - protein, 71 aa, Zea mays
  misc_feature: Ceres CLONE 1402722-F
  misc_feature (10)..(36): Pfam Name: zf-CCCH Pfam Description: Zinc finger C-x8-C-x5-C-x3-H type (and similar)
MELRPYPERAGEPHCSYYMMTGMCRYGMTCRFNHSADKKLTVAAARMKGEYPQRIEQTECQYYLKTGTCKF

SEQ ID NO: 28534 - DNA, 799 bp, Zea mays
  misc_feature: Ceres CLONE 1402727-F
  misc_feature (703)..(703): n is a, c, t, g, unknown, or other
  misc_feature (782)..(782): n is a, c, t, g, unknown, or other
caagctggagctcaccgcggtggcggccgcactacactagtggatcccccgggctgcaggttatcgcacgagaccattacctaaaacatcctaatcgaaaagttcctcatacatattttggttccaaatcgaataacccaatgccgccgtagccgtctgcctcctcgctttcctttcgtccgtacgccgccgcctcgcaccgccgaccgccctcacgcgagaagtccagatttaacctccctcttccccgatcgccccctaggtcaccgcaacgcccgcgctccctccccgtcacccccgccggcgggttctcacgtcccctttttccccctgccgcgcgtttccccccgcgacgcgcccgctgtttttttttttcctagccgggccccccccccccccccctttaacgcgggcccccttaaggcaggctcccccctcccacccagggcccctaataagccctgccctctcccccccgggccctcgccgaccacccccccctatcccccgaagctgtgatagtcgccgctctccgcgtccgcggctacctgccgccgccccgccccccccgcgatagtattccaccccggaaacgccccacccgccccgcccaacatctcggggggccccgcgatacgtattttcacccgccacattaacgcagtgagtatttgttcgcgttctcgcccgtaccgcgcccccncgccccacacatggggtaaatatagatcatgggtgtcgaccttgccgtctcccaaccgcaagatccctcccgtgtctcnccccgccctctcctcgc

SEQ ID NO: 28535 - DNA, 636 bp, Zea mays
  misc_feature: Ceres CLONE 1402730-F
  misc_feature: Encodes the peptide sequence at SEQ ID NO. 28536
  misc_feature (440)..(440): n is a, c, t, g, unknown, or other
aaagctggagctccccgcggtggcggccgctctagaactagtggatcccccgggctgcaggaattcgcacgagaccattacctagaacatcctaatcgaaaaaatttatcaaagtctttttttatcacatgatttttttttggtttcccatctctctctctctctctctctctctctacacgccaattttcagtgagcggcggcgatcggcttcggatcggcgcagcgcggcggagcggagatggttgccgtggcggaggatggcctgatccgcggtgcggacgccgtgccggcggtggagagggaagcgtagagggcggcagctgcggaggcggcggccaaggtcgatgaggcggaatcgtggaagggagacgtgagggagtatgatagcgacatgaggaagctgaaggagctgctttctaagctgaacccctacgcgnaggtagtcgtggcgcagtcccgacgtcgcgtggacggcggcgctccccgcctttcaggcgacgcgcccgagttcgtgtcggcggggatcgactatagggggcgcaacaccagctcccggcgccgaagttcgtgaagacaaaaaccgatgccgtgctgaagtttgggggggacgcccgcggggttggaagggggggc

SEQ ID NO: 28536 - protein, 59 aa, Zea mays
  misc_feature: Ceres CLONE 1402730-F
  misc_feature (16)..(16): Xaa is any aa, unknown, or other
MRKLKELLSKLNPYAXVVVAQSRRRVDGGAPRLSGDAPEFVSAGIDYRGRNTSSRRRSS

SEQ ID NO: 28537 - DNA, 576 bp, Zea mays
  misc_feature: Ceres CLONE 1402733-F
  misc_feature (367)..(367): n is a, c, t, g, unknown, or other
aagctggagctccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttggagaccctcccgcaagactatcaccctcagtggagcttctgacccattgacaatgcaagctaaatccagacaagagtcatccctctgacagcagcggttatctcgcgcaagcagcttgagacgacgccattgctgactacacatcanaaagagcaaccctccactggtgctgcggctaaggggagcatgcagatcttgtcaagacttgactggcagacaatcaccctggagtggagtctcaaacacctttgacattggcagggcaagatccaggacaggaggggatcccactgaaccagaaagtttcttttttcccggaaaaaattggaggaaggggggggccccttgttgaataa

SEQ ID NO: 28538 - DNA, 723 bp, Zea mays
  misc_feature: Ceres CLONE 1402737-F
  misc_feature: Encodes the peptide sequence at SEQ ID NO. 28539
  misc_feature (592)..(592): n is a, c, t, g, unknown, or other
  misc_feature (625)..(625): n is a, c, t, g, unknown, or other
  misc_feature (688)..(688): n is a, c, t, g, unknown, or other
aaagctggagtccccgcggtggcggccgctctaaatagtggatcccccgggctgcaggaatcgcacgagaccattacctagaaatcctaattgaaaatttaaatttttctccagataacaaacaaccgcatgggcaggtgccatgactggaacacacccaccctgcagaacgggcacgctaattctcatcacgtactccgtcgcagtccaacgccccctcgtacaggatgctgcgataaacttttcttaccataagaatacgtgattagcgacaatacagaccaacaatcatgacgtcgtcgggggcacaacttgggtaaggagacctgagtgcttgaagcgaccatgatgcaccatcttgctatcattgcgactgagttacgcgaccaaccaccacaatttgatggtgaagatgtccagcactctcagagacaatgatgtcacaccactacgagatcgatgcgtgaagagctccccggacgaatgaggaaggatcaagtcaagctaaagaggagcagggagaggcaacataaacttgccctgcattcgacggagctgcagaagaccactacaagcagagatttcagacgangacctgccggaagaacatgacgagggaccaggnacggggaacctaccaagtacatgctcaagctcgatgaggggggggccaagggccccgaagggnttccgtgtaacgggatcattcccatggagaaaggt

SEQ ID NO: 28539 - protein, 50 aa, Zea mays
  misc_feature: Ceres CLONE 1402737-F
  misc_feature (45)..(45): Xaa is any aa, unknown, or other
MREELPGRMRKDQVKLKRSRERQHKLALHSTELQKTTTSRDFRRXPAGRT

SEQ ID NO: 28540 - DNA, 850 bp, Zea mays
  misc_feature: Ceres CLONE 1402737-R
  misc_feature: Translation starting site: 460
  misc_feature: SWISSPROT Homolog: EC 4.1.2.10 Mandelonitrile lyase
  misc_feature (782)..(782): n is a, c, t, g, unknown, or other
  misc_feature (786)..(786): n is a, c, t, g, unknown, or other
tgggtccgggccccccctcgaggtcgacggtatcgataagcttttttttttttttttttgcagcttagatgcagatttcactcataatagtccacatagtaacaacaaacaacatgatacaactccgacaatatgtgcaacctatcaatatcagaatcacaccaacaatattgaatccagcattacatagttcaatagagattcttaatacgcctcgcctactgtcttggattataggatcatcacggttttgttccctctaatccttcagctgccaacctttcgtttgtgattctgactcccatatacctgccgagcatcatgacggttgcctgcgggttggttcctggcgaggcgttgaaagtggagccgtcaatgacgcgcagcgcgtcgatgccgagcactcggtattcagcgtcgacgaccctgccgacctggcagccaccgtggtagtgccagatggtcatgacggtgtccttgcagaacatctcaagcgacgtggagtcgttgtcgtgccggggcagcaggttgacggggaaccccgtcgacatgttgagcagcgtctccatggagaagtcggggtacgtgaagttcttgaaggcctgggagtggatgacgcgctcgatgaccgacaagccggccacgcagcggcggaggtcctcggggtgcgagaagtagttgaacgtcaccagcgggttgtcgtcggggtcgcggttgcgcagctcgaagtggcccgtggacagcgggccgaggacccttctcaggatgagccaccgcggaanggcngagtcgtcaagctgcctcatcgactccgctgcgcgcgcgattgggctcccggcgtgcgctgcta

SEQ ID NO: 28541 - DNA, 707 bp, Zea mays
  misc_feature: Ceres CLONE 1402742-F
  misc_feature: Encodes the peptide sequence at SEQ ID NO. 28542
  misc_feature (655)..(655): n is a, c, t, g, unknown, or other
aagctggagctccccgcggtggcggccgctctataactagtggatcccccgggctgcaggtaattcgcacgagaccattacctagaacatcctaatcgaaaacctttcgggcagaaagagccagagagagagagagagagaggtcggggctggggagcacacacccatcacccatggcctgactgacctccggactctccctgcttccgtcgccgccgcgggccgcccagctgactgctcctgccctccgcccgccctccatggcgtccgtcaagctcggctccaagcctgacgccttcaagcggcaaggccaggcatggttctgcacaacaggacttcctagcgatgtcaccgttgaggttggggatatgtctttccaccttcacaagttccctttactttcaaaaagtgcctttcttgaacggtcaattgaagaaaattctgaccaagaagaatgcatcatcaaactaaatgacattcctgggggtgccaagtcatttgagctagttgcaaggttctgctatggtgtgaaaatagagctttcacctgcaaatgttgtctacctacggtgtgcctcagagcatctagaaatgactgaagaagtagctgaggaaaacctgattgcacaggcagaaatgttcctcaaccaagtggntctccgtaactggacagattccttggcagcattggaaacatgtgatgaccca

SEQ ID NO: 28542 - protein, 149 aa, Zea mays
  misc_feature: Ceres CLONE 1402742-F
  misc_feature (23)..(124): Pfam Name: BTB Pfam Description: BTB/POZ domain
  misc_feature (132)..(132): Xaa is any aa, unknown, or other
MASVKLGSKPDAFKRQGQAWFCTTGLPSDVTVEVGDMSFHLHKFPLLSKSAFLERSIEENSDQEECIIKLNDIPGGAKSFELVARFCYGVKIELSPANVVYLRCASEHLEMTEEVAEENLIAQAEMFLNQVXLRNWTDSLAALETCDDP

SEQ ID NO: 28543 - DNA, 671 bp, Zea mays
  misc_feature: Ceres CLONE 1402746-F
  misc_feature: Encodes the peptide sequence at SEQ ID NO. 28544
  misc_feature (488)..(488): n is a, c, t, g, unknown, or other
  misc_feature (527)..(527): n is a, c, t, g, unknown, or other
aaagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagncgcatccaagcccgtgccagctgcagggaacctgcggcngtggcagcaccccgatcctggggcagtgcgtcgagttccctgagcatcagtgcagcccgacgggactggaggaactgaggcgtggggcccgcgcggccaagtatcctgtccgctaccgtggtgttaccctaatccagagtgttt

SEQ ID NO: 28544 - protein, 32 aa, Zea mays
  misc_feature: Ceres CLONE 1402746-F
  misc_feature (6)..(6): Xaa is any aa, unknown, or other
  misc_feature (19)..(19): Xaa is any aa, unknown, or other
MPVPTXASKPVPAAGNLRXWQHPDPGAVRRVP

SEQ ID NO: 28545 - DNA, 686 bp, Zea mays
  misc_feature: Ceres CLONE 1402750-F
  misc_feature: Encodes the peptide sequence at SEQ ID NO. 28546
  misc_feature (663)..(663): n is a, c, t, g, unknown, or other
caaagctggagctccccgcggtggcggccgctctagaactagtggatcccccgggctgcaggaattcgcacgagaccattacctagaacatcctaatcaaaaaatctcccttcggttccccaattctaaatcgaatcgggtcggtcttgccgtgcgtgcgtggctgcgcgagcgactcgactgcaccccccgctcctcccagtccccacacactgcgcgccgccgccgggtcctcctagggtttcgccgcgatgtcgctccggccgagcgagcgtgagcagatgcgtaagggcaactacaagcagacggtggacgcggaggagagccgccgccgccgcgagggacagatggtggacatccgcaaggccaagcgcgaggaaagcctccagaagaagcgccgcgatgggtttcccgcctccgccgctggtgtgccgccgatgggccactccaccgcgctccagcagaagctcgatggcttgccggcgaatggtgcagggccgtccactccaacgacccctccgtgcagcttgaggccaccacacagttcagggaagctgctttctattagaacgtagtccccaaatccgaagaggtgacagcaccaaggagtggtgccgcgatttcattgagtttcttacacgtgaggaccatccccaactccangtttgaggctgcatgggcactca

SEQ ID NO: 28546 - protein, 107 aa, Zea mays
  misc_feature: Ceres CLONE 1402750-F
  misc_feature (4)..(89): Pfam Name: IBB Pfam Description: Importin beta binding domain
MSLRPSEREQMRKGNYKQTVDAEESRRRREGQMVDIRKAKREESLQKKRRDGFPASAAGVPPMGHSTALQQKLDGLPANGAGPSTPTTPPCSLRPPHSSGKLLSIRT

SEQ ID NO: 28547 - DNA, 746 bp, Zea mays
  misc_feature: Ceres CLONE 1402752-F
  misc_feature: Encodes the peptide sequence at SEQ ID NO. 28548
  misc_feature (391)..(391): n is a, c, t, g, unknown, or other
  misc_feature (639)..(639): n is a, c, t, g, unknown, or other
aaagctggagctccccgcggtggcggccgctctagaactagtggatcccccgggctgcaggaattcgcacgagaccattacctagaacatcctaatcaaaaaatattaaaaaagaaaactctgttcaaccacccgccgagttcaacaaaactctcctccgccctcttccaggtccagcagagattgcgggcgcgtggccatccgacattgcctcgggagcgcgtttcctggtcaactaaggccggcatgaagggctgctcagagcgcttgctgtttctgctgctgctgctggcatcgtcgtcgttactgtccgctgtgattgccgcgcatcagacttgccccgccgacctcgacagcatatgccatggtggcgctgtgtatgatgatggcnaaggggggagctcttccccggcgtcacgaaaataaagtatgatgggtccaacaagcaagaaccctcttgcttataagtgggataaccacggaagaagtgattctcgcgtactcaaatgaatgattgtatgcttcttacaggttgcgtactggcacacctttccgagctactggagctgcattcctttcgacgctcctactgagacttgtccattgagaggatgtaacgaattcgatgatcatgactanagagaagaatgacagctccttggagcccatgcaacaagttggcgaggcgagcgatgtcgcattcctgacacgatttttgggcgcagatgtgcatcctctagtagaaa

SEQ ID NO: 28548 - protein, 59 aa, Zea mays
  misc_feature: Ceres CLONE 1402752-F
  misc_feature (49)..(49): Xaa is any aa, unknown, or other
MKGCSERLLFLLLLLASSSLLSAVIAAHQTCPADLDSICHGGAVYDDGXGGSSSPASRK

SEQ ID NO: 28549 - DNA, 730 bp, Zea mays
  misc_feature: Ceres CLONE 1402753-F
  misc_feature: Encodes the peptide sequence at SEQ ID NO. 28550
  misc_feature (281)..(281): n is a, c, t, g, unknown, or other
  misc_feature (282)..(282): n is a, c, t, g, unknown, or other
  misc_feature (319)..(319): n is a, c, t, g, unknown, or other
  misc_feature (473)..(473): n is a, c, t, g, unknown, or other
  misc_feature (474)..(474): n is a, c, t, g, unknown, or other
  misc_feature (613)..(613): n is a, c, t, g, unknown, or other
caaagctggagctccccgcggtggcggccgctctagaactagtggatcccccgggctgcaggaattcgcacgagaccattaacctaaaacatcctaaatcgaaaagaacgagtattttgagtcaactcacaagggtagttcaaagtccagaattccagactcgcgttcgcacgccgcctttcgcgctgccttagcgccttagcctgctagggctcgtcgattcatcgccggctcgacttctgatctcgcgggcagagcagtgcgccggcgcgatggctcgnngatccggatgtgtccggcggcgagcaggcggagccgncccgacgatgtgccgaaccccgacagttcgacgaggtcgaccccaccggccgctacttcagggtacaagggagggtcgtggggatcagggggccttcaagacagtctacaaagggttttcgaacgtggtcaaagggcatcgagggtggcatggnngctaaagtgggagataaacggccggaaccatggggatcccccaaggagctccagcggctccaagacggagatccaggctgctgcggtcgctccatcacaagcacattctcaagctctacacctcatgggtcgacaacanaaagagggcggtcaatataatcactgagcttttcacgtccggcaacttgagagagtaccgtacgaagcacaagaaagttgacatgaaggcaatgaggcgatgggccaacaaatactg

SEQ ID NO: 28550 - protein, 75 aa, Zea mays
  misc_feature: Ceres CLONE 1402753-F
  misc_feature (37)..(37): Xaa is any aa, unknown, or other
MGIPQGAPAAPRRRSRLLRSLHHKHILKLYTSWVDNXKRAVNIITELFTSGNLREYRTKHKKVDMKAMRRWANKY

SEQ ID NO: 28551 - DNA, 779 bp, Zea mays
  misc_feature: Ceres CLONE 1402758-F
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
ttttcccccccccccccccccccccccccccnnnnnnngggttttttttccaaagctggagctccaccgcggtggcggccgctctagaactagtggatcccccgggctgcaggaattcgcacgagaccattacctagaacatcctaatcgaaaaaacgacgcgattggtgattccgtttctaccccgagacctccagccgtccgcccctgaaccctcagacttctccgtcgcgcctcggcactcgacggccgccggcacacaccgcgcagtctcgagacaggtaacccgctcccctctccgttgaactcctctcccaagaagggggcagacctcacgccccacgcccatctgagccaagtgcacggtgctgctagatcccgatctcgttctgccacccgccgagggagggttgcgctcgccggatcccgccggagggacgtgcggctttggatcgctggacctgtccggggagaacccggagtaccgaggatggaggatgatctcccccctgacgaaaaacattaaaggggggggggtaaaggaatttcggccggggggaaccattctgggggaacccgtccccgcccacgggggacgagagtggccccccggggggaaagggcccggggggggctcccggggcctttatccgggaacgtcaaaagatgggggggggaccataacgggggcccccttttccccgcaatataggggggggcccttacatcatcggggaccaaaaaaggatcctcggggggaaagactcccgggggggaaa

SEQ ID NO: 28552 - DNA, 767 bp, Zea mays
  misc_feature: Ceres CLONE 1402759-F
  misc_feature: Encodes the peptide sequence at SEQ ID NO. 28553
  misc_feature (382)..(382): n is a, c, t, g, unknown, or other
  misc_feature (429)..(429): n is a, c, t, g, unknown, or other
  misc_feature (436)..(436): n is a, c, t, g, unknown, or other
  misc_feature (452)..(452): n is a, c, t, g, unknown, or other
aaagctggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcnagcacggcgtgtacctgggcacatccccgtcatcgtgctggtgtgcncgcgccnagctgggcagcctcanccgcgacgagctgtggcgcaggggggtgggggggaggccaccctacgacctcggcaccgtggttcgctttcctcggcggtctcggctttaaccattttccgtttaaataatggcccaggccaaggccggggaccctcatcgacttcccagggtaaaagccggccgagagggttcaggggggcccaaggggggagttccctacccggggcgcaaatcccggaaatttcaagagggaagcccgggggttccaaggcggggtgtggggaaaacccgggtttggggaaaagattaattgggcgggtgggggtttcaccc

SEQ ID NO: 28553 - protein, 111 aa, Zea mays
  misc_feature: Ceres CLONE 1402759-F
  misc_feature: SWISSPROT Homolog: EC 2.3.1.119 Icosanoyl-CoA synthase
  misc_feature (59)..(59): Xaa is any aa, unknown, or other
  misc_feature (77)..(77): Xaa is any aa, unknown, or other
  misc_feature (82)..(82): Xaa is any aa, unknown, or other
MAREEQALLSTEIVNRGVEPSGPDAGSPAFSVRVRRRLPDFLQSVNLKYVRLGYHYLIXHGVYLGTSPSSCWCARAXLGSLXRDELWRRGVGGRPPYDLGTVVRFPRRSRL

SEQ ID NO: 28554 - DNA, 679 bp, Zea mays
  misc_feature: Ceres CLONE 1402772-F
aagctggagctccccgcggtggcggccgctctagaactagtggatcccccgggctgcaggaattcgcacgagaccattacctagaacatcctaatcgaaaaaacgacgcgattggcgattccatttctaccccgagacctccagccgtccgcccctgaaccctcagccttctccgtcccgcctcggcactcgacggccgccggcacacaccgcgcagtctcgagacaggtaacccgctcccctctccgctgaactcctctcccaacaaggggccagcctcacccccaacgcccatctaagccaagtgcacggtgctgctagatcccgatctcgttctgccaaccgccgagggagggttgcgctcgccggatcccgcccgagtcacgtgcggctttgattcgctgcacctgtcgtgcaggaaccggaggaacgaggatggaggatgactcgccgctgacgagacgatgaagggtgcgtgacaggactcgccgcgggaacaatctggggcacgtcctcccaccggtacgagtggccccgggggaaaggccacgtccgggtccctggccttaatcgaagcttaaaaggggggggccctaaggggcccctttcgccaccatgggggggctcttattcggggtaaaaaaattttggggaaaacccgggaaaaaggccgaattct

SEQ ID NO: 28555 - DNA, 660 bp, Zea mays
  misc_feature: Ceres CLONE 1402776-F
  misc_feature: Encodes the peptide sequence at SEQ ID NO. 28556
aagctggagctccccgcggtggcggccgctctagaactagtggatcccccgggctgcaggaattcgcacgagaccattacctagaacatcctaatcgaaaaacagggaagcacccatggccctcgccaccaatgacgactccctccaccttttcctcacccggaccgcctccaagctccgcgtagaccgtggcctcccatgcctcctcctccgagccacttcatccacctccgactccccggacttgaacatcaccttcgcgcagaccgcgacgtccaaaaaggccccgtccgcgcagccgatggtcacatggatcgtccgcatcgaggacgatcagtcccgtctcagcacctctacgtcgacggatgtaatccagatcatcgcgctcgcggaggcgcaggccaagaacgtcgacaagaaggataccctcaagggtcagaatgacgcatttgccgccgacaccgagaatgcttccaatgccagcgtcaagggcaaggaaaggaagcccgacccgaccgtgacgaccaagttctcacatgactgcgggaggatttacaatgagaatatcacgtagcgtcaatcgcaacggctcttcaagcgtctgtgcggcgcatgagtgttatcaagaatgaccagtgaggagctcatcttccaaagtaa

SEQ ID NO: 28556 - protein, 90 aa, Zea mays
  misc_feature: Ceres CLONE 1402776-F
MVTWIVRIEDDQSRLSTSTSTDVIQIIALAEAQAKNVDKKDTLKGQNDAFAADTENASNASVKGKERKPDPTVTTKFSHDCGRIYNENIT

SEQ ID NO: 28557 - DNA, 670 bp, Zea mays
  misc_feature: Ceres CLONE 1402776-R
tcgaggtcgacggtatcgataagctttttttttttttttgctcgtcaataaaggattcttaaaaaaacagttctcggttctcggatgtacaatgttatttgcccaactctcactcgtctgccattattgactacctgttggacaagaggcattctaaactatcacatattttaatttgagaaaaacaatgcatctgaaaaaattataattgaaaatatagagtaaaatggatatgccaacagaagatcgctatttgacaatgttccatcctcaccaaacgactgctgcatcgcggactggttctgccggttgatatgatgtggacacccgcaagctaagtatcgcgagtagttcaccagttcttcaaggcaaaacatgtttgccacatcttgatcaacagccaccaccaccaatggacatccctaacattcacaagctttctgaactgagtagcaactcttgcattgtgaccttgaggattgctaccctccttggacaaaatgcgcatcattagccacatcagacgccatctcctaggagttgccatcccacccccctgattaccaccccgaaaaaaccccaacaaaactctctccattcccaaaatccagctgggaaggccttacccttggccttcccccaacaaccgttttgaaggcaactacaccgg

SEQ ID NO: 28558 - DNA, 631 bp, Zea mays
  misc_feature: Ceres CLONE 1402778-F
  misc_feature: Encodes the peptide sequence at SEQ ID NO. 28559
tggagctccccgcggtggcggccgctctagaactagtggatcccccgggctgcaggaattcgcacgagaccattacctagaacatcctaatcgaaaaattccaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggcgcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtgttacttcttctcgccgcgcgaccgcaagtacccgaatggctccaggcctaaccgggcggccgggacagggtactggaaggccacccggcgccgacgaagccgggaagggtcgccgcggccccgtggccatcaagaaaggggttccgtctttcaaacgcccgggaagccgcccccaggggcggccaagaaccaaccgggaatcatggcccg

SEQ ID NO: 28559 - protein, 134 aa, Zea mays
  misc_feature: Ceres CLONE 1402778-F
  misc_feature (9)..(131): Pfam Name: NAM Pfam Description: No apical meristem (NAM) protein
MDCGGALQLPPGFRFHPTDDELVMYYLLRKCGGLPLAAPVIAEVDLYKFDPWQLPEKAFGGEKECYFFSPRDRKYPNGSRPNRAAGTGYWKATRRRRSREGSPRPRGHQERGSVFQTPGKPPPGAAKNQPGIMA

SEQ ID NO: 28560 - DNA, 682 bp, Zea mays
  misc_feature: Ceres CLONE 1402779-F
  misc_feature: Encodes the peptide sequence at SEQ ID NO. 28561
  misc_feature (396)..(396): n is a, c, t, g, unknown, or other
  misc_feature (637)..(637): n is a, c, t, g, unknown, or other
  misc_feature (655)..(655): n is a, c, t, g, unknown, or other
aaagctggagctccccgcggtggcggccgctctagaactagtggatcccccgggctgcaggaattcgcacgagaccattacctagaacatcctaatcaaaaaagactcaagggccaaggcagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgttgctgcagaccttgtcacggcgatggcgagggcgagggcaagggcaaagcatcagcttcgcgacgaggagaggccgtggggggaatgctgcgacttnggcgtatgcgtcaagacgtacccgctaacttgctcgtgctttgatcgggttgagcgctgctccgacgcctgtaaggagtgcgtggaaacggaggactcgcgccacgtctgcgtcgacaggtaccgtggcgaccccgggccccagtgccacgacgaggacgggaggaagcgcgaacccgctgacgacgacgctggtgggcaagcgacgcccgacgcagtgatggcagatgacaagaaagcangcggcgccgacgacgacnagaagaaagagccgtggaaatgctgca

SEQ ID NO: 28561 - protein, 165 aa, Zea mays
  misc_feature: Ceres CLONE 1402779-F
  misc_feature (70)..(70): Xaa is any aa, unknown, or other
  misc_feature (151)..(151): Xaa is any aa, unknown, or other
  misc_feature (157)..(157): Xaa is any aa, unknown, or other
MAMGAASILLMMVSLEALLLAAAAGGGTIRLPSDVGGVAADLVTAMARARARAKHQLRDEERPWGECCDXGVCVKTYPLTCSCFDRVERCSDACKECVETEDSRHVCVDRYRGDPGPQCHDEDGRKREPADDDAGGQATPDAVMADDKKAXGADDDXKKEPWKCC

SEQ ID NO: 28562 - DNA, 709 bp, Zea mays
  misc_feature: Ceres CLONE 1402782-F
  misc_feature: Encodes the peptide sequence at SEQ ID NO. 28563
  misc_feature (260)..(260): n is a, c, t, g, unknown, or other
  misc_feature (268)..(268): n is a, c, t, g, unknown, or other
  misc_feature (303)..(303): n is a, c, t, g, unknown, or other
  misc_feature (341)..(341): n is a, c, t, g, unknown, or other
  misc_feature (354)..(354): n is a, c, t, g, unknown, or other
  misc_feature (388)..(388): n is a, c, t, g, unknown, or other
  misc_feature (389)..(389): n is a, c, t, g, unknown, or other
  misc_feature (408)..(408): n is a, c, t, g, unknown, or other
  misc_feature (409)..(409): n is a, c, t, g, unknown, or other
  misc_feature (430)..(430): n is a, c, t, g, unknown, or other
  misc_feature (482)..(482): n is a, c, t, g, unknown, or other
aagctggagctccccgcggtggcggccgctctagaactagtggatcccccgggctgcaggaattcgcacgagaccattacctagaacatcctaatcgaaaacacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtngaggacgncgcgcttgcgcccagcgtgtcgtactacgactacntcaatcgtgggcggcgggcacggcgggtgcccgctggnccgccacgctgtncgagcgcttccgcgtgctgctgctggagcgcggnngcctcgcctaacgacgacnnacgcatcggggacatggcccngttttccggaacgcctgtcgaaccctccccgggctcgccgcgcagggcttcntgtcgggaggaggggtcatcaatcgcggcccccgggtggtgtgggggggggaaattgattaaaggcggcttttaaccgcgggcagcgacacacctgcggggggggtccggtgggaacactggggggcgccccggcggctaaaaccttggggggggggaaacaattgggggcctccaacgagggagggcccccccccaagaagacacccctttttgagggggtcgctt

SEQ ID NO: 28563 - protein, 135 aa, Zea mays
  misc_feature: Ceres CLONE 1402782-F
  misc_feature (40)..(40): Xaa is any aa, unknown, or other
  misc_feature (52)..(52): Xaa is any aa, unknown, or other
  misc_feature (69)..(69): Xaa is any aa, unknown, or other
  misc_feature (80)..(80): Xaa is any aa, unknown, or other
  misc_feature (87)..(87): Xaa is any aa, unknown, or other
  misc_feature (94)..(94): Xaa is any aa, unknown, or other
MSGRSRHFTMSTLLATSFFFVLLCSSLQVRGVNYTFVEDXALAPSVSYYDYXNRGRRARRVPAGPPRCXSASACCCWSAXASPNDDXRIGDMAXFSGTPVEPSPGSPRRASCREEGSSIAAPGWCGGGKLIKGGF

SEQ ID NO: 28564 - DNA, 654 bp, Zea mays
  misc_feature: Ceres CLONE 1402783-F
  misc_feature: Translation starting site: 178
  misc_feature (490)..(490): n is a, c, t, g, unknown, or other
  misc_feature (491)..(491): n is a, c, t, g, unknown, or other
  misc_feature (494)..(494): n is a, c, t, g, unknown, or other
  misc_feature (654)..(654): n is a, c, t, g, unknown, or other
aaagctggagctccccgcggtggcggccgctctagaactagtggatcccccgggctgcaggaattcgcacgagaccattacctagaacatcctaatcgaaaagaccctcgcttcacttgtcacggactcgcgtccacaaaccacaaccagctcactcaagaacaaagaacccaacccatggcttctcccaagccgctcctcctgctcgccacctcgttcctgagctgcggcctcctggtggccgccgactacgccccaatgaccctgaccgtggtgaacaactgcccctacccggtgtggccgggcatccaggccaactccgggcacacggtcctgggagggcggcggcttcttcctcccgccgctctcccacaagtccttcccggcgccggcccacccctggtccggccgcatctgggcgcgcacggggctgcgcgggcgccggcgcgcagctccactgcgccacggcgaactgcggcggcggtcccannggngcggggctccgggcgccgcggcgcccacgacgcttggcgcaggtgaacctccaccacggcaacgaccagacctcgtacggcgtgaagcggggtgaacggcttcaacgggggcctgtcccgtgaccccgcacgaagggcgcggcaactgccccgtcctccn

SEQ ID NO: 28565 - DNA, 718 bp, Zea mays
  misc_feature: Ceres CLONE 1402784-F
  misc_feature: Encodes the peptide sequence at SEQ ID NO. 28566
aagctggagctccccgcggtggcggccgctctataactagtggatcccccgggctgcaggaattcgcacgagaccattacctagaacatcctaatcgaaaaatttcttccccccttctctcgtcacgtccaataaaaaggggggaaaacttctctctctttttttccctcccccgcccgaatctgatgcttaaaccctcgccgggaggaggattccaatcccgacgcaccagcccgcgcccgccacctacagccgcgcccggatctccgccatggccgccgcgccgcaccaggcccagggccccgcagatagtgtgattccgctgcagtctgaacctgcacttgataataatccctccaagagtgcaaacgctagggaccagattctttctggtacggagaatgtgactacaggcaatgcacgcggcggcagctccttgaaatcgcaaaaaggcccgccagagaaggctagctctgtcggaaaacctggagaacaaccttttccctaccatcaaaatgtgtatgcaccacagccacaaccactctatcttggaggctacatgaacccttcaggacaatgggaggatatccccattatgggaggatgggaggggcttcattccgtatttcccgggaatctgcaggaacaacaggcccccatggtaatctcctggatatgcaaaaaatcccccaaatgaggggtggagcgtatttctcct

SEQ ID NO: 28566 - protein, 141 aa, Zea mays
  misc_feature: Ceres CLONE 1402784-F
MAAAPHQAQGPADSVIPLQSEPALDNNPSKSANARDQILSGTENVTTGNARGGSSLKSQKGPPEKASSVGKPGEQPFPYHQNVYAPQPQPLYLGGYMNPSGQWEDIPIMGGWEGLHSVFPGNLQEQQAPMVISWICKKSPK

SEQ ID NO: 28567 - DNA, 513 bp, Zea mays
  misc_feature: Ceres CLONE 1402787-F
  misc_feature: Encodes the peptide sequence at SEQ ID NO. 28568
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (484)..(484): n is a, c, t, g, unknown, or other
ggagctccccgcggtggcggccgctctagaatagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtatattatcttccgcccacctgactacgccctcgacctcggcctcggcgccgccctccgtccgcctggacgcggcagacatgggcgcagctggtggggctcaagcggctccgccaacgcagaacatcactctggcggcgcctgacacgcgnnnnctttgggcttgggggggccgatggtcatgggggttttcccacggaaatccccccggggttttgggaaaaaaaaacccccccgccccccgggggggggggcccccgggggggtttcccccccgggggaaaaaaaaaagggccaaaggggggggcggncccccccccccccccggcggggggaaggg

SEQ ID NO: 28568 - protein, 86 aa, Zea mays
  misc_feature: Ceres CLONE 1402787-F
  misc_feature (25)..(25): Xaa is any aa, unknown, or other
MGAAGGAQAAPPTQNITLAAPDTRXLWAWGGRWSWGFSHGNPPGVLGKKNPPAPRGGGPPGGFPPRGKKKRAKGGGGPPPPPGGGK

SEQ ID NO: 28569 - DNA, 671 bp, Zea mays
  misc_feature: Ceres CLONE 1402789-F
  misc_feature: Encodes the peptide sequence at SEQ ID NO. 28570
  misc_feature (519)..(519): n is a, c, t, g, unknown, or other
  misc_feature (574)..(574): n is a, c, t, g, unknown, or other
  misc_feature (575)..(575): n is a, c, t, g, unknown, or other
  misc_feature (608)..(608): n is a, c, t, g, unknown, or other
aaagctggagctccccgcggtggcggccgctctagaactagtggatcccccgggctgcaggaattcgcacgagaccattacctagaacatcctaatcgaaaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacacctccccgggctcgcccgcgcagcgcttcgtgtcggaggacggcgtcatcaactcgcgcccgcgggtgctggcggnggcagctgcatcaacgccggcttctacacgcgggccagcgacgactacgtgcggnngcgtcgggtgggacctgggcgcccgccgggcgncgtaccggtgggtggaagaactgctgccgttccagccggagctgcggcccctggcaggccgcg

SEQ ID NO: 28570 - protein, 176 aa, Zea mays
  misc_feature: Ceres CLONE 1402789-F
  misc_feature: SWISSPROT Homolog: EC 4.1.2.10 Mandelonitrile lyase
  misc_feature (126)..(126): Xaa is any aa, unknown, or other
  misc_feature (145)..(145): Xaa is any aa, unknown, or other
  misc_feature (156)..(156): Xaa is any aa, unknown, or other
MSGRSRHFTMSTLLATSFFFVLLCSSLQVRGVNYTFVKDAALAPSVSYYDYIIVGGGTAGCPLAATLSERFRVLLLERGASPYDDDRIGDMARFADTLSDTSPGSPAQRFVSEDGVINSRPRVLAXAAASTPASTRGPATTTCGXVGWDLGARRAXYRWVEELLPFQPELRPLAGR

SEQ ID NO: 28571 - DNA, 696 bp, Zea mays
  misc_feature: Ceres CLONE 1402792-F
  misc_feature: Encodes the peptide sequence at SEQ ID NO. 28572
  misc_feature (415)..(415): n is a, c, t, g, unknown, or other
caaagctggagctcaccgcggtggcggccgctctagaaaagtggatcccccgggctgcaggaattcgcacgagaccattacctagaacttcctaatcgaaaaactcgccctgcaaagcacagacacaaaccacgagcgcgaggcacgaccttcatcgaatcggtcacgaaccaccatggcggcctcacgcgcgctcctccccagtccgcaggtgagccctgcgagcgcgcgggtccgtctggccgcggccgtgacgtcgtcgctcacgctcgcggagcgcggcggggccggggcccgcgcgcgtctccgcgtgcggtgcgcgatcttgacgacgcctgcggccgtggcgtccatcgagtcgaggacgatgctgcggaactctgcctctcgaccagaaggcgatgtgcggacaaanccggtcctgctggactgcccaaaaatgactcaggccgggcttggcgggctgcagaaaattacgggacccggagagtgccctacagatgtaccccggggaaactctcggcaggggggggggaggtttaacgggttcttttggggaaagtcatcacgagacactggggggtggttgtcgggctccccaaggagggtcttgctgggggggcaccccaaagaaaaaggccccttgggggcccccgttggggtggtctctctgggccaggggggggggtttttccg

SEQ ID NO: 28572 - protein, 173 aa, Zea mays
  misc_feature: Ceres CLONE 1402792-F
  misc_feature (80)..(80): Xaa is any aa, unknown, or other
MAASRALLPSPQVSPASARVRLAAAVTSSLTLAERGGAGARARLRVRCAILTTPAAVASIESRTMLRNSASRPEGDVRTXPVLLDCPKMTQAGLGGLQKITGPGECPTDVPRGNSRQGGGRFNGFFWGKSSRDTGGWLSGSPRRVLLGGHPKEKGPLGAPVGVVSLGQGGGFF

SEQ ID NO: 28573 - DNA, 1321 bp, Zea mays
  misc_feature: Ceres CLONE 1402793
  misc_feature: Encodes the peptide sequence at SEQ ID NO. 28574
ataccttccctttccaggcctcggctccgtccgtccccaatctcccctttcgtcttctcttcccgctcccgtcccgaaattagcccaccgattagcttgcttgccctagcagatcgaagccgtagccctagccgaggagcgcccatggccgctgcgatcgtggcctgaggcggcggggctcttcccatggggtgaggggatggaccctagcctgaaggaggaggtgatgaaggcggtggaggaggcgaggtccgcggcggcgccgcggtgccgggtggtgcggatcatcgtgcacgacgaggacgccaccgactcgtcttccagcgacgacgagggagaggaggcgggggagcgcgccgcggcgcacccgggcgcggcgccggcgggcagcgtgaagcgcagccgcgtgctgctccagtccactgggtgcggggcggaggaggacggcgagggggccaggttcacgggcgtgcggcggcggccgtggggccggtgggcggcggagattcgcgacccgctgctccgccgccgcgtctggctcggcactttcgacaccgccgaggaggccgcggcggcctacgtcgcagcgcgcctccgcatccgcgggcccagcaactcgctccctccgcccgcgcaccgcccggccttgcccccacgtcccccgccgccacctcagcagcgggagaagaagctgccgccgccgccgccgccgctgcttccgcttccgccgaagaagcagcagtatccgccaccgcctctgcttccgccgaagaagcagctgtacccgccaccgcttcccctcctcccaccaaagaagcagcagcagcatcaccatcacccgtcaccgcctctgcccacgcttccgccgaagaagcggctgccgtcgccgcctctgctgcgcgaaagcaagaagcagtgcgtcgcctcctccccagcggagccgcgtttcatgccgctgccggtgtgggcgctgatgtccggctccgggaagcgcaagaagcggtcgggctgcggcgggcgcgtccccgccctccacacccccgccgccgaggagacggggcgcgcctgagacgacagggacctccctgcttctggtatccatctcctaccgctccttgatcatgccatgccaatctgaattgccgctcaatcggtgctgatgtgaagagcctgtaacctctctgattcatgaactgatgaatttgtgtacatatgctcttttgctgctggaaccgcagcgggcgatgaactgatctgtaaaacccgacgtattattcatatgtaataaataagtatctgttgacgaaaaaaaaaaaaaaaa

SEQ ID NO: 28574 - protein, 289 aa, Zea mays
  misc_feature: Ceres CLONE 1402793
  misc_feature (86)..(137): Pfam Name: AP2 Pfam Description: AP2 domain
MDPSLKEEVMKAVEEARSAAAPRCRVVRIIVHDEDATDSSSSDDEGEEAGERAAAHPGAAPAGSVKRSRVLLQSTGCGAEEDGEGARFTGVRRRPWGRWAAEIRDPLLRRRVWLGTFDTAEEAAAAYVAARLRIRGPSNSLPPPAHRPALPPRPPPPPQQREKKLPPPPPPLLPLPPKKQQYPPPPLLPPKKQLYPPPLPLLPPKKQQQHHHHPSPPLPTLPPKKRLPSPPLLRESKKQCVASSPAEPRFMPLPVWALMSGSGKRKKRSGCGGRVPALHTPAAEETGRA

SEQ ID NO: 28575 - DNA, 645 bp, Zea mays
  misc_feature: Ceres CLONE 1402795-F
  misc_feature: Encodes the peptide sequence at SEQ ID NO. 28576
  misc_feature (573)..(573): n is a, c, t, g, unknown, or other
  misc_feature (574)..(574): n is a, c, t, g, unknown, or other
tggagctccccgcggtggcggccgctctagaactagtggatcccccgggctgcaggaattcgcacgagaccattacctagaacatcctaatcaaaaggtggttgacggccgcttacccgcaccggcgccatgcgcgcgcgcggctaggtggtcgaggtcaagccaaacgctgcccaccgcctctgcctctgcctcgcatatatcctcgcgcacgttctttgctcgtctcgcactcgcttccttcgacgactcatcgccgatcacaccaggctagctagcccacccacagtcgtagggccaggaccgatcggaggagctcggtttttcgaccaggaccgccgccgccacacccgaagaagccgacgatgcagacgacgacgtcctcggcggcggcgtcgccgcgcccgcgcgcgcgggcgccgcagtccgtggtggccgagctggagggcgcgctgctccggagcgcggacacgttcccgtacttcatgctcgtggcgttcgaggcgtccgggctgccgcgcttcgcgctgctgctggcgctgtggccgctgctgcggctgctggaggtggcgnnccggcgcggcctggcgctgcgcgccgccgcgttcgtggccaccgcgggcgtgccgcgcgccgaggtggagg

SEQ ID NO: 28576 - protein, 93 aa, Zea mays
  misc_feature: Ceres CLONE 1402795-F
  misc_feature: SWISSPROT Homolog: EC 2.3.1.15 Glycerol-3-phosphate O-acyltransferase
  misc_feature (70)..(70): Xaa is any aa, unknown, or other
MQTTTSSAAASPRPRARAPQSVVAELEGALLRSADTFPYFMLVAFEASGLPRFALLLALWPLLRLLEVAXRRGLALRAAAFVATAGVPRAEVE

SEQ ID NO: 28577 - DNA, 734 bp, Zea mays
  misc_feature: Ceres CLONE 1402796-F
  misc_feature: Encodes the peptide sequence at SEQ ID NO. 28578
  misc_feature (532)..(532): n is a, c, t, g, unknown, or other
  misc_feature (663)..(663): n is a, c, t, g, unknown, or other
  misc_feature (664)..(664): n is a, c, t, g, unknown, or other
  misc_feature (687)..(687): n is a, c, t, g, unknown, or other
aaactggagctccccgcggtggcggccgctctagaactagtggatcccccgggcttgcaggaattcgcacgagaccatttacctagaacatcctaatcgaaaaacccaccagtccggtccatctgctggacctcgattggtttcttcttacctaggaacatccggggatgtcgactcctgcgaggaagaggctgatgagggatttcaagcggttgatgcaggaccctccggccggcataagtggcgccccgcaggataacaacattaatgcttgtggaatgcttgtcatttttggacctgatgataccccgtgggattggaggtacgtttaagcttgacttttccagtttaattgaaaatttccaaacaaaccaccaacttgtgcgatttgttttctaggattgttccattccttaacattttatgcttgattggaagcatattgctttagaatatccctgcagaaatccagtgggagtccgaatattatgattgtagcttgcgataccttcacgtcaattccagtcttttnttttgtgcgatccaaaaccccgaatttcgccccgttaatttctaagcccgccccgcattgttcagcgagaaccaaacgaaaattcaaccccaaatttcccggaaagtcctgaaacaaaatgacggattttnnccccccccccgtttcttgtttgnccccccccggtttttgtttgaaaatttttttttggccccccaaaaaa

SEQ ID NO: 28578 - protein, 54 aa, Zea mays
  misc_feature: Ceres CLONE 1402796-F
  misc_feature: SWISSPROT Homolog: EC 6.3.2.19 Ubiquitin--protein ligase
MSTPARKRLMRDFKRLMQDPPAGISGAPQDNNINACGMLVIFGPDDTPWDWRYV

SEQ ID NO: 28579 - DNA, 645 bp, Zea mays
  misc_feature: Ceres CLONE 1402798-F
  misc_feature: Translation starting site: 202
  misc_feature: SWISSPROT Homolog: EC 3.4.22.14 Actinidain
  misc_feature: SWISSPROT Homolog: EC 3.4.22.30 Caricain
  misc_feature (310)..(310): n is a, c, t, g, unknown, or other
  misc_feature (403)..(403): n is a, c, t, g, unknown, or other
ggagctccccgcggtggcggccgctctagaactagtggatcccccgggctgcaggaattcgcacgagaccattacctagaacatcctaatcgaaaaaccaaaagaaagaaaccaactaaaatcccaaaagagaggaaaggcataaacagacggtagaaggaagaaagggacgctcgtctcggctcgtcacgtgccgccgccatggctgctctgggccgtggcctgcccctcctcctgctcctcctcctcgccgtagcgggggccgccaacgccgcggcggcgcccggcggcatgtccatcatcacctacnacgaggagcacggcgcgcgggggctggagcggacggagccggaggtgcgggccatgtacgacctctggctcgcggagcacggccgcgcctacnacgcgctgggcgagggcgagggcgagcgcgaccgccgcttcctcgtcttctgggacaacctccgcttcgtcgacgcgcacaacgagcgcgccgggcgcccgcggcttccgccctcgggatgaaccagttcgccgacctcaccaacgacgagttccgcgccgcgtacctcggcgccatggtcccgccggccgccccgggaagccgtcgtggggggggagaggtaccgccacgacggcgccgcc

SEQ ID NO: 28580 - DNA, 679 bp, Zea mays
  misc_feature: Ceres CLONE 1402799-F
  misc_feature (634)..(634): n is a, c, t, g, unknown, or other
aaagctggagctccccgcggtggcggccgctctagaactagtggatcccccgggctgcaggaattcgcacgagaccattacctagaacatcctaatcgaaaaatcttactggcgcccaagctctccacgccagccatctcccctccatcttcccttctgcagaaatcctaccatggccgccctccctggtgctcaccccagtcgaggtctctccatggccggctgtagttccctggcgcccctgctcctccctgttctagctcggtgctcagagccccagcgccagtcgcccttctgctcccttccccatggcgcgcttgctccctagacggcgctcggattcctccttctcggccctctccatcgcgccctgctcgcccagccgcgccgagctcggcctcttcttctcccctgcttcctatggcggcgccggtcggatctccctggcgcctcaccctgctctctatctgcccatgaagtcgcctagcccaaccgtgcctgctccctcactgtgctcgccatggtcgccgcctccaagcttctccctgctgcgcctgtggccgtcccctctgctcgccacgacgtgtcgagctcccgcgtcgagtccttttcctgctcgcccgcgatgcccggngtcctgcctgctctgctcgacatccgtccatggcgtcatgcgtga

SEQ ID NO: 28581 - DNA, 716 bp, Zea mays
  misc_feature: Ceres CLONE 1402800-F
  misc_feature: Encodes the peptide sequence at SEQ ID NO. 28582
  misc_feature (409)..(409): n is a, c, t, g, unknown, or other
  misc_feature (433)..(433): n is a, c, t, g, unknown, or other
  misc_feature (507)..(507): n is a, c, t, g, unknown, or other
  misc_feature (569)..(569): n is a, c, t, g, unknown, or other
ggagctccccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggacccggccacatccaagccgtcgcctccggacccggccacacccaagcccgccgctccggccccggncacacccaagccagcgccagcagngggaggaaaagggcgatgacccgatgctggacttcacggtcgtcccgcgcaagggtaaacgtgaagtggcgggnctgcagacaaagcggggcacggaagtgggcgcgatgcacgtggtccaggcggtgggcaaggntccggtgcttctaatcccaggaaaggccggcgaccctcggcaaaatgaacaaattttttcgtcaggttaagggccaccctaaagggaaacctatgggggaaggacattcgggtaaggggcaatcccatggggaaaccttagggaaca

SEQ ID NO: 28582 - protein, 75 aa, Zea mays
  misc_feature: Ceres CLONE 1402800-F
  misc_feature (62)..(62): Xaa is any aa, unknown, or other
  misc_feature (70)..(70): Xaa is any aa, unknown, or other
MGAVTSTVAARFAFFPPSPPSYGFEQPAPLPAPATPEPPDPATSKPSPPDPATPKPAAPAPXTPKPAPAXGGKGR

SEQ ID NO: 28583 - DNA, 641 bp, Zea mays
  misc_feature: Ceres CLONE 1402807-F
  misc_feature: Encodes the peptide sequence at SEQ ID NO. 28584
  misc_feature (313)..(313): n is a, c, t, g, unknown, or other
  misc_feature (536)..(536): n is a, c, t, g, unknown, or other
gctctagaactagtggatcccccgggctgcaggaattcgcacgagaccattacctagaacatcctaatcgaaaagacaaccccagcgcacgaactccaaaatagcgagccgaagggggccacgagtcctccacctccctctccgccgcgtcgctcgcgcttgacgcgcgccgagagccgaatcggagccacgaggcagccgccccgggcggatcgatcctagggccagggcatgggcggaggggacgccgacgccggcggcgagcccgcggacgcgcaggccacgctccacatccggtgcaccaacgcctccnagttcaccgtgcgggccgacctgggcgccaccgtcggggcgtttaaggcgatcgtcgccgacagctgcgacgtgccggcgccgcagcagcggctgatctacaagggccggatcttgaaggacgagcaaaccctagccagctacggtgtggagacagaccatacaatccacatggtacgtggtgctgtgccatcaccaacatctactgcacctgcagccaaccnagaacctaccactgctgctcctgccagttccccggcaacaggattggggtggtttgttgcaaagtctgggtactacaggcgctgctgctaacagtgagggggttg

SEQ ID NO: 28584 - protein, 131 aa, Zea mays
  misc_feature: Ceres CLONE 1402807-F
  misc_feature (22)..(90): Pfam Name: ubiquitin Pfam Description: Ubiquitin family
  misc_feature (28)..(28): Xaa is any aa, unknown, or other
  misc_feature (102)..(102): Xaa is any aa, unknown, or other
MGGGDADAGGEPADAQATLHIRCTNASXFTVRADLGATVGAFKAIVADSCDVPAPQQRLIYKGRILKDEQTLASYGVETDHTIHMVRGAVPSPTSTAPAANXEPTTAAPASSPATGLGWFVAKSGYYRRCC

SEQ ID NO: 28585 - DNA, 873 bp, Zea mays
  misc_feature: Ceres CLONE 1402810-R
  misc_feature: SWISSPROT Homolog: EC 3.4.23.1 Pepsin A
  misc_feature (873)..(873): n is a, c, t, g, unknown, or other
caattgtgtacgtggccccccctcgaggtcgacggtatcgatattcatgccctggaagccactgatgcagctcccctcgctctgcaggatgtaggcactgggtggcacggggtactggactccattgatggtgaagacgatgtcgggcaggctgctgatggctgagcagctgaccaccatgtcgccatctgagttctcgctggctccgatgtcgctctggatgttggcaatggggctggttgggccggtcagcagagaggtgccggtgtcaacaatggcctggcagccctcagcgcaggcgatggcctctccgttcatggtgatgctgtccacggtgatctgccagtaaccctcgacggtaacaggcacccagttcagacttccagtgtagtaagaagagtcaatgccaccaaagatcaccacgctgccactctggtcatcggcgctgaggtagacagagaagaggtcctgagaaaccaggccctggttccagatgttgtcaaagacgggtgtggccccggaggaggaaatgctggggtaggccagccccaggatgccctagaagggagcttaatacaggatggggccaggttccgtctcgctcaggccgaagaatctgattggtgtcagagatgcctccacccggaacagtgtcttttcccaaggatgccctgtcatgcctcccggtggccgtaaggggaaggaagactggcctccgctggtgggacggggaaggggggattctcccaattaaggatgttcctaagggaaatgggcctccgtgccgaaatctctggccgcccccgggtgggatcccactagttttctaagaggggtgcccgcgccccccgcgggggggaacttcccggtccn

SEQ ID NO: 28586 - DNA, 745 bp, Zea mays
  misc_feature: Ceres CLONE 1402810-F
  misc_feature: SWISSPROT Homolog: EC 3.4.23.1 Pepsin A
  misc_feature (392)..(392): n is a, c, t, g, unknown, or other
  misc_feature (393)..(393): n is a, c, t, g, unknown, or other
  misc_feature (412)..(412): n is a, c, t, g, unknown, or other
aaagctggagctcaccgcggtggcggccgctctagaactagtggatcccccgggctgcaggaattcgcacgagaccattacctagaacatcctaatcgaaaattcatctaccagctcaccagagggacagtctccatcacctacgctacccggcaggatgacagggatcctcgcatacgacactgaccatgccggagggattgctgacaccaatcggatcttccgcctgagtgagacgagaacctgcttccttactgtattatgctcacttctatgtgatcctggggctgacctaccgcagtatctactcctgcgtgcacacacgcgtctatgaccacagtctggaccagggcctaggtgtctcaggagctgttctctggctagctgaaagnncgatgacactagggcaaanatgaggaccttttttggatttgactctgcttactaacctgaaagcatgaactgggtgcttgtaccggcaaaggtaactggcagaaaaccgggtctggattcccgtgaacggctgggccttcaccctgccgtaaagggttgccaggcagttgttagaccccgttcccttttggggggaagggcccatccaacgccatttgcaaaaagtcaaaaagggaatttgaacccggggggaacttctagggacaccgggggggggattttttccaaaaaattaaaaggcggcgcggatatttttttttacaccaactctggggaaaaaatacccccgccc

SEQ ID NO: 28587 - DNA, 734 bp, Zea mays
  misc_feature: Ceres CLONE 1402811-F
  misc_feature: Encodes the peptide sequence at SEQ ID NO. 28588
  misc_feature (349)..(349): n is a, c, t, g, unknown, or other
  misc_feature (549)..(549): n is a, c, t, g, unknown, or other
tggagctccccgcggtggcggccgctctagaactagtggatcccccgggctgcaggaattcgcacgagaccattacctagaacatcctaatcgaaaaacagcgagtaccgagtaggagcaaccgcttgcgtcagacgcacactgacggagagtgatcactgatttctggtcatggcaaccgtaactgaggaagttgctccggtcgtcaccgtctccgaggagccggcgccggaagcggcgaaggaggtggtggagaagccggaggaggggaagaagcccgacgaggagggtgacgagagaaagaaggccgaccccgccgccgagaaggagaagaaggcgaggaagcggngctgcgagggatgcgctcgccggtggccgaagttggggctaagcttgggctgtgcacagtcgagaagacggaggcaaggccagtcactccatcacgctgtgcatgtcaccaagggcgcgcctcccaatctcgagcctagacttttcaacgagggttatggatttggcagcaggggaactcccccgagatgtgcctctggnaaaaagcttctttcttgccactatcatatttcaattttggattgaccatttatcgtcgcgttcctttgtcctcatcttttacctcttgtagtacacaagacaacttgattgtgcttaacagcaatcaatctgcagtctgatgacttgaatcaaggctcaggacctgtctctttttggcatgggcc

SEQ ID NO: 28588 - protein, 140 aa, Zea mays
  misc_feature: Ceres CLONE 1402811-F
  misc_feature (60)..(60): Xaa is any aa, unknown, or other
MATVTEEVAPVVTVSEEPAPEAAKEVVEKPEEGKKPDEEGDERKKADPAAEKEKKARKRXCEGCARRWPKLGLSLGCAQSRRRRQGQSLHHAVHVTKGAPPNLEPRLFNEGYGFGSRGTPPRCASGKKLLSCHYHISILD

SEQ ID NO: 28589 - DNA, 670 bp, Zea mays
  misc_feature: Ceres CLONE 1402812-F
  misc_feature: Encodes the peptide sequence at SEQ ID NO. 28590
  misc_feature (396)..(396): n is a, c, t, g, unknown, or other
  misc_feature (581)..(581): n is a, c, t, g, unknown, or other
  misc_feature (582)..(582): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (592)..(592): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (607)..(607): n is a, c, t, g, unknown, or other
  misc_feature (649)..(649): n is a, c, t, g, unknown, or other
ctggagctccccgcggtggcggccgctctagaactagtggatcccccgggctgcaggaattcgcacgagaccattaccaagaacatcctaatcgaaaacgccctccagaccgcacgcacgcacggcacgagctcgccgcgatgtcatggttcgctcgctccatcgctgccacactttcatctgcccactctgacgacgatgaatccgagcccgcctccggcgacaacagcccgccgcgcgcctccgaccccaccagcgccgagaccggtgagtccgatgagcagccggacaccccgagccgcggcgttaagggcgacatctcggagctgaccgagtccctcacccgccggttctggggtgtgcctttccctcctcgcgccaccgccactgaagagnaaaaccctgtaaaggggaggaggaggagacagccgccgccgcggaggtgcctcagtccccacggatcgacgggatccggagtgacctggcggagatcgggggcagggtgaagaccggcatctcgatgctgtcgaacgccggcgcggtggcggagatctccaggttcgcgtcatcgtcctgctcgnnccccnnnngnataacaggnnnnagnagaaaaagggcgaggcagtcgtgtgacgaggaaggtagtggntgttcgtcggtaacatctcaa

SEQ ID NO: 28590 - protein, 121 aa, Zea mays
  misc_feature: Ceres CLONE 1402812-F
  misc_feature (86)..(86): Xaa is any aa, unknown, or other
MSWFARSIAATLSSAHSDDDESEPASGDNSPPRASDPTSAETGESDEQPDTPSRGVKGDISELTESLTRRFWGVPFPPRATATEEXNPVKGRRRRQPPPRRCLSPHGSTGSGVTWRRSGAG

SEQ ID NO: 28591 - DNA, 763 bp, Zea mays
  misc_feature: Ceres CLONE 1402813-F
  misc_feature (26)..(26): n is a, c, t, g, unknown, or other
  misc_feature (35)..(35): n is a, c, t, g, unknown, or other
  misc_feature (38)..(38): n is a, c, t, g, unknown, or other
  misc_feature (48)..(48): n is a, c, t, g, unknown, or other
  misc_feature (50)..(50): n is a, c, t, g, unknown, or other
ggggggggggggggggggggaaaaanaaaaaaaanaanaagtgggggntnaaggtaaaatataagcaaaaaaagaactcaccgcggtggcggccgctctagaactagtggatcccccgggctgcaggaattcgcacgagaccattacctagaacatcctaatcgaaaatcgtctccactgctctgctgctcctcgcaccgccgccgccgccgccgcagcgacgtaatggcttccgccgcggtgctccggaacgccggctcccggcgcctcttctcctaccctactctccgcgccgctgcgatatatgtacctttctgcggctaccccggaatgcggccccggcggggggggggggcagtgcgccgggcccagccgcccaccggaaaggccgggaacctctcgggggggaggggccttaatggcccccccttttcggggggggaggcaaaaacccccccctggggaaaaaatggtcccccacaccccttttgggggggcacaccggcggggtaaacacagggggaaaaaaacaccacccccccccccccacgggtgggggggcaaataaaacaaaaaaaaggcccctctggggcccccgaagaggggcgggcggaaaaagggccccaaaaaacggcccggggtgttttttttctcttccccctaacatatccccccaataagaggggcctcccccgtgggtgaaaaaaaagacaccccccacaagaagaaaatccccccccttttggtggagacaacgctcccc

SEQ ID NO: 28592 - DNA, 714 bp, Zea mays
  misc_feature: Ceres CLONE 1402814-F
  misc_feature: Encodes the peptide sequence at SEQ ID NO. 28593
ggagctccccgcggtggcggccgctctagaactagtggatcccccgggctgcaggaattcgcacgagaccattacctagaacatcctaatcgaaaaatacttccggcgcggcggagatcgaatcgagcgcccgccacggcgatggcgactagagtcctgccgccggctctgctctctttcatactcctcctgctgctctcgctctcagcccgcgacaccgtcgccgcgggcgaggatttcccacgcgacgggcgggtgatcgacctcgacgacagcaatttcgaggcggcgctgggcgccatcgactttctcttcgtcgacttctacgccccttggtgcggccactgcaagagacttgcgcccgagttagatgaagctgcaccggtgttgtcaggggttgagtgagccctattgttgtttgccaagtcaacgctgataaatacagaaaactcggatcaaaatatggagtggatggggtcccctaccctcatgctcttttatccatggtgttcccatttgatacactgggtccgaggaaagctgaccaggcttgttcgcaatctggaagaagttcgtttccgccggatggttctatcctttgagccagattctgccataaagaaatttggttgagaatgctgggaaaaccttccaaaattcccttggttttggggggaaggccccttgattggtggggatggaaaagaaacacac

SEQ ID NO: 28593 - protein, 87 aa, Zea mays
  misc_feature: Ceres CLONE 1402814-F
  misc_feature: SWISSPROT Homolog: EC 5.3.4.1 Protein disulfide-isomerase
MATRVLPPALLSFILLLLLSLSARDTVAAGEDFPRDGRVIDLDDSNFEAALGAIDFLFVDFYAPWCGHCKRLAPELDEAAPVLSGVE

SEQ ID NO: 28594 - DNA, 655 bp, Zea mays
  misc_feature: Ceres CLONE 1402816-F
  misc_feature: Translation starting site: 199
  misc_feature (389)..(389): n is a, c, t, g, unknown, or other
  misc_feature (455)..(455): n is a, c, t, g, unknown, or other
  misc_feature (500)..(500): n is a, c, t, g, unknown, or other
tccccgcggtggcggccgctctagaactagtggatcccccgggctgcaggaattcgcacgagaccattacctagaacatcctaatcgaaaactacatcctcggtcagtgctcagtagtcatttgtgtccattgccgctctgctttgtgctcgctctgtttgtttgttgtcgactccattgacggccgctgatacttacatggttgatggttcagcgaacgagtgctgcgagaggctggcttactatggcatgagcaccaacctggtgaactacatgaagacccgacttggccaggtgaactccgttgcctccaacaacgtcaccaactggcaagggacgtgctacatcacgccgctcatcggcgccttcttcgccgacgcgtacatggngaggttctggaccatcgccatcttcatgatcatctacatttttcggcctggcgctgctgacgatgncttcgtcggtgaaggggctggtggctacgtcgtgcgccgacaggnatggtgtgccccccgacggaccgcccagcgggggtggtgttcgtggcgctttacctcatcccgctgggcaccggcgggaatcaagccgggggtgtccctccttcggggccaaacattttcaaaaaaaaaccacaagcgggaaaaaaaaaaacaaa

SEQ ID NO: 28595 - DNA, 700 bp, Zea mays
  misc_feature: Ceres CLONE 1402818-F
  misc_feature: Encodes the peptide sequence at SEQ ID NO. 28596
  misc_feature (412)..(412): n is a, c, t, g, unknown, or other
  misc_feature (452)..(452): n is a, c, t, g, unknown, or other
  misc_feature (453)..(453): n is a, c, t, g, unknown, or other
  misc_feature (550)..(550): n is a, c, t, g, unknown, or other
  misc_feature (572)..(572): n is a, c, t, g, unknown, or other
  misc_feature (573)..(573): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (619)..(619): n is a, c, t, g, unknown, or other
  misc_feature (620)..(620): n is a, c, t, g, unknown, or other
  misc_feature (622)..(622): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (656)..(656): n is a, c, t, g, unknown, or other
  misc_feature (681)..(681): n is a, c, t, g, unknown, or other
aaagctggagctccccgcggtggcggccgctctagaactagtggatcccccgggctgcaggaattcgcacgagaccattacctagaacatcctaatcgaaaactcactatatactcactcctgctgttttccgtccatccgcccaccggttcgcagcccgcgcctcaaaaccctagccccgggcggatcgcggggcgcctccgcggtgccagcgacgcggctcgtttgatccgattgttggtcgagccccgccctcgctgccgcgcttcgctccggctgtgcagcggcgtgagcaccgagcacactcgcgaatggggaactgctggggtgcgcggatcaaggatgggagccctcaccctggcgcctcaggaatgttctcaaagagtagtggcaaggatgggagtaggcttancggctgtagtagtcgagcctcttcagcttctatgccaccnngcgcgaagactgaatgcgaaatcctgcaatccgccaatgttaagattttcactttcaataatctcaagggagccccaaaggaatttccgtcccggangtgttctaggtgaaggaggttnnggatttcttattcttggaggnnnagcaagccgacattttatctttnntntttnnnctgcgctnnnnnccccatatttttgtangataaaaaaccaatatagaatacgnaggttatgtaaactcatct

SEQ ID NO: 28596 - protein, 83 aa, Zea mays
  misc_feature: Ceres CLONE 1402818-F
  misc_feature: SWISSPROT Homolog: EC 2.7.11.1 Non-specific serine/threonine protein kinase
  misc_feature (34)..(34): Xaa is any aa, unknown, or other
  misc_feature (48)..(48): Xaa is any aa, unknown, or other
  misc_feature (80)..(80): Xaa is any aa, unknown, or other
MGNCWGARIKDGSPHPGASGMFSKSSGKDGSRLXGCSSRASSASMPPXAKTECEILQSANVKIFTFNNLKGAPKEFPSRXCSR

SEQ ID NO: 28597 - DNA, 704 bp, Zea mays
  misc_feature: Ceres CLONE 1402826-F
  misc_feature: SWISSPROT Homolog: EC 1.11.1.7 Peroxidase
  misc_feature (232)..(232): n is a, c, t, g, unknown, or other
  misc_feature (665)..(665): n is a, c, t, g, unknown, or other
tggagctccccgcggtggcggccgctctagaactagtggatcccccgggctgcaggaattcgcacgagaccattacctagaaatcctaatcgaaaaacgatacaaaacacaagctctcgggggacagagaagtagcgcagctagatccagcgctcggcgccagagacacccgacatcctcgtcatgtctccggttgcaatcaagggagtagtgatggacggtgctgtggcgngtggcggcagtggccgccgccgtggtgctgtgcctccatctgccggcggtggcgcgcggacagctggcaggtggggttctacaacacgagctgccccaacccgagtccctgtcccgccagggcggtggcgagcgccttcgccaacgactccggcatcgccgccggcctcatccgcctccatttccacgactgcttcgtcaggtgctgcgacgcatcggtgctgctcacctccgccaacaacacggaggagcgcgacgcgccgcccaacaacccaggcctccacggattccaggtgatcaacgcgggaaatgcggcggtggagcagagctgcccgcaaacggtgtcgtgcgcggacatcgtagcccttcgcggcgcgcgacagcatcaacctcacgggcaacctgccgtaccaggtgccctcgggccgccgggnacggtcacgtctccctggacacggaggtcaacagtcacc

SEQ ID NO: 28598 - DNA, 643 bp, Zea mays
  misc_feature: Ceres CLONE 1402830-F
  misc_feature: Encodes the peptide sequence at SEQ ID NO. 28599
aaagctggagctccccgcggtggcggccgctctagaactagtggatcccccgggctgcaggaattcgcacgagaccattacctagaacatcctaatcgaaaaaagttcgggagggactccatttttcttctgacgttcaccccgagtgggcgaccgccgccgccgccgccgccccacgccaggtgcacagatcttcgtcgggcccttggccggcgacgaacgcccagcagattatcgggtatacatgcgcacaaccatgtcctttaccgggtccgcccctgccaatgatccctgcctcgccaagatcctgtccaagcaaggggacaacaaagttctctttgcggacaaggtattaaagttcacccaatctggaaagatgaagagacgcatcctagtgatcacagactttgctctataccttgttgaccccgaggccaacatattgaagaggacgatagcccttgcagctgtggataagctatgcattagcaacctcagtgataacgtctttgcgatcattgtgcggactgagtacgattgtttaatggcagcactagaaagaggaaattgttgatgtcatttggtaggctatcaagagcacatctgagtatgaacctgaggtgccttcctctaacagtttggg

SEQ ID NO: 28599 - protein, 105 aa, Zea mays
  misc_feature: Ceres CLONE 1402830-F
MSFTGSAPANDPCLAKILSKQGDNKVLFADKVLKFTQSGKMKRRILVITDFALYLVDPEANILKRTIALAAVDKLCISNLSDNVFAIIVRTEYDCLMAALERGNC

SEQ ID NO: 28600 - DNA, 777 bp, Zea mays
  misc_feature: Ceres CLONE 1402832-F
acagctggagctccccgcggtggcggccgctctatacctagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtctacggcctcccgccggggcctccggattgtccggcgacggggcacctccccccccttgagcggggtggcggggccccttccgtacgcgtctgcgcgcgcccccctgacaatacccgttcccccctcctccgccctcacccggatagctccatcggcactcggggcaccctcggggcaacctcctcccggaggaatcctcgcgacatgacgcggcaccttcgtccccgacccgcgccccaagacaatttccaccgccaccgtcctgccggccccggacgctaccttatcccccccccacctaacctcccccgactaaacgctttttgggttctcatactcacttccccctactcccatgcccaaccgggcgcgctcgaaaaagtacatcgtatatggagccctccccagcgccccatcccgacatcgctccctctctcttctccagccccttctccctgcc

SEQ ID NO: 28601 - DNA, 723 bp, Zea mays
  misc_feature: Ceres CLONE 1402839-F
  misc_feature: Encodes the peptide sequence at SEQ ID NO. 28602
  misc_feature (452)..(452): n is a, c, t, g, unknown, or other
  misc_feature (558)..(558): n is a, c, t, g, unknown, or other
  misc_feature (559)..(559): n is a, c, t, g, unknown, or other
  misc_feature (671)..(671): n is a, c, t, g, unknown, or other
aaagctggagctccccgcggtggcggccgctctagaactagtggatcccccgggctgcaggaattcgcacgagaccattacctagaacatcctaatcgaaaaacgccgcgctcgcggtgctgcctcccgggctcccgttccagcattccaggctcgcatcgcacagcctggccccgcccgctccgacccttctcggcgacactcctcgtaggctcgtactggcacgtccccgctctgtcttctgcccaccaggcaccagcgggtccacgcttcctagggttccaaactctcggcggcgcaagcaatggcggcgcggggccgggagctctggtagtttcgcatatcgcggcggcttgttgccacctcgccatcgcagattatggggatcaacggcgaggagtgggaggagacggtactgggcgacggcgttgggaggcggaagggtggtgtgnaggctttccggtttggtcgcatcatcctcctttgctgaggggaatggggggaatcccgtgctgaggtctatggacgccggttcttccggatcggtcgacgacgatnnagttatatgtctcgtctcggcagccagtatttggccatagtaaatcgacagctactacttctggtaccattaaaggcaagataaacgtttttttgtagatctactcctgaangggttgctggaagtgtgacctcactttggatatgctatcagaaaatgagaaa

SEQ ID NO: 28602 - protein, 36 aa, Zea mays
  misc_feature: Ceres CLONE 1402839-F
  misc_feature (25)..(25): Xaa is any aa, unknown, or other
MGINGEEWEETVLGDGVGRRKGGVXAFRFGRIILLC

SEQ ID NO: 28603 - DNA, 700 bp, Zea mays
  misc_feature: Ceres CLONE 1402843-F
  misc_feature: Translation starting site: 439
  misc_feature: SWISSPROT Homolog: EC 1.8.1.7 Glutathione-disulfide reductase
  misc_feature (606)..(606): n is a, c, t, g, unknown, or other
  misc_feature (629)..(629): n is a, c, t, g, unknown, or other
  misc_feature (630)..(630): n is a, c, t, g, unknown, or other
  misc_feature (655)..(655): n is a, c, t, g, unknown, or other
  misc_feature (671)..(671): n is a, c, t, g, unknown, or other
aaagctggagctccccgcggtggcggccgctctagaactagtggatcccccgggcttgcaggaattcgcacgagaccatttacctagaacatcctaatcgaaaaggggcagagctggcaagtggcaaggctgcgcagccgcagagggactttttgtgtaaaatgcggtgggaaggtgcgctgcacctgcaagcagaggtgtgctctactgacagagtttgaactctcaagaggaggcgaggcagaaccgcaatcgcgaccgcgacccgcaggtgacatacatacggtgcgagcgccggaagccggaagcaccggtgacgaagccttccgtgtcattcactcatcaggatcttcagggttttgtttcgtttcgcgggcgttgggaatccatccttggcgaggaagatgctcatcgacggggaggtggcggccgtcgcggatggtgggcactattgactacgatctcttcgtcattcgggcgggcaagcggcggcgttcgcggctctcgcaccgccccctccttcggagctaaggttgcgatttgtgagcttcccatttccaccccatcagctcagagtggctaggaggacatggtgggacttgcggntgatacgtggttgcgtacctaannaagatactcgtgtatggtgcatcanttctgtggagaatttngagattcgaagaattttttgggtgggaga

SEQ ID NO: 28604 - DNA, 669 bp, Zea mays
  misc_feature: Ceres CLONE 1402844-F
  misc_feature: Encodes the peptide sequence at SEQ ID NO. 28605
  misc_feature (451)..(451): n is a, c, t, g, unknown, or other
aaagctggagctccccgcggtggcggccgctctagaactagtggatcccccgggctgcaggaattcgcacgagaccattacctagaacatcctaatcgaaaagaatacaccacccctcgtctccccacggaggccgtcctctcctctcctctgcgtccgccactgcccaccgctcgcccgcgcgcgctccattacctcggcgggcgatggccgacctatccaacaccggctccacctaacacgagcagcgcccccgcctaggcggcagctggctggtcggtcgtcgagcagctagcggcggcagcgcccggagggaggccgtctcactctcctcgtcggggcggcaggagatggaggcatcgtgggcgtccgcgcgccgccgcgtggccgtgcctgggccggcctcgagaagccgccgcgcgccgcttgccgcgccagagtcccgacgggnaggctcgcggtcgcggcggacaggccgcggaggctggtgctgctgggcgccgatacgcggagggccgcggatcctgccctccgttgcgccgcgcaatctgcaggtggaacaggaaaggtccactactctgctgatgacgctctcatactacaggttaggaaaatatgcaccaccccacccccacccaataggaactgatgaattgctaatttctttgt

SEQ ID NO: 28605 - protein, 106 aa, Zea mays
  misc_feature: Ceres CLONE 1402844-F
  misc_feature (34)..(34): Xaa is any aa, unknown, or other
MEASWASARRRVAVPGPASRSRRAPLAAPESRRXGSRSRRTGRGGWCCWAPIRGGPRILPSVAPRNLQVEQERSTTLLMTLSYYRLGKYAPPHPHPIGTDELLISL

SEQ ID NO: 28606 - DNA, 675 bp, Zea mays
  misc_feature: Ceres CLONE 1402845-F
  misc_feature: Encodes the peptide sequence at SEQ ID NO. 28607
  misc_feature (547)..(547): n is a, c, t, g, unknown, or other
  misc_feature (641)..(641): n is a, c, t, g, unknown, or other
  misc_feature (664)..(664): n is a, c, t, g, unknown, or other
aagctggagctccccgcggtggcggccgctctagaactagtggatcccccgggctgcaggaattcgcacgagaccattacctagaacatcctaatcgaaaaaacacaacaatctctctcccctcactccctctctgcagcgcgcagctttcaaagcgttgggagagatggcagaggagacgcaaccagaggccgcagccgccgccgcgcccgccgcggccgaggtagtcgtgaccgaagctgcgccggcggaggcggaggtgcctgcggcggcggaagctgaagccgaggccaaggatgagaagaaaggtgacgaggcggagctcaccgccgatgacgcgggggtggggaccggctcgttcaaggaggaaagcaacctggtggaagacctgcccgacccggagaagaaggcgctcgacgagttcaagcagctgatcgctgctgccctcgccgccggtgagttcaacctgcctcccccgccgccgccgccgaaggccaaggaaacaaaggtggaggaagccaaggcccaggtggctgcggatgccccnggttgaggaggtcaagacggaggtgccgccggccgaggaggccaaggctgagacacgggctgaggaagccaagccttccgagcccgagccgcangagaagaactgtcgtggtcactngaggaggagat

SEQ ID NO: 28607 - protein, 128 aa, Zea mays
  misc_feature: Ceres CLONE 1402845-F
MAEETQPEAAAAAAPAAAEVVVTEAAPAEAEVPAAAEAEAEAKDEKKGDEAELTADDAGVGTGSFKEESNLVEDLPDPEKKALDEFKQLIAAALAAGEFNLPPPPPPPKAKETKVEEAKAQVAADAPG

SEQ ID NO: 28608 - DNA, 674 bp, Zea mays
  misc_feature: Ceres CLONE 1402853-F
  misc_feature: Encodes the peptide sequence at SEQ ID NO. 28609
  misc_feature (389)..(389): n is a, c, t, g, unknown, or other
  misc_feature (480)..(480): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (506)..(506): n is a, c, t, g, unknown, or other
  misc_feature (507)..(507): n is a, c, t, g, unknown, or other
  misc_feature (535)..(535): n is a, c, t, g, unknown, or other
  misc_feature (536)..(536): n is a, c, t, g, unknown, or other
tccccgcggtggcggccgctctagaactagtggatcccccgggctgcaggaattcgcacgagaccattacctagaacatcctaatcgaaaaaaaaagctggcagtgtcggtgtcggtgtcgtcgtcggcgtcggtgctggggagcgggcgagcggcgcgtcgcatgattctgtcctcctgacgtggcagctaacgattccgattccctttggttgcagtgcgacgacattgacatggacatggcgcagctggagtggctgtcggggctcttcgacgacgcatccatcccgcacgagccggcgttccccggcgcggcgcccatcatcaagagctccgcgctggcggccggcgcgctgctgccgccggacaaagatggggggacgcgctgnctgttccgcagctccagcccccatctcgggtgctggagcacggcagcttcaacacgccaacgggcgggtggcggcgctgctccgccgtccntcggagcnnntcctcgggcgcccccnntccctgggagtctttctccggaagcggnnaggcgcgaagggccttggggtgggtcccgcgccccgggtccccccccacccgggttcgtattaccgggggggggcgggggaaaaagggctcccggcccggccgggttcaagggggggcggggggggggaggcgccccc

SEQ ID NO: 28609 - protein, 147 aa, Zea mays
  misc_feature: Ceres CLONE 1402853-F
  misc_feature (52)..(52): Xaa is any aa, unknown, or other
  misc_feature (83)..(83): Xaa is any aa, unknown, or other
  misc_feature (86)..(86): Xaa is any aa, unknown, or other
  misc_feature (92)..(92): Xaa is any aa, unknown, or other
  misc_feature (101)..(101): Xaa is any aa, unknown, or other
MDMAQLEWLSGLFDDASIPHEPAFPGAAPIIKSSALAAGALLPPDKDGGTRXLFRSSSPHLGCWSTAASTRQRAGGGAAPPSXGAXPRAPPXPGSLSPEAXRREGPWGGSRAPGPPPPGFVLPGGGGGKRAPGPAGFKGGRGGGGAP

SEQ ID NO: 28610 - DNA, 642 bp, Zea mays
  misc_feature: Ceres CLONE 1402857-F
  misc_feature (241)..(241): n is a, c, t, g, unknown, or other
  misc_feature (292)..(292): n is a, c, t, g, unknown, or other
  misc_feature (387)..(387): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
tacccgcggtggcggccgctctagaactagtggatcccccgggctgcaggaattcgcacgagaccattacctagaacatcctaatcaaaaaaccggagagatctgggtctgggccattccctcgctccttcccgtgaaccacaaacctaacgcggagcggcgcgggccggccgccgggcgaggtgcgcgtagctgccgtcgattgtcgccggatccatccaccatgggcggtggcaacggncagaagtccaagatggcccgcgagcgcaacttggagaagacaggggggccnaggggagccagctcgagaccaacagaaggccatgagcatccagtgcaagtgtgcatgcaaccatcatgtgtacacgacggaaatgagtgccgagnaacgcaggcagttttccccaaagaaaggnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28611 - DNA, 607 bp, Zea mays
  misc_feature: Ceres CLONE 1402859-F
  misc_feature: Encodes the peptide sequence at SEQ ID NO. 28612
  misc_feature (384)..(384): n is a, c, t, g, unknown, or other
tcaccgcggtggcggccgctctagaactagtggatcccccgggctgcaggaattcgcacgagaccattacctagaacatcctaatcgaaaacgctcgtggccaccgatttcactggcttcatttcgaatcataaatttcatctactggagtttgctttgcttgctcctggaatcttcggaaccgaaggccaccgcgccaaccgcccaattaccgaaccaaaccctaccggtcgcggctcctccatagtccatactctcgcgcgcctaaaccctagccatcctcctcgccgccggcgaccgccgccatgagccgctacgacggccgcgctgcggacgcgggctcctaccgcgaccgccgcagcgagggggcgttccggaagcggntccagggcgttctcggcgccgagcagggcggacgcttccgcggcggcctcgaagctggatggccttgcccccttcaaaaagaacttctacgtggagccacccgggggggcccgcatggaggaagaaaaagggggaggcttaccggccccccccgggaaattaccctccaaaggccgcaaaatggcccaaaccgggggttttggattcccggggaagggggcct

SEQ ID NO: 28612 - protein, 100 aa, Zea mays
  misc_feature: Ceres CLONE 1402859-F
  misc_feature (27)..(27): Xaa is any aa, unknown, or other
MSRYDGRAADAGSYRDRRSEGAFRKRXQGVLGAEQGGRFRGGLEAGWPCPLQKELLRGATRGGPHGGRKRGRLTGPPREITLQRPQNGPNRGFWIPGEGG

SEQ ID NO: 28613 - DNA, 672 bp, Zea mays
  misc_feature: Ceres CLONE 1402860-F
  misc_feature: Encodes the peptide sequence at SEQ ID NO. 28614
  misc_feature (274)..(274): n is a, c, t, g, unknown, or other
  misc_feature (454)..(454): n is a, c, t, g, unknown, or other
  misc_feature (669)..(669): n is a, c, t, g, unknown, or other
gctggagctccccgcggtggcggccgctctagaactagtggatcccccgggctgcaggaattcgcacgagaccattacctagaacatcctaatcgaaaagagcctcgcaggagggagaggggggagagcggaggagaaaccacctttctttccgttccagacaagctcccagctttgaccgccgccgccgccgccgctgtgtgtgtgtgctcccttagtagttagtccctgtcgcgtcccggatcggagctcccctccgtgcacgggacaccgnccggtccgggcgtctccactcccccccggatcgatcagctccgcctccgcaagataggcaagcaatgaggtgcctgcctttcttgcatggagacaccaaagagaaggatccagtcactaagtcggcctctctacggtccatgagcacaacatcaacgggagcgcgatgtcccgctccggntcagacttcaccctccttgaatgtttccgacatgagcgccgagtccataagggaggacgcagtaccccagctttcctgaccgcccgtctaaccctgaaggtgttctcctttgctgaactgaagaaggtcacccgcaacttcaggcggtctcttctggatggggaggttggctttggctgggggaacaggggggcatcaagacctccgagaaccgnacg

SEQ ID NO: 28614 - protein, 64 aa, Zea mays
  misc_feature: Ceres CLONE 1402860-F
  misc_feature (39)..(39): Xaa is any aa, unknown, or other
MRCLPFLHGDTKEKDPVTKSASLRSMSTTSTGARCPAPXQTSPSLNVSDMSAESIREDAVPQLS

SEQ ID NO: 28615 - DNA, 676 bp, Zea mays
  misc_feature: Ceres CLONE 1402862-F
  misc_feature: Encodes the peptide sequence at SEQ ID NO. 28616
  misc_feature (551)..(551): n is a, c, t, g, unknown, or other
  misc_feature (555)..(555): n is a, c, t, g, unknown, or other
  misc_feature (584)..(584): n is a, c, t, g, unknown, or other
  misc_feature (585)..(585): n is a, c, t, g, unknown, or other
  misc_feature (599)..(599): n is a, c, t, g, unknown, or other
  misc_feature (637)..(637): n is a, c, t, g, unknown, or other
tccccgcggtggcggccgctctagaactagtggatcccccgggctgcaggaattcgcacgagaccattacctagaacatcctaatcgaaaaattattacaaccgaccaacgcgctttgtaacgcctccgctgcaatcagcccccgcggcgagcttgccctgcccctgaccctgagtgctagttctcgccgttacgtaaggcttcttggccttgcgtcctccgtctttcgttgctgatacatcgaggtattaaagaagctgcctgattccgggtagcagaggtcgccgccgcctgcagcaatggccgacttctcctggctcacggtgcttggtttcctattcctcacattcaactcaggcatggcgatttatcggtccaacggtgacgccggctccgtcgctttcgtcgtggtatcttatctcgacctggtggccctgttcgcctgcttgcgctactacgagcagttggatcagcagcactcccaaaagcgcgcgagggcaaggggttgggggtttggaggctcacgaccctccttactaatcatgttcagntacnagggtgggttgagattatgcccctgcagnnaaaactttgttgtncttgggccaatggcagccgctaacaccctgggggcggntttctaccgttttcttcgtccacaggggagaaggctgtg

SEQ ID NO: 28616 - protein, 125 aa, Zea mays
  misc_feature: Ceres CLONE 1402862-F
  misc_feature (84)..(84): Xaa is any aa, unknown, or other
  misc_feature (86)..(86): Xaa is any aa, unknown, or other
  misc_feature (95)..(95): Xaa is any aa, unknown, or other
  misc_feature (96)..(96): Xaa is any aa, unknown, or other
  misc_feature (113)..(113): Xaa is any aa, unknown, or other
MADFSWLTVLGFLFLTFNSGMAIYRSNGDAGSVAFVVVSYLDLVALFACLRYYEQLDQQHSQKRARARGWGFGGSRPSLLIMFXYXGGLRLCPCXXNFVVLGPMAAANTLGAXFYRFLRPQGRRL

SEQ ID NO: 28617 - DNA, 682 bp, Zea mays
  misc_feature: Ceres CLONE 1402865-F
  misc_feature (215)..(215): n is a, c, t, g, unknown, or other
acccgcggtggcggccgctctagaactagtggatcccccgggctgcaggaattcgcacgagaccattacctagaacatcctaatcaaaaaagaaatcgcatcgccgtcgcgtcgtcgtcgatctccccgccccgccccgcccgcgccgcggaatctgacacatctccctaatctctcctaggaccgggtgcccttacatccacgccgcaacgcanatcgccgtccgagccctcgcggtctctcgtctccccgtgcgagaggacgccggcagcagcggcgtgccagtgcggtggcttggtgggggaagaccggaggcggcggcagagctcgcgcccagaggtgcacggcaggcctgttctcggcgtccgctgggggaaggcgagtagccccgggaaagacgagtgaataatcatgagctcgatctgccctttcgcggaagccacacctggtggggggtgtatgccctgtgaaatctgataagagcaaccactggggtgggccctgccaaatctgacaagagcaatcagtgggggtatgccctggcactgggaaaggatccatggaaccagcctcaagggaaaaggggtgattcttgggggaagaaaaagggcacccgattccctcggggtcgtaaccagcaaaaatggccatttcggcttataactcccacacttttccaggg

SEQ ID NO: 28618 - DNA, 661 bp, Zea mays
  misc_feature: Ceres CLONE 1402867-F
  misc_feature (268)..(268): n is a, c, t, g, unknown, or other
  misc_feature (303)..(303): n is a, c, t, g, unknown, or other
  misc_feature (314)..(314): n is a, c, t, g, unknown, or other
  misc_feature (316)..(316): n is a, c, t, g, unknown, or other
  misc_feature (317)..(317): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (338)..(338): n is a, c, t, g, unknown, or other
  misc_feature (344)..(344): n is a, c, t, g, unknown, or other
  misc_feature (350)..(350): n is a, c, t, g, unknown, or other
  misc_feature (385)..(385): n is a, c, t, g, unknown, or other
  misc_feature (386)..(386): n is a, c, t, g, unknown, or other
  misc_feature (388)..(388): n is a, c, t, g, unknown, or other
  misc_feature (389)..(389): n is a, c, t, g, unknown, or other
  misc_feature (394)..(394): n is a, c, t, g, unknown, or other
  misc_feature (398)..(398): n is a, c, t, g, unknown, or other
  misc_feature (402)..(402): n is a, c, t, g, unknown, or other
  misc_feature (407)..(407): n is a, c, t, g, unknown, or other
  misc_feature (417)..(417): n is a, c, t, g, unknown, or other
  misc_feature (423)..(423): n is a, c, t, g, unknown, or other
  misc_feature (439)..(439): n is a, c, t, g, unknown, or other
  misc_feature (449)..(449): n is a, c, t, g, unknown, or other
  misc_feature (450)..(450): n is a, c, t, g, unknown, or other
  misc_feature (457)..(457): n is a, c, t, g, unknown, or other
  misc_feature (461)..(461): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (467)..(467): n is a, c, t, g, unknown, or other
  misc_feature (471)..(471): n is a, c, t, g, unknown, or other
  misc_feature (474)..(474): n is a, c, t, g, unknown, or other
  misc_feature (507)..(507): n is a, c, t, g, unknown, or other
  misc_feature (515)..(515): n is a, c, t, g, unknown, or other
  misc_feature (516)..(516): n is a, c, t, g, unknown, or other
  misc_feature (523)..(523): n is a, c, t, g, unknown, or other
  misc_feature (527)..(527): n is a, c, t, g, unknown, or other
  misc_feature (528)..(528): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (544)..(544): n is a, c, t, g, unknown, or other
  misc_feature (555)..(555): n is a, c, t, g, unknown, or other
  misc_feature (556)..(556): n is a, c, t, g, unknown, or other
  misc_feature (558)..(558): n is a, c, t, g, unknown, or other
  misc_feature (560)..(560): n is a, c, t, g, unknown, or other
  misc_feature (576)..(576): n is a, c, t, g, unknown, or other
  misc_feature (577)..(577): n is a, c, t, g, unknown, or other
  misc_feature (582)..(582): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (591)..(591): n is a, c, t, g, unknown, or other
  misc_feature (593)..(593): n is a, c, t, g, unknown, or other
  misc_feature (602)..(602): n is a, c, t, g, unknown, or other
  misc_feature (608)..(608): n is a, c, t, g, unknown, or other
  misc_feature (609)..(609): n is a, c, t, g, unknown, or other
  misc_feature (639)..(639): n is a, c, t, g, unknown, or other
  misc_feature (640)..(640): n is a, c, t, g, unknown, or other
  misc_feature (644)..(644): n is a, c, t, g, unknown, or other
  misc_feature (647)..(647): n is a, c, t, g, unknown, or other
  misc_feature (656)..(656): n is a, c, t, g, unknown, or other
ggagctccccgcggtggcggccgctctagaactagtggatcccccgggctgcaggaattcgcacgagaccattacctagaacatcctaatcgaaaaatccatcacagctagctagcatacagacgaataatctcttcttcacctcactaacaccagctagcaactctttctctcctgcaataatggccgctcgctcctcctcctccagccgcagctgggtcgcggcggcggcggtcctgggcagcggcgctgctgctgctggcggcgngggcccgggacggcgtcggcggcggggagctgcgncgaggtgacgncnncnnnggcgccgggcctcggcnacgcgnggggcngcggggcgccccccccccccgcgcggccgggcggnngnnccccnccgncgcncccgnccgggggggnggggcnccggcggggccccggncccggggggnncccccgngggncnnngnggcnggngcggcggggccccggcggggcgggggggccccncccccccnnggggggngggnncggggggnnngccggncccggcccccnngngnggccccggggggggcnncgggncnnngggcncnggggggccncccgcnncccggggggggggggcgggccccccccgcnngggncgnggggggccnccccg

SEQ ID NO: 28619 - DNA, 679 bp, Zea mays
  misc_feature: Ceres CLONE 1402871-F
  misc_feature: Translation starting site: 126
  misc_feature: SWISSPROT Homolog: EC 5.3.4.1 Protein disulfide-isomerase
  misc_feature (295)..(295): n is a, c, t, g, unknown, or other
cgcggtggcggccgctctagaactagtggatcccccgggctgcaggaattcgcacgagaccattacctagaacatcctaatcgaaaaagaagacttcccttcgtctgcttcccagagacccagccatggcgatctcccagatctcacgcatattcctggccatccttctcctggccgccgccttcgccgccgccccagctgcgcttgcggacggcgacgacgtggtggcccttaccgaatccacgttcgagaaggaggtcggaaaggaccgcggcgccctcgtcgagttctacgnccccctggtgtggtcactgcaagaagcttgctcctgagtatgaaagacttggtgcaagttttaagaaagctaaatctgtcttgattgctaaggttgattgtgatggagcacaagagtttgtgcagaaagtaatggagtttccgggtatccaccaatccaatggttcccgaaaaggatccttggagcccaaaaaagtatgaaggacaacgcactgcagaagccccttgctgaaatttctcaatactgaaggaggcacaaaatgtaaagctgcacattccttccaagaggggggggggggggttcctcaccccagaggacttttgactcatttgggccttgatgaaaacaaagatggggccccttgggtggagtctaggccccccc

SEQ ID NO: 28620 - DNA, 652 bp, Zea mays
  misc_feature: Ceres CLONE 1402872-F
  misc_feature: Translation starting site: 163
  misc_feature: SWISSPROT Homolog: EC 2.4.1.13 Sucrose synthase
  misc_feature (403)..(403): n is a, c, t, g, unknown, or other
  misc_feature (589)..(589): n is a, c, t, g, unknown, or other
ggagctccccgcggtggcggccgctctagaactagtggatcccccgggctgcaggaattcgcacgagaccattacctagaacatcctaatcgaaaactccctccctcctccattggactgcttgctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgcccctgttgatagggacaaggagaagtatgcacccttttgagacattcttcgtgctgctcaggaagcaattgtgctccccccatggntgcacttgctattcaggcaaggcctggtgtctgggattacattccggtggattgaaatgagctggctgggaaggaactgaatggttctgagtacttgcattcaaggaaaagttgtggatggaaatccaaaagaactttggggttgagtttgatttgagcccttaaagggcccctttcccggctttnaagggggaaagccctgggaaaaggggggggaattcttaaaccaacccggggcgcccaaagtgt

SEQ ID NO: 28621 - DNA, 603 bp, Zea mays
  misc_feature: Ceres CLONE 1402875-F
  misc_feature: Translation starting site: 318
  misc_feature (394)..(394): n is a, c, t, g, unknown, or other
tccccgcggtggcggccgctctagaactagtggatcccccgggctgcaggaattcgcacgagaccattacctagaacatcctaatcgaaaacccctccctcccctccagcgctccagctcccctccatcctcggccaaaaattctgcggcgagctccgatccggtccgactactaacccacgccgcagaagccgcgcgacctgatcgcgcgggggtcgaggagaggggaagcgcggcgccgcggttgcctgccaccgtaccgccgcaggagaaggaagaggagcccgtatccctccgccccgctgcccgccggaccgatggactccgagcactggatctcgcgcctggccgccgcgaagcgcttctacgcggctcagctcggccacagcgatcngggccgggatggacgagctggagagggacgaagggaggtcaggcccgagttcccctgcccctactgctacagggacccacgacgtcggatccctctgcgggcaccctggaggaggagcacccgttcgaaccccaagccgcggcctgccctgctggctcagagatgggttaccgaaaggatatggttaaccatattactacgcaacatgg

SEQ ID NO: 28622 - DNA, 666 bp, Zea mays
  misc_feature: Ceres CLONE 1402880-F
  misc_feature: Encodes the peptide sequence at SEQ ID NO. 28623
  misc_feature (529)..(529): n is a, c, t, g, unknown, or other
ccccgcggtggcggccgctctagaactagtggatcccccgggctgcaggaattcgcacgagaccattacctagaacatcctaatcgaaaagggagtcggcactcgggtctcgacgtctcgtctcgtctcgtctcgcctgcccgcagccccttggcttcgttccatccggcttctccggcggcggcggagaggagggggatggcgcaccggctgctgcgggacgcgcaggcggacgggtgggagcggtcggacttccccatcatctgcgagtcatgcctcggcgacaacccctacgtccggatgttaagagctgaatatgacgaagaatgcaaaatttgtgcacgtccttttactgtatttccggtggcgtcctgggcgagatgcaaggtacaagaagactgagatctgccagacatgttgcaagctaaagaatgtctgccaggtctggcctgctggatcttgaatatgggctggccctgttcaaggtccgagatacagcactctctatcaattccaatgatgaattccnaaggggagtgatgtcaatcgcgaatattttgcagaagagatgggataggaggggccagagctggcatagactatgattcatccctatgggaaggctcgcccaaatgataccattctggaagcttcaaaggacagcac

SEQ ID NO: 28623 - protein, 67 aa, Zea mays
  misc_feature: Ceres CLONE 1402880-F
MAHRLLRDAQADGWERSDFPIICESCLGDNPYVRMLRAEYDEECKICARPFTVFPVASWARCKVQED

SEQ ID NO: 28624 - DNA, 601 bp, Zea mays
  misc_feature: Ceres CLONE 1402882-F
  misc_feature: Encodes the peptide sequence at SEQ ID NO. 28625
  misc_feature (152)..(152): n is a, c, t, g, unknown, or other
  misc_feature (258)..(258): n is a, c, t, g, unknown, or other
  misc_feature (301)..(301): n is a, c, t, g, unknown, or other
  misc_feature (340)..(340): n is a, c, t, g, unknown, or other
ggagctccccgcggtggcggccgctctagaactagtggatcccccgggctgcaggaattcgcacgagaccattacctagaacatcctaatcgaaaaacctcctatggccaccgtcgactgccccctgccctctcccgcggacctcgacgacnacggattcccggctctaccctcatcccccgctgcctgtagcagcggcttcgcggaggacttctaccgcagcggcaccgactggtcctccttacgcgcccctcccgnccgctgggccgcccagaaggcaccccggtgtgaaagaaaaaangaagcggcttccgccggtgcagagcagcctcttccaggncgtggggggatcgagaagacgcggcgggacccggcggggggggctgaatccatcgcttggggcaaaggagcctcttcagggattggggggatcgagagacgcaaaaaggggggggcccccgggggttgggaaaattcttccccctctctccccctttttgggggttttttgtgggcaaaggaaaaggaggggaaggaaaccaccgggaggagaggagggggggggggggaaaaaaaaccccctgggggggcccttttaaag

SEQ ID NO: 28625 - protein, 166 aa, Zea mays
  misc_feature: Ceres CLONE 1402882-F
  misc_feature (17)..(17): Xaa is any aa, unknown, or other
  misc_feature (52)..(52): Xaa is any aa, unknown, or other
  misc_feature (66)..(66): Xaa is any aa, unknown, or other
MATVDCPLPSPADLDDXGFPALPSSPAACSSGFAEDFYRSGTDWSSLRAPPXRWAAQKAPRCERKXEAASAGAEQPLPGRGGIEKTRRDPAGGAESIAWGKGASSGIGGIERRKKGGAPGGWENSSPSLPLFGGFLWAKEKEGKETTGRRGGGGGEKKPPGGALLK

SEQ ID NO: 28626 - DNA, 621 bp, Zea mays
  misc_feature: Ceres CLONE 1402885-F
  misc_feature: Encodes the peptide sequence at SEQ ID NO. 28627
  misc_feature (252)..(252): n is a, c, t, g, unknown, or other
  misc_feature (285)..(285): n is a, c, t, g, unknown, or other
  misc_feature (288)..(288): n is a, c, t, g, unknown, or other
  misc_feature (306)..(306): n is a, c, t, g, unknown, or other
  misc_feature (333)..(333): n is a, c, t, g, unknown, or other
cgcggtggcggccgctctagaactagtggatcccccgggctgcaggaattcgcacgagaccattacctagaacatcctaatcgaaaattctcttgatcgctttgtcacttgaatccgtgcctgctctaacagagagcggatcagcggagacacgacgacgacgacgaagccaggctcaggctctgcaatggagcaggagccgcaccggcccatggagctgccccccgggcttccgcttcaccccgacgacgnagagctcatcacgcactacctggcccgcaaggncgncgacgcccgctttcgcgngttcggcgtcgccgagggcgacctcancaagtgcgaggccctgggactgccatcctggggggaggatggggaaaaaagaaagggaacttccttccgcctccaggacccgcaagaccccaaagggggcttgaggaccaaccggccccggggggcccggtaatttggaaaggcccggggaaagaaagggaaccctcttttggggaaaggggcccccccccccctcaaaaaaaacctccttctttctacaccggggggggccctaaggggggagaaaacccccggggggggttttccacaaaaacccccccccccccg

SEQ ID NO: 28627 - protein, 92 aa, Zea mays
  misc_feature: Ceres CLONE 1402885-F
  misc_feature (22)..(22): Xaa is any aa, unknown, or other
  misc_feature (33)..(33): Xaa is any aa, unknown, or other
  misc_feature (34)..(34): Xaa is any aa, unknown, or other
  misc_feature (40)..(40): Xaa is any aa, unknown, or other
  misc_feature (49)..(49): Xaa is any aa, unknown, or other
MEQEPHRPMELPPGLPLHPDDXELITHYLARKXXDARFRXFGVAEGDLXKCEALGLPSWGEDGEKRKGTSFRLQDPQDPKGGLRTNRPRGAR

SEQ ID NO: 28628 - DNA, 624 bp, Zea mays
  misc_feature: Ceres CLONE 1402888-F
  misc_feature: Encodes the peptide sequence at SEQ ID NO. 28629
  misc_feature (399)..(399): n is a, c, t, g, unknown, or other
  misc_feature (411)..(411): n is a, c, t, g, unknown, or other
caccgcggtggcggccgctctagaatagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaagggcggagtgtacgtgggcgacgcggcggggcaggagaagacgcggctgctcctccagaaacgggcctccggagggggttgctcccggtgggggaaatcattcaagggggtaactggaaggaaaaggggtttcggggtggctccgcaaggccccaaagggggaccattaattggccaagggcgcccggccagggtctaaaagncccaaggggggntcgggggggcccaaaaaaggcccgcgtctaaaaaaataaaccggggggcaagggccaaagaaaaagtgggttggggggggccccctcccgagaaaaagggggggggaaaaacccccccccgggggggaatcccccccggggaggccttcgggggggggggtcccccagagatttcccccggggggggggtttttaagggaggaggaagggcgc

SEQ ID NO: 28629 - protein, 77 aa, Zea mays
  misc_feature: Ceres CLONE 1402888-F
MTLTIPDEVRAKGGVYVGDAAGQEKTRLLLQKRASGGGCSRWGKSFKGVTGRKRGFGVAPQGPKGGPLIGQGRPARV

SEQ ID NO: 28630 - DNA, 679 bp, Zea mays
  misc_feature: Ceres CLONE 1402891-F
  misc_feature: Encodes the peptide sequence at SEQ ID NO. 28631
  misc_feature (292)..(292): n is a, c, t, g, unknown, or other
tccccgcggtggcggccgctctagaactagtggatcccccgggctgcaggaattcgcacgagaccattacctagaacatcctaatcgaaaaatcgcgtctgtccgctacccctccccgaccagatcgctacgagacgccgcgcgatccgacccaggccgacgccgacgacccctctcgccgccggcggccatggcgtacggcgaccgcgtcaccaccttcgaggactccgagaaggagagcgagtacggctatgtccgcaaggtctctggacctgtggttgtggctgatggnaatgggtggtgctgccatggtatgaacttgttcgtgtcggacatgataacctcattggggaaattaatccgtcttgagggcgattcagctacaatccaagtttatgaggaaacagctggactggatggttaatggacccctgtattgagaacaagaaggcctcttttcagttgaattggggaccctggaattcttggaaacatttttttgacgggtatccagcggcctctaaaaacttcgctattaaggtcaggagatgtgaattttcccgtggggggggggttccagtcctgccttgaaaaaaaaggagtattgggggggaatttcagcaaaaaagggggggtggggggggggaaaggcatccccggggggggggaatctaacccg

SEQ ID NO: 28631 - protein, 77 aa, Zea mays
  misc_feature: Ceres CLONE 1402891-F
  misc_feature: SWISSPROT Homolog: EC 3.6.3.14 H(+)-transporting two-sector ATPase
MAYGDRVTTFEDSEKESEYGYVRKVSGPVVVADGNGWCCHGMNLFVSDMITSLGKLIRLEGDSATIQVYEETAGLDG

SEQ ID NO: 28632 - DNA, 627 bp, Zea mays
  misc_feature: Ceres CLONE 1402894-F
  misc_feature (274)..(274): n is a, c, t, g, unknown, or other
tccccgcggtggcggccgctctagaactagtggatcccccgggctgcaggaattcgcacgagaccattacctagaacatcctaatcgaaaaccccaaccccgttcttctccctccgtccgaccgtccctcgacagtgccgaggcgcaacctagcagccgcccacgcggcgcgacatccactggcgcaagcgcaatccgcaagggccccccggcgcgccgccagcctcctggctcggccgcccccgcggctaacccaggggcgggaaaggccggncagcccgccacaccccatccgggcagccaggcggaaacgaccgtaagagggaaagcggaagccggcgctgactccgatcccacctctagtcaacccaggcagaacgatcctcttcgtctggacacgacgtccattctcgaacgctatttcactcaacaaataaagtcttttctgcaaggctaacctttcccctgcgcgcccttaatggtttgcacagggccgggacggggaaaaaccgggaaaacccacgaaaaataaattatttcttccttctcggggccacaggttctcagttgcggaaaaccacccggggggggttcccccccccccttgaaaaaacccaggggggggcg

SEQ ID NO: 28633 - DNA, 663 bp, Zea mays
  misc_feature: Ceres CLONE 1402895-F
  misc_feature: Encodes the peptide sequence at SEQ ID NO. 28634
  misc_feature (373)..(373): n is a, c, t, g, unknown, or other
  misc_feature (416)..(416): n is a, c, t, g, unknown, or other
  misc_feature (417)..(417): n is a, c, t, g, unknown, or other
  misc_feature (422)..(422): n is a, c, t, g, unknown, or other
  misc_feature (437)..(437): n is a, c, t, g, unknown, or other
  misc_feature (515)..(515): n is a, c, t, g, unknown, or other
ggcggccgctctagaactagtggatcccccgggctgcaggaattcgcacgagaccattacctagaacatcctaatcgaaaaattcatcggccatggccgggcggtggctccaggtgactctcgccctcgtcgtcgtcacggcggcggcaacgacgctgtcctcagcccagcagacggcagcatcgttcccggccatgcccagctgcccgccggcgccgctcagcctgtccccgtgcatcggctacgtcttcggcgtcggctcggcgacgctcgcctcctgctgctcccagctccgtggcttcctccaggcccaggcgccgtgcatctgcgccgcatccaagctcgcgccagcccccatcggcgtgttcctcgnccaggcgcagggcatgatcccccaacgtctgcgacctgccagnncatgngatgccggcgcccgnccgggcgagggctccaagccggccgggcggagacactttcgcctgtggcctacgacgacgactccggagtgaaaaccngtcgaagggcgcgcttgggcccggtgttggttccaaaaacgggtcagggaagcaccgccggcaccaaaaatataaaatgattctggccactggcatgggcaccgggcaggaccccgcatcgaaagctaccggaaatacgggggatggc

SEQ ID NO: 28634 - protein, 138 aa, Zea mays
  misc_feature: Ceres CLONE 1402895-F
  misc_feature (94)..(94): Xaa is any aa, unknown, or other
  misc_feature (108)..(108): Xaa is any aa, unknown, or other
  misc_feature (109)..(109): Xaa is any aa, unknown, or other
  misc_feature (110)..(110): Xaa is any aa, unknown, or other
MAGRWLQVTLALVVVTAAATTLSSAQQTAASFPAMPSCPPAPLSLSPCIGYVFGVGSATLASCCSQLRGFLQAQAPCICAASKLAPAPIGVFLXQAQGMIPQRLRPAXXXDAGARPGEGSKPAGRRHFRLWPTTTTPE

SEQ ID NO: 28635 - DNA, 675 bp, Zea mays
  misc_feature: Ceres CLONE 1402898-F
  misc_feature: Encodes the peptide sequence at SEQ ID NO. 28636
  misc_feature (397)..(397): n is a, c, t, g, unknown, or other
cgcggtggcggccgctctagaactagtggatcccccgggctgcaggaattcgcacgagaccattacctagaacatcctaatcgaaaaacgaggcaatgctgtcccgtcgccgcagctcgccgcgcccgctcgcacctggcctcctcctgttactcctcgccatggcgccgccaccgccggcttccgcggtgggtgtgaactggggcttcgcgtcctcccactcgcttccggcggcgcaggtcgtacggggcctcctcctccccaactctgttccccgcgtccgcctcgccgccgcctcctccgacgcgctcacggcgctcgaaggcaccggcatcgccgtccagcgtcgggatccccgacgcgctgctccggcccctcgcctcctccacaaggaagncggcccgcggtgggtccacgacaacatcacccgttactctcccagcgtggcgttcgaggataaatggttggtttggggatgagccctttcttctacgtcatggacaaaatttcttccctttttgtagttcgagaaagcagaaaatgttcaacaagcattatcccatgcaaaattgtctgggaaagatggaaaggtgaaaaacaccttgaaggtgctgacccattccagaaagcatctactcctgccacgaaagttagtttcaagacctgatgttacaa

SEQ ID NO: 28636 - protein, 105 aa, Zea mays
  misc_feature: Ceres CLONE 1402898-F
  misc_feature (79)..(79): Xaa is any aa, unknown, or other
MAPPPPASAVGVNWGFASSHSLPAAQVVRGLLLPNSVPRVRLAAASSDALTALEGTGIAVQRRDPRRAAPAPRLLHKEXGPRWVHDNITRYSPSVAFEDKWLVWG

SEQ ID NO: 28637 - DNA, 617 bp, Zea mays
  misc_feature: Ceres CLONE 1402904-F
  misc_feature: Encodes the peptide sequence at SEQ ID NO. 28638
  misc_feature (205)..(205): n is a, c, t, g, unknown, or other
  misc_feature (232)..(232): n is a, c, t, g, unknown, or other
  misc_feature (240)..(240): n is a, c, t, g, unknown, or other
  misc_feature (242)..(242): n is a, c, t, g, unknown, or other
  misc_feature (243)..(243): n is a, c, t, g, unknown, or other
  misc_feature (251)..(251): n is a, c, t, g, unknown, or other
  misc_feature (264)..(264): n is a, c, t, g, unknown, or other
  misc_feature (305)..(305): n is a, c, t, g, unknown, or other
  misc_feature (325)..(325): n is a, c, t, g, unknown, or other
  misc_feature (326)..(326): n is a, c, t, g, unknown, or other
ggagctccccgcggtggcggccgctctagaatagtggatcccccgggctgcaggaattcgcacgagaccattacctagaacatcctaatcgaaaagttgtttcgtctccaccgccgctctcctttccagtctccaccaccgctcgtctccccgtaccgcccgcaacccccctcccctgcgagatcccgggcgcgatgtggcgcanctgcgtctcgcggggcctctccagggncagggctncnngctcaggntccctctcacggngtcgtcgtcctacacggtggtcgaccacacctaccacccantggtggtgggggccgggggnnccgggctcccggcgggggatcgggctttccaaggcacgggttaaaaccggggggattaccaaggtttttcccaaggggttggaaaccggtgggggttcagaggggtaaatgggtcccttgaaaaattaggaaaaaaactggggggggctatatttaaaccttttaagggaaaaaatttgttgggggccccccatttcttttcttatattgggggaaaagggccccaaaagggtttaaaaagtgggaaaaaaatggggccccttttttagaaaagggggggggggggaaaaa

SEQ ID NO: 28638 - protein, 79 aa, Zea mays
  misc_feature: Ceres CLONE 1402904-F
  misc_feature (4)..(4): Xaa is any aa, unknown, or other
  misc_feature (13)..(13): Xaa is any aa, unknown, or other
  misc_feature (16)..(16): Xaa is any aa, unknown, or other
  misc_feature (17)..(17): Xaa is any aa, unknown, or other
  misc_feature (24)..(24): Xaa is any aa, unknown, or other
  misc_feature (37)..(37): Xaa is any aa, unknown, or other
  misc_feature (44)..(44): Xaa is any aa, unknown, or other
MWRXCVSRGLSRXRAXXSGSLSRXRRPTRWSTTPTTXWWWGPGXPGSRRGIGLSKARVKTGGITKVFPKGLETGGGSEG

SEQ ID NO: 28639 - DNA, 691 bp, Zea mays
  misc_feature: Ceres CLONE 1402917-F
  misc_feature: Encodes the peptide sequence at SEQ ID NO. 28640
  misc_feature (629)..(629): n is a, c, t, g, unknown, or other
aaagctggagctccccgcggtggcggccgctctagaactagtggatcccccgggctgcaggaattcgcacgagaccattacctagaacatcctaatcgaaaaccggaatggtatcgtgcgacctgtagtcgtcgccagccacctcgctccctcctagacgacacccagctagtgctcccttccacacccaggaaccagccacctaaccccgcccgccatgccgggcctcgccgcctccgacaactcgcccccggcgccggcgccgccgccgcgccggctctcgtcgccgctaccccgtcgcgcgccgtcgtccccgtcgccgtccgcctcctcgcgcgccaagcctcggaagccctcgccctctcccgcggccttccccaccgacgccgacgactcgctcgacaacccggatctggggcccttcctccctcagcaggcgcgcgacgccatggtgtcaagcgagggcggtggcgccgcgcgcgcactcgagttcgccgagcgcgccgccatggcgctcgagcgacgcggcgagggcgccgagctcgagctcgccatgagcctccacgtcgccggcggcatccactgcgggctcgggccgcacgctgacgccatccccgtcctcgagcgcngcgtcgcagtcgtcacgccgccgccagaggcgcctgccgacggcgaggcgaagccgagccgg

SEQ ID NO: 28640 - protein, 158 aa, Zea mays
  misc_feature: Ceres CLONE 1402917-F
  misc_feature (138)..(138): Xaa is any aa, unknown, or other
MPGLAASDNSPPAPAPPPRRLSSPLPRRAPSSPSPSASSRAKPRKPSPSPAAFPTDADDSLDNPDLGPFLPQQARDAMVSSEGGGAARALEFAERAAMALERRGEGAELELAMSLHVAGGIHCGLGPHADAIPVLERXVAVVTPPPEAPADGEAKPSR

SEQ ID NO: 28641 - DNA, 692 bp, Zea mays
  misc_feature: Ceres CLONE 1402918-F
  misc_feature: Encodes the peptide sequence at SEQ ID NO. 28642
  misc_feature (308)..(308): n is a, c, t, g, unknown, or other
  misc_feature (333)..(333): n is a, c, t, g, unknown, or other
  misc_feature (349)..(349): n is a, c, t, g, unknown, or other
  misc_feature (369)..(369): n is a, c, t, g, unknown, or other
  misc_feature (370)..(370): n is a, c, t, g, unknown, or other
  misc_feature (410)..(410): n is a, c, t, g, unknown, or other
  misc_feature (518)..(518): n is a, c, t, g, unknown, or other
  misc_feature (532)..(532): n is a, c, t, g, unknown, or other
  misc_feature (559)..(559): n is a, c, t, g, unknown, or other
  misc_feature (564)..(564): n is a, c, t, g, unknown, or other
aaagctggagctccccgcggtggcggccgctctagaactagtggatcccccgggctgcaggaattcgcacgagaccattacctagaacatcctaatcgaaaaatcggctgtcgagtcgtcgcaaggtgttgctcgccgtatctcctttccccctcctccctgcgtcccccggctccggcgatccgccgcacctgaacccttctccacgtcgcctcgccggttgggttgaggtgagccgatcagatccgatcggggccggtccttgcgccactgctgcgtgagctcatctcggtcgaccgcctgcttgnctcgatcggggcgggacggcggcgnccagatctgcaatggnaggcaacaaggacgacgcgnncaagtgcctgcgcatcggcaagggcgcgctcgacgccggngaccgcgcgcgcgccatcaagttccctgtcagagcaaagcgctggaccccctcgctgccatcgacgacctcctcacctccttttctcaccccgaagcgactccaaggnttcttcgcccccgncgctttcacaccgaaaactgccgaaanagggncatcggaggcattgagggcttatggcttaaaaaaaaggaccccagggcaaaataaggaggagggggcgattcggaagaacccccaaaacaattcgaggcgggggcccggcaaaaaggccccaaggcaa

SEQ ID NO: 28642 - protein, 116 aa, Zea mays
  misc_feature: Ceres CLONE 1402918-F
  misc_feature (2)..(2): Xaa is any aa, unknown, or other
  misc_feature (9)..(9): Xaa is any aa, unknown, or other
  misc_feature (63)..(63): Xaa is any aa, unknown, or other
  misc_feature (72)..(72): Xaa is any aa, unknown, or other
  misc_feature (74)..(74): Xaa is any aa, unknown, or other
MXGNKDDAXKCLRIGKGALDAGDRARAIKFPVRAKRWTPSLPSTTSSPPFLTPKRLQGFFAPXAFTPKTAEXGXSEALRAYGLKKRTPGQNKEEGAIRKNPQNNSRRGPGKKAPRQ

SEQ ID NO: 28643 - DNA, 692 bp, Zea mays
  misc_feature: Ceres CLONE 1402919-R
ccgattgggtaccgggccccccctcgaggtcgacggtatcgataagcttttttttttttttttttggcaaacaccaaacggcggattcgtcattcagattcagggttacttgatgtccgaaaagaaagataggaaacaagtacaggtctgcactgcagccgagagagagagatagagagcttcacgccgattctctttgcgaagcggtgagcaaactacaccaacctatcctattccttcgtcatcgagctagattttaggcaggcagggaacctcacatcacatcttccacgtatacgcgacggggctgcggacgacgtgctcatcgttgacccaggaaatccacccgaagtccggcttcgcgtggccttgccgagccctggacgcaaaggtgacatagtacctgagcttctggccggcctgcctgaacgtgagcctcgccggcgtcaccgtgacggcgacagactcggggccgaccaccttcacgtcgtagaccgacgcccgcgggcccgacgttggtcagctccctcctgaaacgcaaggccgccgccgggcttcgtcttccgcttctgggccgaaaacccccgagaaggaccggtagttgagggcccccgggggcgggacttgttcagggccgcccaccgaaacgtttggacgccctgggtgactcccttggaccgtgcggggggcgc

SEQ ID NO: 28644 - DNA, 568 bp, Zea mays
  misc_feature: Ceres CLONE 1402921-F
  misc_feature (236)..(236): n is a, c, t, g, unknown, or other
  misc_feature (242)..(242): n is a, c, t, g, unknown, or other
acagctggagctccccgcggtggcggccgctctataatagtggatcccccgggctgcaggaattcgcacgagaccattacctagaacatcctaatcgaaaaatccaatacccccacgaacccactctctctccccacgatggcaaaaatggcgatggtgtcctcccgcctcccggttctcctctgcctcgccgccgtcgtcgtcgccgtcgcgatggaaggcgccgccgacgacgnagaggnggacttcgcctgcccgcgacgcacggtcccggggcgcaggggaaaggttcatcggggggtcacctcctggctaagaaaaggaacggggcctgcccgggggtgggggaacgggtcctgggggccccccggaaactcctaaaaggtttggtcggttggcccgggccctccccccgggttgggaacatccggcccccaccccgaatatttttcttggggcaaacaaaaaaaggcaaaaggtgtccattttttttttaaaaaggggggggaaaaaaaaaggggggacccccccccggggagttttttccccccggggcccccctcttaag

SEQ ID NO: 28645 - DNA, 573 bp, Zea mays
  misc_feature: Ceres CLONE 1402924-F
  misc_feature: Encodes the peptide sequence at SEQ ID NO. 28646
  misc_feature (389)..(389): n is a, c, t, g, unknown, or other
  misc_feature (416)..(416): n is a, c, t, g, unknown, or other
  misc_feature (440)..(440): n is a, c, t, g, unknown, or other
aaaactggagctccccgcggtggcggccgctctagaactagtggatcccccgggctgcaggaattcgcacgagaccattacctagaacatcctaatcaaaagtcactcttgtgtcctcctaaaaccctaaccctccgccgcccctcggacccccaaccagcagctgccgcggccatccgccggcgagatggcgctgtacctgctgttcgagtcggcgtccggctacggtctattccacgcgtacggcatcgatgagatcgggcagagcgtggaggccgttcgctcctccgtgctggacctcgatcgcttcggcaaggccgtcaagctcaccgccttcaccctttctcctctgcgtcgatgcactcatcagtgcacgctatatccgaggnatcatgaccgatgactgaggagttccntggagctgaacctgccgaagcccnaggaggggaaagaaggccaatccggccctcggggtcgtcaaggcccagggccggttttcaaatttcccaagggcaaccggattttccctggcagaggaaacaaattccgtccaggaacttggctcccgggggg

SEQ ID NO: 28646 - protein, 71 aa, Zea mays
  misc_feature: Ceres CLONE 1402924-F
  misc_feature (3)..(58): Pfam Name: NOP5NT Pfam Description: NOP5NT (NUC127) domain
  misc_feature (68)..(68): Xaa is any aa, unknown, or other
MALYLLFESASGYGLFHAYGIDEIGQSVEAVRSSVLDLDRFGKAVKLTAFTLSPLRRCTHQCTLYPRXHDR

SEQ ID NO: 28647 - DNA, 697 bp, Zea mays
  misc_feature: Ceres CLONE 1402935-F
  misc_feature: Encodes the peptide sequence at SEQ ID NO. 28648
  misc_feature (697)..(697): n is a, c, t, g, unknown, or other
gctcttaactagtggatcccccgggctgcaggaattcgcacgagaccattacctagaacatcctaatcgaaaaatgtaaaccacactccactccagcactgaacacttgattgattcagtaggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgggagtgcatcccggagcgcgtggtgcacgcgcgcggggcctccgccaagggcttcttcgagtgcatccacgacccgacgtcgctgacgtgcgccaacttccctgcgcgcgcccggcgtgcggacgtccgtgatcgcgcgcttctcgacggtgaatccacgaccgggggtccccggagaacaatccgcgaccccgcgcgggtttcgccgggaaattctacaccccgcgaggtccaatggaacctgctggccaacaacttccccgtcttttttctccgctaccgccttcagtttcccccaaagggattcaggggttcaaagccccaaccccgcggatcccacggggcaagaagaaatggccgcggtgattctaatttccctgaccgan

SEQ ID NO: 28648 - protein, 184 aa, Zea mays
  misc_feature: Ceres CLONE 1402935-F
  misc_feature (18)..(184): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARECIPERVVHARGASAKGFFECIHDPTSLTCANFPARARRADVRDRALLDGESTTGGPRRTIRDPARVSPGNSTPREVQWNLLANNFPVFFLRYRLQFPPKGFRGSKPQPRGSHGARRNGRGDSNFPDR

SEQ ID NO: 28649 - DNA, 700 bp, Zea mays
  misc_feature: Ceres CLONE 1402936-F
  misc_feature: Encodes the peptide sequence at SEQ ID NO. 28650
  misc_feature (393)..(393): n is a, c, t, g, unknown, or other
aaagctggagctccccgcggtggcggccgctctagaactagtggatcccccgggctgcaggaattcgcacgagaccattacctagaacatcctaatcgaaaaacactcgtccactcaccccctctttgctctgcctcgccgcgccgcagagcagagcatggcgcccccacgccctctcctcgccgccgtcttcctcgccgcggcggttctgctcctcctttctccggcagaggcggggacgctgggcgtgaactacggccgcgtgacgaacaacctgcccaacccagcggtggttgtgcagctgctcaagcagcagggcgtcgcgcaggtgactctgtacgacgccgaccccaccgtgctgcgcgccctcgcgaacaccggaatcagggtggntggtgacgctgcccaaacgagcaggtcgacgccggcggcgactcgctgcgtctacgcgctgctgtgggtgcccccgaacgtggtcgcgtaccacccggccacgcagatcagggtatcgccgtgggcaccgagtggtcgcgccggccagaaacggacggggcactggtctcgccatgaccacgggaccccgccttggcagactcgactcaaagggcctgcaagggtgttcccatggcctacggggttccggcaactaccgacccgggggggggttcgggggcctccgaaggcctatgaaccctgttat

SEQ ID NO: 28650 - protein, 181 aa, Zea mays
  misc_feature: Ceres CLONE 1402936-F
  misc_feature: SWISSPROT Homolog: EC 3.2.1.39 Glucan endo-1,3-beta-D-glucosidase
  misc_feature (79)..(79): Xaa is any aa, unknown, or other
MAPPRPLLAAVFLAAAVLLLLSPAEAGTLGVNYGRVTNNLPNPAVVVQLLKQQGVAQVTLYDADPTVLRALANTGIRVXGDAAQTSRSTPAATRCVYALLWVPPNVVAYHPATQIRVSPWAPSGRAGQKRTGHWSRHDHGTPPWQTRLKGPARVFPWPTGFRQLPTRGGVRGPPKAYEPCY

SEQ ID NO: 28651 - DNA, 712 bp, Zea mays
  misc_feature: Ceres CLONE 1402938-F
  misc_feature (498)..(498): n is a, c, t, g, unknown, or other
  misc_feature (569)..(569): n is a, c, t, g, unknown, or other
  misc_feature (585)..(585): n is a, c, t, g, unknown, or other
  misc_feature (707)..(707): n is a, c, t, g, unknown, or other
  misc_feature (712)..(712): n is a, c, t, g, unknown, or other
aaagctggagctccccgcggtggcggccgctctagaactagtggatcccccgggctgcaggaattcgcacgagaccattacctagaacatcctaatcgaaaaatacagcgccggccgggccgttgcgtccgtccatcctcatccccatccgccacccaccccgcgcccctccttctcactccagtgctggctgccggccagctccgcccccggggtccttgagctggaggtgggtggcgacgtaaaggcgcccgcttgctttgccactgccggcgctcgtcatctccttacttattcatccctgcggccctgctacacatcggtgccgtgccgtgcgtgcttgattccgtcctgtcctgtgcttgccgtttctttggcttgtattgtaggtggcggtggatgaccagctctcggagttttctgaggcgaggatcggagggcgttgcgttaggtccgcggttggtgagcggcggtcggagcggtctcgcgcgcggcggngtcgttcgatgacgcaggaatcgcgctctggggaggtgggaatacctcgcgctcgcgctcaaggtgctcgnataatttactgcctgnagctgaggggaggcgcgcctgtgagctgaaccgttcccgctgcactgactcctgagctcgggaaatggttgggagcgtgcacatcaatggatcggtccacggcggcaatggcacggccacgnaggan

SEQ ID NO: 28652 - DNA, 655 bp, Zea mays
  misc_feature: Ceres CLONE 1402939-F
  misc_feature (308)..(308): n is a, c, t, g, unknown, or other
  misc_feature (309)..(309): n is a, c, t, g, unknown, or other
  misc_feature (363)..(363): n is a, c, t, g, unknown, or other
aaagctggagctccccgcggtggcggccgctctagaactagtggatcccccgggctgcaggaattcgcacgagaccattacctagaacatcctaatcgaaaaaaaaaattcgattccacgaagcagcaatcgcaagttcgaagctctaaaataatctcttcccgacgtctctggaaggtcagcatctgaacccaggtagcctccagcgctggagacgtgccgtactcaaaccctagccaccaatggcagccggcggcggggctccgtgggcggagcgcgcgcgggtggtggggacgcaaatccgcaanncaggttccgcgtgggcgccccgtggacccaccgggtcgcttgtgggctgcgggncggaacggtccgtggtcggccacctggaaggggggtcccgggggggggggccggatatcgggtttcggggccccctggttttaaaaaagggggcccggaaaaaccggggattttttgaaaatccccccccctctcgggggggggaaaaaacttctccccccggggggggggggggggggaaaaaaaaaacccttttctcccccccaacggggggcgttttttgggggaaatctcccccccccccaaaaaaaaaaagaagggggggggggggaaacaaaaaaaaaaaaaaaaa

SEQ ID NO: 28653 - DNA, 713 bp, Zea mays
  misc_feature: Ceres CLONE 1402944-F
  misc_feature: Encodes the peptide sequence at SEQ ID NO. 28654
ggagctccccgcggtggcggccgctctagaactagtggatcccccgggctgcaggaattcgcacgagaccattacctagaacatcctaatcaaaaaacgacaaatcgacgatcgccgcttctcttggccattgtagagggagagagagagcgcgagcgacctaggtcagtcggattcggttttgggcgacagcttcatctatccgcgaccgcgacgatgggtctgcgcgtgggcgccaccgcgccagctccggacggcgtgcgcgtgctcgacaggggcgccgcgcgcgtgacgccgccatcgtgggtggctgtccgcggcaggagacgcttctccgtggggatgtccgtcgcgaccaccgaggccaccactaccatcgccgtgtctgcctcggaggaccaggcgctggaggctaggaactccaagagggtggtgtcggtcatcctcggagatggcgccggcaccagtctcttcccgcttaccagacgcagggtcaagtccgcgctgcacattggtggcgcgtacaggctcatcgacgtgccgatgatgcactgcataaacagcgggatcaatgatgactacatcctcaggcacttcaactcgcaatacctcaatcgccacctcgtcagagacgtactattcagcaatggcgtggccatcgtagacggcatcgacgaggttctagcaccaacccagaggtctggaacggatgg

SEQ ID NO: 28654 - protein, 165 aa, Zea mays
  misc_feature: Ceres CLONE 1402944-F
  misc_feature: SWISSPROT Homolog: EC 2.7.7.27 Glucose-1-phosphate adenylyltransferase
MGLRVGATAPAPDGVRVLDRGAARVTPPSWVAVRGRRRFSVGMSVATTEATTTIAVSASEDQALEARNSKRVVSVILGDGAGTSLFPLTRRRVKSALHIGGAYRLIDVPMMHCINSGINDDYILRHFNSQYLNRHLVRDVLFSNGVAIVDGIDEVLAPTQRSGTD

SEQ ID NO: 28655 - DNA, 696 bp, Zea mays
  misc_feature: Ceres CLONE 1402945-F
  misc_feature: Encodes the peptide sequence at SEQ ID NO. 28656
ggagctccccgcggtggcggccgctctagaactagtggatcccccgggctgcaggaattcgcacgagaccattacctagaacatcctaatattgctgattcttcccgcaccggcctcagcctgccctctctctctctctctctctctctcccccttccttcctcgagcagctccacgcgcgacgccatcccaatgctctccacgcctcattggaccccaggaagcaatcgcgctgatcggggccgccgcctagcggtgccgtgcgggttagggcgcgaggctggcgctagctcgagctcgcggctgccgcaaggtgctggaaaggtgaggagtatgtcctcgatacgatttggatttgttagaagccagctcctctgttctggcaccatttgctaggattttgttatggtgtttattaggcagccatgaaaagtctgatatgcttcgaacagaagatggacatcagacacatgggggaaaaatggggtgcactgcaaggagaacagattaacatcacatcagtggtcagcaacaagatccattaacaccacgcaaggtccacaaaagcctttagcgggcatgggtgttccgcagcggaggcagcaggtgcgccggcggccagaaagtgtgctctgtgcaatttcgatatggatggggaggagattgaagagtgtgcatacctgcatctggatgacc

SEQ ID NO: 28656 - protein, 67 aa, Zea mays
  misc_feature: Ceres CLONE 1402945-F
MLSTPHWTPGSNRADRGRRLAVPCGLGREAGASSSSRLPQGAGKVRSMSSIRFGFVRSQLLCSGTIC

SEQ ID NO: 28657 - DNA, 715 bp, Zea mays
  misc_feature: Ceres CLONE 1402946-F
  misc_feature: Encodes the peptide sequence at SEQ ID NO. 28658
aagctggagctccccgcggtggcggccgctctagaactagtggatcccccgggctgcaggaattcgcacgagaccattacctagaacatcctaatcaaaaaatctcccttcggttccccaattcgaaatcgaatcgggtcggtcttgccgtgcgtgcgtggctgcgcgagcgactcgactgcaccccccgctcctcccagtccccacacactgcgcgccgccgccgggtcctcctagggtttcgccgcgatgtcgctccggccgagcgagcgggagcagatgcggaagggcaactacaagcagacggtggacgcggaggagagccgccgccgccgcgagggccagatggtggacatccgcaaggccaagcgcgaggaaagcctccagaagaagcgccgcgatgggtttcccgcctccgccgctggtgtgccgccgatgggccactccaccgcgctccagcagaagctcgatggcttgccggcgatggtgcaggccgtccactccaacgacccctccgtgcagcttgaggccaccacacagttcaggaagctgctttctatagaacgtagtcccccaatcgaagaggtgatcagcacaggagtggtgccgcgattcattgagtttcttacacgtgaggaccatccccaactccagtttgaggctgcatgggcactcaccacattgcatcaggcacatcagagaacactaaggtggg

SEQ ID NO: 28658 - protein, 155 aa, Zea mays
  misc_feature: Ceres CLONE 1402946-F
  misc_feature (4)..(97): Pfam Name: IBB Pfam Description: Importin beta binding domain
  misc_feature (106)..(147): Pfam Name: Arm Pfam Description: Armadillo/beta-catenin-like repeat
MSLRPSEREQMRKGNYKQTVDAEESRRRREGQMVDIRKAKREESLQKKRRDGFPASAAGVPPMGHSTALQQKLDGLPAMVQAVHSNDPSVQLEATTQFRKLLSIERSPPIEEVISTGVVPRFIEFLTREDHPQLQFEAAWALTTLHQAHQRTLRW

SEQ ID NO: 28659 - DNA, 725 bp, Zea mays
  misc_feature: Ceres CLONE 1402950-F
  misc_feature: Encodes the peptide sequence at SEQ ID NO. 28660
  misc_feature (303)..(303): n is a, c, t, g, unknown, or other
  misc_feature (448)..(448): n is a, c, t, g, unknown, or other
  misc_feature (484)..(484): n is a, c, t, g, unknown, or other
  misc_feature (504)..(504): n is a, c, t, g, unknown, or other
  misc_feature (538)..(538): n is a, c, t, g, unknown, or other
aagctggagctccccgcggtggcggccgctctagaactagtggatcccccgggctgcaggaattcgcacgagaccattacctagaacatcctaatcgaaaaatcttcctgctcaacatcagtagcagctttagctgtagcagcgccaccggccaccgccacgccatggccaccacgttgcacaagccccttggggcgatcaccgttgacgacctcgccgcggcggcgcctgggtcggacgccaccgcgctccacgcagcgctccggcgcgcgctcgactcgcacggacccaccgaagtgtggngcgagctctgccggtccgtgctctgtccgtctgtccccttcgccgtccaccggatgctctactacggttgcttcgccgggttcccgtcccccacgccgccggcctggacgcccgacccccaggagtctgtcttgaccaatgtcgnccgtgtcctcgaggcgcgtggtaagaacttgatcgncgacgcgtacaaggatcccnatcacagcttccccagacccctccacagtctccnacgagaacccagaagcgtactggaagatggtatttgaggatatgggtatcccaatcagcgtagaagcatcctgcatctgaagagggacactgcatatcctggttggcgaggggctaccaggggccaagctcaacgctggtgtaaattgcttgactgctaaaacccgggaggagttccaacgtccggc

SEQ ID NO: 28660 - protein, 136 aa, Zea mays
  misc_feature: Ceres CLONE 1402950-F
  misc_feature (47)..(47): Xaa is any aa, unknown, or other
  misc_feature (95)..(95): Xaa is any aa, unknown, or other
  misc_feature (107)..(107): Xaa is any aa, unknown, or other
  misc_feature (114)..(114): Xaa is any aa, unknown, or other
  misc_feature (125)..(125): Xaa is any aa, unknown, or other
MATTLHKPLGAITVDDLAAAAPGSDATALHAALRRALDSHGPTEVWXELCRSVLCPSVPFAVHRMLYYGCFAGFPSPTPPAWTPDPQESVLTNVXRVLEARGKNLIXDAYKDPXHSFPRPLHSLXREPRSVLEDGI

SEQ ID NO: 28661 - DNA, 717 bp, Zea mays
  misc_feature: Ceres CLONE 1402951-F
  misc_feature: Encodes the peptide sequence at SEQ ID NO. 28662
  misc_feature (252)..(252): n is a, c, t, g, unknown, or other
  misc_feature (482)..(482): n is a, c, t, g, unknown, or other
  misc_feature (564)..(564): n is a, c, t, g, unknown, or other
  misc_feature (644)..(644): n is a, c, t, g, unknown, or other
aaagctggagctccccgcggtggcggccgctttccaactagtggatcccccgggcctgcagtaattcgcacgagaccattacctaaaacatcctaatcgaaaaacaaaaagatctaaaatacagaaaaaaaaagttgtccggaacctacgaggaaggcttaggcgttttcctcgttcgctcgccgcggcgtcggacgatgcctctggggctgacgctggggtcgctggggcgggctatgcggcagaagcggncgtcctcgctcgacatcctctcctccaagcgggcgccgcgggactactacaagggcaagaactgcaagcccaccgggttccacacgcgcaaagtgcaccagggacctcgcagcgtcgacgacatcctcggcctctctaacctcagcacagactactgagagcaggagctgattgtcatcggactgctctagccatttgcaggaagcgagcgaccaagccttgcagtattngcggctacgttttccctggagagtgccccgtgttcagaggattagtcattaagtgtcgccgtcttagcagctacagggtggncttttccagaggatttttctcccccccctccccttgaacttgggaaggggcaaacattgtggcgtaagccccctgtcggncctgtctgtttttctttcaggaatattataatctaacttataaaattaaaaaaaaaaaaaaaaaaagtttatc

SEQ ID NO: 28662 - protein, 70 aa, Zea mays
  misc_feature: Ceres CLONE 1402951-F
  misc_feature (19)..(19): Xaa is any aa, unknown, or other
MPLGLTLGSLGRAMRQKRXSSLDILSSKRAPRDYYKGKNCKPTGFHTRKVHQGPRSVDDILGLSNLSTDY

SEQ ID NO: 28663 - DNA, 658 bp, Zea mays
  misc_feature: Ceres CLONE 1402952-F
  misc_feature: Encodes the peptide sequence at SEQ ID NO. 28664
  misc_feature (381)..(381): n is a, c, t, g, unknown, or other
  misc_feature (393)..(393): n is a, c, t, g, unknown, or other
  misc_feature (489)..(489): n is a, c, t, g, unknown, or other
  misc_feature (527)..(527): n is a, c, t, g, unknown, or other
  misc_feature (610)..(610): n is a, c, t, g, unknown, or other
  misc_feature (631)..(631): n is a, c, t, g, unknown, or other
tggagctccccgcggtggcggccgctctagaactagtggatcccccgggctgcaggaattcgcacgagaccattacctagaacatcctaatcgaaaaattttgcttggctgctgctcccttctcccaccgaccaactcgatcccgcgccatggatcgcgccgaccccgcgcggggccgccttgccgtgctctcctcccacctccgtggtgcaggggccgaggaggcggcggggctggagaggtcgccggtatccgcgccggcgcccgggccccgcgccggcgcgcttgccgtggtggacgggaggaccgggaagcggcacgaggtcaaggtctccgaagacggcaccgtgcgcgccaccgacttcaagaagattaccactnggaaggacgacnagggtcttaagatttatgatcctggttaccttaacactgcccctgttcgctcgtccatctgctacatcgatggagatgagggaatccttcgctatnaggggtatcccatcgaagaattgctgaaagcagctcgntttgttgaggtgggctacctttttatgtatggggacttgcctactcagagtcaattggcaggtgggaaatttgtatttctcanattctgctgttcccacagcantgtttgaatcaaacatcatgcccatga

SEQ ID NO: 28664 - protein, 162 aa, Zea mays
  misc_feature: Ceres CLONE 1402952-F
  misc_feature: SWISSPROT Homolog: EC 2.3.3.1 Citrate (Si)-synthase
  misc_feature (78)..(78): Xaa is any aa, unknown, or other
  misc_feature (82)..(82): Xaa is any aa, unknown, or other
  misc_feature (114)..(114): Xaa is any aa, unknown, or other
  misc_feature (154)..(154): Xaa is any aa, unknown, or other
  misc_feature (161)..(161): Xaa is any aa, unknown, or other
MDRADPARGRLAVLSSHLRGAGAEEAAGLERSPVSAPAPGPRAGALAVVDGRTGKRHEVKVSEDGTVRATDFKKITTXKDDXGLKIYDPGYLNTAPVRSSICYIDGDEGILRYXGYPIEELLKAARFVEVGYLFMYGDLPTQSQLAGGKFVFLXFCCSHSXV

SEQ ID NO: 28665 - DNA, 706 bp, Zea mays
  misc_feature: Ceres CLONE 1402955-F
  misc_feature: Encodes the peptide sequence at SEQ ID NO. 28666
  misc_feature (586)..(586): n is a, c, t, g, unknown, or other
  misc_feature (610)..(610): n is a, c, t, g, unknown, or other
  misc_feature (611)..(611): n is a, c, t, g, unknown, or other
  misc_feature (641)..(641): n is a, c, t, g, unknown, or other
  misc_feature (650)..(650): n is a, c, t, g, unknown, or other
  misc_feature (680)..(680): n is a, c, t, g, unknown, or other
  misc_feature (681)..(681): n is a, c, t, g, unknown, or other
aaagctggagctccccgcggtggcggccgctctagaactagtggatcccccgggctgcaggaattcgcacgagaccattacctagaacatcctaatcaaaacttgcagctcgcgaatctgcggcccccgttcccccacccgacacggcacaccactcgctccagtccgccttcatccaacggttcccctcctatttgccctcggaatcccgcccgcgaaccctagccggcctccgcgagatggacgaggactgggagctactcctcgcgtcccccaaggcggcggcggcggcggcgccggccgagccgtacgccggcggcggaggagatggggaggacgacgccggcgcaatcaagcacgactacttcgacctcggctccgatgccaagtacccccggagggcgtcgccgtcgaagggaagcgaggaggagtgtgctgaggaggggcctttcgcggcgtcggacaacgcgggctgggtggagccggaccccgacgaccttctcttccccggccgcgaccgcgcggcgctctggtcggactcgtcctccgacggggagaggcccgaggtcgaggtcgaggttgaggncgccgatcaggtggaacgggtcgnngtcacggcggcggctgacgcgggcgagggncccccgtgncgaagggaagcagggcctgcccagtggtgnnagctgccgctggacgtgctgcgggg

SEQ ID NO: 28666 - protein, 155 aa, Zea mays
  misc_feature: Ceres CLONE 1402955-F
  misc_feature (116)..(116): Xaa is any aa, unknown, or other
  misc_feature (124)..(124): Xaa is any aa, unknown, or other
  misc_feature (137)..(137): Xaa is any aa, unknown, or other
  misc_feature (147)..(147): Xaa is any aa, unknown, or other
  misc_feature (148)..(148): Xaa is any aa, unknown, or other
MDEDWELLLASPKAAAAAAPAEPYAGGGGDGEDDAGAIKHDYFDLGSDAKYPRRASPSKGSEEECAEEGPFAASDNAGWVEPDPDDLLFPGRDRAALWSDSSSDGERPEVEVEVEXADQVERVXVTAAADAGEGPPXRREAGPAQWXXLPLDVLR

SEQ ID NO: 28667 - DNA, 728 bp, Zea mays
  misc_feature: Ceres CLONE 1402958-F
  misc_feature: Encodes the peptide sequence at SEQ ID NO. 28668
caaagctggagctccccgcggtggcggccgctctagaactagtggatcccccgggctgcaggaattcgcacgagaccattacctagaacatcctaatcgaaaactctccccaccggctaaccctagcagcggcacgcgggcgacggcgaccagtagagggctagtcgcgccaccggcgaagggattcagcggtctacccgtcctccgacacaggcgcggcggcgtcctgcagattattattggtttgttgcaaaatgtctacggaagtgactttgaacaattctggtggttctgaatctgcattgctgttactggaacagcttgctgaagtttttggaaagttgaaaactcacaccgaaacatttctgcaattgcaaaatggcataaaatgggaagatattgaagggcatttcctcagccttgatgagtcgtacagaagcaagtttgatgaactggtagagaaagagaaggcattagaagaaagaaagctgaagcttgtagattgattgcagagaaagaggctaaagtttctacaaaagagcatgcctcactgaatcagcttcaggagctaagggatgctgctgtctcttctctagcagaggtcgacaaaatataaggtggagcttgctgagatactgaagcaagtgaagcaagacaaaaagggagtacctcaatcatgacacaatgcatctcgtgcttcagagagatacccctgctaaggggtcgga

SEQ ID NO: 28668 - protein, 83 aa, Zea mays
  misc_feature: Ceres CLONE 1402958-F
MSTEVTLNNSGGSESALLLLEQLAEVFGKLKTHTETFLQLQNGIKWEDIEGHFLSLDESYRSKFDELVEKEKALEERKLKLVD

SEQ ID NO: 28669 - DNA, 619 bp, Zea mays
  misc_feature: Ceres CLONE 1402960-F
  misc_feature: Encodes the peptide sequence at SEQ ID NO. 28670
  misc_feature (369)..(369): n is a, c, t, g, unknown, or other
aaagctggagctccccgcggtggcggccgctctagaactagtggatcccccgggctgcaggaattcgcacgagaccattacctagaacatcctaatcaaaaaattgtcagccatcctcaggcagcttcgagttccacgacgagagcaccggcagccgcacacgcgtttgtctcctcgccggaccttcccggcaccgccgccggctctccctcacggtccactacactccacagcaccgccgtcgcacaacgacatggcctcctccgctacctatctcatgctcgccagcgcccacgctcccctcgctcctctcataagggcaccgccgatggcccttgtcgcgagaaccgccgcaaccctcatcactangcgcgaaagagccagtgtccctctgttagtcaacccccgctgcgtgccggccgggactggcgcgcccgtggctgggccaatatctgcagagactcgtccctccagggcctttcgggggccgattctcctgctcaggaaccaaaggatctgaagaaaacggagcggggtcaaaggtgcggttcggattagcggagcactgcgggaacttaagggatggaacacgcccgggtcattcttcgggatttggggg

SEQ ID NO: 28670 - protein, 88 aa, Zea mays
  misc_feature: Ceres CLONE 1402960-F
  misc_feature (39)..(39): Xaa is any aa, unknown, or other
MASSATYLMLASAHAPLAPLIRAPPMALVARTAATLITXRERASVPLLVNPRCVPAGTGAPVAGPISAETRPSRAFRGPILLLRNQRI

SEQ ID NO: 28671 - DNA, 669 bp, Zea mays
  misc_feature: Ceres CLONE 1402963-F
  misc_feature: Encodes the peptide sequence at SEQ ID NO. 28672
  misc_feature (406)..(406): n is a, c, t, g, unknown, or other
  misc_feature (435)..(435): n is a, c, t, g, unknown, or other
  misc_feature (436)..(436): n is a, c, t, g, unknown, or other
  misc_feature (439)..(439): n is a, c, t, g, unknown, or other
  misc_feature (504)..(504): n is a, c, t, g, unknown, or other
  misc_feature (576)..(576): n is a, c, t, g, unknown, or other
aagctggagctccccgcggtggcggccgctctagaactagtggatcccccgggctgcaggaattcgcacgagaccattacctagaacatcctaatcaaaaagacctgcctcgccattccgccgcgccttcgcatcgtccgcgcgcccggcccttctcgttctaccccggtacgactcgacggtggtcgtgggcgccgaaggtgcggctccgaggcgccaggtggttcgtttgctgtttgcgcgatcgccggaggagtctgtgcaagctgtgctggctaagggtttgggggttcggattcagtggaggggctgcggcaggagggagctagagatgtacggaccgccgtcccgaggcggcgggggagctggcactgccggagagcagcctagggtttaccaggttggncgagggaagcacgagtttttcttgcaggnncgnttcatatttggacctgatgtgagatcattgtttctcaccatattcctcattctttgcgccatggntgtcttctgtatatttgtggccagacatcttatcaatgactttcctgatcattggggagtttcagttatggncatagggatggtcttcctgggtacgatttaacattgctgctttcttactctgggagagatcctggaatagtgcctcgtaacacccatcttctg

SEQ ID NO: 28672 - protein, 91 aa, Zea mays
  misc_feature: Ceres CLONE 1402963-F
  misc_feature (35)..(35): Xaa is any aa, unknown, or other
  misc_feature (58)..(58): Xaa is any aa, unknown, or other
  misc_feature (82)..(82): Xaa is any aa, unknown, or other
MYGPPSRGGGGAGTAGEQPRVYQVGRGKHEFFLQXRFIFGPDVRSLFLTIFLILCAMXVFCIFVARHLINDFPDHWGVSVMXIGMVFLGTI

SEQ ID NO: 28673 - DNA, 761 bp, Zea mays
  misc_feature: Ceres CLONE 1402966-F
  misc_feature: Encodes the peptide sequence at SEQ ID NO. 28674
  misc_feature (349)..(349): n is a, c, t, g, unknown, or other
  misc_feature (368)..(368): n is a, c, t, g, unknown, or other
  misc_feature (400)..(400): n is a, c, t, g, unknown, or other
  misc_feature (403)..(403): n is a, c, t, g, unknown, or other
  misc_feature (404)..(404): n is a, c, t, g, unknown, or other
  misc_feature (406)..(406): n is a, c, t, g, unknown, or other
  misc_feature (407)..(407): n is a, c, t, g, unknown, or other
  misc_feature (412)..(412): n is a, c, t, g, unknown, or other
  misc_feature (413)..(413): n is a, c, t, g, unknown, or other
  misc_feature (417)..(417): n is a, c, t, g, unknown, or other
  misc_feature (419)..(419): n is a, c, t, g, unknown, or other
  misc_feature (424)..(424): n is a, c, t, g, unknown, or other
  misc_feature (439)..(439): n is a, c, t, g, unknown, or other
  misc_feature (488)..(488): n is a, c, t, g, unknown, or other
aaagctggagctccccgcggtggcggccgctctagaactagtggatcccccgggctgcaggaattcgcacgagaccattacctagaacatcctaatcgaaaagctgatctcagatccaaaccaaacgaactccacactaccctctgctcagcccgcgcacgcatgaaaccctagtgaccccgtccagatctccgcgtccggatcactgcgcggcgccgccatggcgccccccgcgctggactccctcccggcgccgctccggtcgctgcggctcaagacgaagcagcaggagctcctgctccgcgtctcggcgctggcgctcatctacgtgctcgccttttcgcgtcgnctctttctcccgtctccgntacgagtcatgatccacgaggtcgacctttanttnnanntacgnnacangntcttnctcacgaaaaagggnttcagcgagttctggacctggttcactttcaaaactggaccccttccgncgcgttgcgggggaacttcttcccgggtccatgggaacgggggttgttccccccccccccgggggtttacccccggaaaaatggggagggttgggcctcccccgcctttttttgtgtaaaaaaccagtttggccaaaatttttgggaaaaattgtaacccccgggggggttccccccccggggaaaaacacccccccccggaaaaactccccccccggggggggggccaacaaaaaggggggggcctttcctcgcgggggggcccccacccct

SEQ ID NO: 28674 - protein, 128 aa, Zea mays
  misc_feature: Ceres CLONE 1402966-F
  misc_feature: SWISSPROT Homolog: EC 2.4.1.119 Dolichyl-diphosphooligosaccharide--protein glycotransferase
  misc_feature (50)..(50): Xaa is any aa, unknown, or other
  misc_feature (60)..(60): Xaa is any aa, unknown, or other
  misc_feature (61)..(61): Xaa is any aa, unknown, or other
  misc_feature (62)..(62): Xaa is any aa, unknown, or other
  misc_feature (63)..(63): Xaa is any aa, unknown, or other
  misc_feature (65)..(65): Xaa is any aa, unknown, or other
  misc_feature (66)..(66): Xaa is any aa, unknown, or other
  misc_feature (67)..(67): Xaa is any aa, unknown, or other
  misc_feature (68)..(68): Xaa is any aa, unknown, or other
  misc_feature (90)..(90): Xaa is any aa, unknown, or other
MAPPALDSLPAPLRSLRLKTKQQELLLRVSALALIYVLAFSRRLFLPSPXRVMIHEVDLXXXXRXXXXLTKKGFSEFWTWFTFKTGPLPXRCGGTSSRVHGNGGCSPPPRGFTPGKMGRVGPPPPFFV

SEQ ID NO: 28675 - DNA, 679 bp, Zea mays
  misc_feature: Ceres CLONE 1402970-F
aaagctggagctccccgcggtggcggccgctctagaactaggggatcccccgggctgcaggaattcgcacgagaccattacctagaacatcctaatcgaaaaatcactaaccaccacttccccgtgttgccctctcactcccatgctccttctgctggcatctcgccgcggccgatgggctgcttacttggctgcttcgggggggccaaggagcgcccccctcgccgctggacctggtcggcgtctgcagtcccccgacgatcgtgctcaggccttgctgcagcctacgacaaacaaggctaatctgaatgggaaggacgtttcctccgccgcgcctgtactagaggactctcctgcgagatgaggtactccacggacgacatgtgactgttcctcgatgaagaactacgggacattcgaccccgacggcaccgcattccagatactcccgatcccaagagacaacaaggagaacatcgagccggagtatgatgtgaatatgaccaagacattctgaatgctgggcctcggagtgatccttaaccatacgacttccccttgaagcacatgaacaggaagctcgccgttaccggcaacatcagcgactactaggacacctagttggagacttccttgagacaaagaagagctaccactcgacgacgaaagaaaatggata

SEQ ID NO: 28676 - DNA, 648 bp, Zea mays
  misc_feature: Ceres CLONE 1402972-F
  misc_feature (270)..(270): n is a, c, t, g, unknown, or other
  misc_feature (271)..(271): n is a, c, t, g, unknown, or other
  misc_feature (357)..(357): n is a, c, t, g, unknown, or other
  misc_feature (370)..(370): n is a, c, t, g, unknown, or other
  misc_feature (371)..(371): n is a, c, t, g, unknown, or other
  misc_feature (385)..(385): n is a, c, t, g, unknown, or other
  misc_feature (392)..(392): n is a, c, t, g, unknown, or other
  misc_feature (432)..(432): n is a, c, t, g, unknown, or other
  misc_feature (461)..(461): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (629)..(629): n is a, c, t, g, unknown, or other
  misc_feature (636)..(636): n is a, c, t, g, unknown, or other
  misc_feature (637)..(637): n is a, c, t, g, unknown, or other
  misc_feature (647)..(647): n is a, c, t, g, unknown, or other
aaagctggagctccccgcggtggcggccgctctagaactagtggatcccccgggctgcaggaattcgcacgagaccattacctagaacatcctaatcgaaaaataaattttaaaatataaaaaatacagataaaagggatatggttgaagatagtgccctctaaattctccctcgttgtcttaccgtgtcgttgttgccgggttttcttggcgagcgacggagccacagaaatggagtgcaatacgggcgcctatttttttagcggcggnngaggggagcgaaagcctgggcagccactcgccggcctccaagaaaccgtcgccattttttcatccgagtgccgccgattttgattncattattttctgnnctcgtggggaaccnattcggnttttgttttcggaaagaaaggagggggagattcattgggngggttctgaaatcgcaagggccggtttcnacggggggcgtggacgggggccaaggccaaaaacccggaggggcccgaagggtaaatttcccaaaaggggcccgggggtttgggggggtccgaaaagggcccttggaagttaattcaagctccaattccgcggaaaaaaaagaaaaaagaannnnnnaaaaagggggncccaaannaaaacaaaana

SEQ ID NO: 28677 - DNA, 665 bp, Zea mays
  misc_feature: Ceres CLONE 1402974-F
  misc_feature (663)..(663): n is a, c, t, g, unknown, or other
aagctggagctccccgcggtggcggccgctctagaactagtggatcccccgggctgcaggaattcgcacgagaccattacctagaacatcctaatcgaaaaactccagtgctggctgccggccagctccgcccccggggtccttgagctggaggtgtcggtggatgaccagctctcggagttttctgaggcgaggatcggagggcgttgcgataggtccgcggttgctgagcgtatgtcgcatcgctctcgcgcgcggcggtgccgttcgatgacgcatgaatcgcgctctgggagggtgtgaatacctcgcgctcgcgctcaaggtgctcgattagtttactgcctgacgctgagggaggtcgcgcctgtgagctgaaccgctcccgctgcactgactcctgagctcggcaaatgattgggagcgtgcacatcaatgcatcggaccacggcggatatgacacggtcactgaagatcggctggacgagctgcgccggctgctcggcaagtcggagcttcatcttcatcagatttcagcgtcggctgcggtgcgtggggcagtgacttcgccgcgctcctacaggacgcgtacggccatttccgggaccagtgcagataaagatctgacgtctactggagcggacggtggaccgctcacagcgnat

SEQ ID NO: 28678 - DNA, 673 bp, Zea mays
  misc_feature: Ceres CLONE 1402975-F
  misc_feature: Encodes the peptide sequence at SEQ ID NO. 28679
  misc_feature (479)..(479): n is a, c, t, g, unknown, or other
  misc_feature (496)..(496): n is a, c, t, g, unknown, or other
  misc_feature (569)..(569): n is a, c, t, g, unknown, or other
  misc_feature (659)..(659): n is a, c, t, g, unknown, or other
tggagctccccgcggtggcggccgctctagaactagtggatcccccgggctgcaggaattcgcacgagaccattacctagaacatcctaatcaaaaaaggccagcgtggaaactggaaaagctgcctccgccaaatccaaaccaaacgggacggtcgccggaggaagcatacccgaaactcccctcccctctccttacaataccgcgaggcggcggctgacgtcgcttagccgctttcccacaccttcgccgccgcctatactcctgcagaaatagcccgagggagggcggttgctgctgcatcgtgttcggtgttccttccctcgccgcacgcgggatccatttgacggacggaccgaccgagcgactcacccgtccaccgagagccatggggcagaggcagagccacagcaagcgggacgggagcagccacgggcggcggtcgcgctcctttcagcagcagccgtcggcgcagtggngcgccggaggaggaggntactaccagcaggacccaagcaccggctactacggcgcgccggtgtcacaacaggggaggagggtactactancaggacccaggcaccggctactacggcgcgcccggtgcacagcaggggaggaggtacgccgcgccgtaccgggacagcccgccgctgtcngcgttgctgctccg

SEQ ID NO: 28679 - protein, 95 aa, Zea mays
  misc_feature: Ceres CLONE 1402975-F
  misc_feature (31)..(31): Xaa is any aa, unknown, or other
  misc_feature (61)..(61): Xaa is any aa, unknown, or other
  misc_feature (91)..(91): Xaa is any aa, unknown, or other
MGQRQSHSKRDGSSHGRRSRSFQQQPSAQWXAGGGGYYQQDPSTGYYGAPVSQQGRRVLLXGPRHRLLRRARCTAGEEVRRAVPGQPAAVXVAAP

SEQ ID NO: 28680 - DNA, 683 bp, Zea mays
  misc_feature: Ceres CLONE 1402977-F
  misc_feature: Encodes the peptide sequence at SEQ ID NO. 28681
  misc_feature (267)..(267): n is a, c, t, g, unknown, or other
  misc_feature (386)..(386): n is a, c, t, g, unknown, or other
  misc_feature (454)..(454): n is a, c, t, g, unknown, or other
  misc_feature (459)..(459): n is a, c, t, g, unknown, or other
  misc_feature (557)..(557): n is a, c, t, g, unknown, or other
  misc_feature (571)..(571): n is a, c, t, g, unknown, or other
tggagctccccgcggtggcggccgctctagaactagtggatcccccgggctgcaggaattcgcacgagaccattacctagaacatcctaatcgaaaaaagaacagtcgggcggtcgggccaggcggcgtgtgagcgtgtccgagatccacaggacgcaggacgctgccgatggcgaagccgaggaaaacccgcacctcggctccagatccgcccgtagccgccgttcggcttccgtggcacacaccggcgccggcggtccccacggncgttctgatctcgctcgctgccctcctcatccgcgtgctggtttccgtgggcccctactccggtcagggtgcggcgccctaagtcggcgactatgaggcgcagcggcactggatggagntcacactccatctcacgcccgccgactggtaccgcaacacctcccgacatgacccttgctactggggnctggnactaccgcccctctccccgctacagagcctcctccacggccgcatcatcaacacctcactccccgaggccgtcgttctccgctcctcccgtggctacnaatctatggaatcnaaagtgctgatgcggtggacggtgctgccatcggattctgtgggggtcctcccatctgctttgggggtttggggggcgaactggaaactgggatcggaattaggggaaggga

SEQ ID NO: 28681 - protein, 101 aa, Zea mays
  misc_feature: Ceres CLONE 1402977-F
  misc_feature (3)..(3): Xaa is any aa, unknown, or other
  misc_feature (27)..(27): Xaa is any aa, unknown, or other
  misc_feature (60)..(60): Xaa is any aa, unknown, or other
MEXTLHLTPADWYRNTSRHDPCYWGLXLPPLSPLQSLLHGRIINTSLPEAVVLRSSRGYXSMESKVLMRWTVLPSDSVGVLPSALGVWGANWKLGSELGEG

SEQ ID NO: 28682 - DNA, 672 bp, Zea mays
  misc_feature: Ceres CLONE 1402983-F
  misc_feature: Encodes the peptide sequence at SEQ ID NO. 28683
aaagctggagctccccgcggtggcggccgctctataactagtggatcccccgggctgcaggaattcgcacgagaccattacctagaacatcctaatcgaaaaaatttccagacggaaacccactggtttttgcttgcatatcctttgttgaggacaaagatggagttgcgttccaacttccaagtctggagttgcggaatcgacggcctctgctcgatcgatggaaaaccataatccactctacattctcagattgctgaagcgaagatggacatctcagcataagcttctgttgcatcagggaacaaattctgcaagggtggcgcctgtgatttatctgatgtccagcaactcctcgaaagatgccatggagagatccacgtccatgacgaagcttataatcggagtgatcctttgcatcatattcatgactgaggaagtggtcatcggcatcaaagcaaacagtcttgccatcttaactgatgcggtgcaccttctttctgatgtggcagcatttgccatatcgttattctctctctgaggtgctggacgtgaagcaacaccgcagcagtcatatgagatcttccggattgagattcatggtgccttggactccattcagctcatatgagtacttgctggcatactgatatatgaggctattgtaatgct

SEQ ID NO: 28683 - protein, 106 aa, Zea mays
  misc_feature: Ceres CLONE 1402983-F
MENHNPLYILRLLKRRWTSQHKLLLHQGTNSARVAPVIYLMSSNSSKDAMERSTSMTKLIIGVILCIIFMTEEVVIGIKANSLAILTDAVHLLSDVAAFAISLFSL

SEQ ID NO: 28684 - DNA, 642 bp, Zea mays
  misc_feature: Ceres CLONE 1402985-F
  misc_feature: Encodes the peptide sequence at SEQ ID NO. 28685
  misc_feature (464)..(464): n is a, c, t, g, unknown, or other
  misc_feature (573)..(573): n is a, c, t, g, unknown, or other
caaagctggagctccccgcggtggcggccgctctagaactagtggatcccccgggctgcaggaattcgcacgagaccattacctagaacatcctaatcaaaaagtcgagtctaaccctagcgcgcgccgccacacctgccgttgctaccgccccgtacctcgcttgctttcccgtcgccgaaatgacgaagcgcaccaagaaggctggaattgttggcaaatatggaaccaggtatggcgctagcttgcgtaagcaaatcaagaagatggaggtatctcagcactccaagtacttctgcgagttttgtgggaagtttgctgtgaagaggaaagcagttggaatttggggatgcaaggactgtgggaaggtcaaggctggcggtgcttacaccatgaacactgctagtgcagtcactgtcagggagcacgaattcgtcgcttgagagagcagactggagcatganttagcttgctacatcagggttctcctaagtgctgttgtcgggaatgttgagctcctctagttggatcacgagactcgctaaaaagtggtgctaaagatttggagttggntaccggtgcggatttccccagggaaattatcctatgcctggccccaggactcaaaatggggttggggtt

SEQ ID NO: 28685 - protein, 86 aa, Zea mays
  misc_feature: Ceres CLONE 1402985-F
  misc_feature (2)..(83): Pfam Name: Ribosomal_L37ae Pfam Description: Ribosomal L37ae protein family
MTKRTKKAGIVGKYGTRYGASLRKQIKKMEVSQHSKYFCEFCGKFAVKRKAVGIWGCKDCGKVKAGGAYTMNTASAVTVREHEFVA

SEQ ID NO: 28686 - DNA, 685 bp, Zea mays
  misc_feature: Ceres CLONE 1402986-F
  misc_feature: Translation starting site: 178
  misc_feature: SWISSPROT Homolog: EC 3.2.1.4 Cellulase
aagctggagctccccgcggtggcggccgctctagaactagtggatcccccgggctgcaggaattcgcacgagaccattacctagaacatcctaatcgaaaactcccaaccgccgcgcgcgcgcgcagaaccaaccaacttaaaccgccaacaccgagcccaaggcacaaacgttcccatggcgcggctggtgtcgacggcgacgaaggcaatggcggtcgtggtcctcgcggcggcgtcggcagcgctggccgcgcacgactacggtgacgccctccacaagagcatcctcttcttcgaaggccagcggtccggccggctgccaccgaaccagcgcctccggtggcggcaggactcggccatccacgacggcgccgaggcgggggtgggacctgacgggcgggtactacgacgcgtgcgacaacgtgaagttcgggttccctatggcgttcacggcgacgctcatgtcgtggggcctgatcgacttcggtcgcagcttcgacgcgcacgatgcgtaggcccgggacgcgatgcggtgtacgacggactacctgatgaaggcgacgtcgacgccggacgcgctgtacgtgcaggtggttgacgcatcccgatgacacactcgctgagagcagccgcatgtcatgtacactccgcagcacgagaactagctcgaacacagagatcca

SEQ ID NO: 28687 - DNA, 777 bp, Zea mays
  misc_feature: Ceres CLONE 1402989-F
  misc_feature: Encodes the peptide sequence at SEQ ID NO. 28688
  misc_feature (71)..(71): n is a, c, t, g, unknown, or other
  misc_feature (347)..(347): n is a, c, t, g, unknown, or other
  misc_feature (738)..(738): n is a, c, t, g, unknown, or other
aaagctggagctccccgcggtggcggccgctctagaactagtggatcccccgggctgcaggaattcgcacngagaccattacctagaacatcctaatcaaaaaacatatccccactctagccaagtagtcagtcctctccaatctccactctcctctcgcaccaccaaaaaaccggtcccaccgttcgccatgagctccgaagccggatgctcagctccagccgccgccgcgccggatggggcgggtggcggcagggtggagatcgacacgtcccgcgcgttcgagtccgtgcgcgaggccgtcgaccgtttcggtggcagcgccgcctggagctccgacctcgtcnagcgcatggtcgcgcccctcaagaaacatgaacactctgacccagctgcaaaggccatcaacgcccaggagccagttgccaagttaaagaacgagctggcaagtaaaggaaagggaaacccttgatgggctcaggggactggggggcacccagaaaatccttcccaaccctaaacttgaaatccggagggaagccctggaacccccccgaaaagggttggaacccgttttttgggggggggttttccccggaaaactggaaaccccccctttttgggggggggggccctggagaggggaaaaaaaaacccttgtgggtggtcccgggggtccccccgggggggaggaacccccaaaaaaacctttttttttttttgggggggggtgtgttnccctttttcgaaaaaaaaaacacaaaaaaagggggtttg

SEQ ID NO: 28688 - protein, 93 aa, Zea mays
  misc_feature: Ceres CLONE 1402989-F
  misc_feature (53)..(53): Xaa is any aa, unknown, or other
MSSEAGCSAPAAAAPDGAGGGRVEIDTSRAFESVREAVDRFGGSAAWSSDLVXRMVAPLKKHEHSDPAAKAINAQEPVAKLKNELASKGKGNP

SEQ ID NO: 28689 - DNA, 748 bp, Zea mays
  misc_feature: Ceres CLONE 1402990-F
  misc_feature: Translation starting site: 161
  misc_feature: SWISSPROT Homolog: EC 3.2.1.21 Beta-glucosidase
  misc_feature (454)..(454): n is a, c, t, g, unknown, or other
  misc_feature (479)..(479): n is a, c, t, g, unknown, or other
  misc_feature (519)..(519): n is a, c, t, g, unknown, or other
aaagctggagctccccgcggtggcggccgctctagaactagtggatcccccgggctgcaggaattcgcacgagaccattacctagaacatcctaatcgaaaaacacacttcacaagcagctcaaagctctagttctagctagctagcaaagggggggaaaatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctttactacacgatctgcaagagtaggcagccaaaatggagtccaaatgttgagcccctcggaaatcccacaaagggactgggtcccctctgacttcacctcggtgcccgcacttcagcgtaccaaattgaagtgcttgaatgangatggaaagggggaaagcaactggnatcacttctgccacatcatccggaaaggatactgaacggnaggcatttcaaaatgggagcgaatccgtaccctatggacaaaacggacgttaaattgctcagggaaatgggctggaacccttatgggtccctattcccttggcccaaaaacgggccgaaggaacccaagaggggggtttaaccccggggggttcaagaccaccaaaacccttcccattttggtggtgaaaaccgggaaaacccctttggaaatttttcccgggggaagc

SEQ ID NO: 28690 - DNA, 624 bp, Zea mays
  misc_feature: Ceres CLONE 1402999-F
  misc_feature: Encodes the peptide sequence at SEQ ID NO. 28691
  misc_feature (444)..(444): n is a, c, t, g, unknown, or other
  misc_feature (586)..(586): n is a, c, t, g, unknown, or other
caaagctggagctccaccgcggtggcggccgctctagaactagtggatcccccgggctgcaggaattcgcacgagaccattacctagaacatcctaatcgaaaaaaaatcccaccacccttttccccttccaaccctcgggatctctccggcccgccatggaagtgttctactacctcgtgttcggcgcgctcgccgccatcgtggcggcgctggagctcgccaagtccggcaaggaccgcgtcgccacctccccggccttcaactcatttaagaacaactacatcctcgtttactccctcatgatgtctggggactggctgcaggggccctacgtgtactacctctacagccagtacggcttcgacaagggcgacattggccgcctcttcatcgccggcttcggttcctccatgctcttcggcaccatcgtcggatccctcgncggataagcagggggcggaagagggcgtgtgtcacgtactgcatcacctacattctcaggtgcatcaccaacactcttcccagtacaaagtcttattgattggcggggtcttggtggcatttgcacttccctgcttttttangggttggactccgggtcgtggcaaaacacacaagaaag

SEQ ID NO: 28691 - protein, 97 aa, Zea mays
  misc_feature: Ceres CLONE 1402999-F
  misc_feature (96)..(96): Xaa is any aa, unknown, or other
MEVFYYLVFGALAAIVAALELAKSGKDRVATSPAFNSFKNNYILVYSLMMSGDWLQGPYVYYLYSQYGFDKGDIGRLFIAGFGSSMLFGTIVGSLXG

SEQ ID NO: 28692 - DNA, 617 bp, Zea mays
  misc_feature: Ceres CLONE 1403000-F
aagctggagctccccgcggtggcggccgctctagaactagtggatcccccgggctgcaggaattcgcacgagaccattacctagaacatcctaatcgaaaatctctatgacacgtgccccttcccccctcttaagctaagggacccttgggcagcccggcatcttctccaatctccacgctctgcccctctcgatttcttcttcacatctcccgatcgatcgcaagccagaccctactccagggagatctccgactccgccgacgctgacggagcgagcacagtagtctattcgctgtgatgatgtacgacagtatcgtatcagcagagtgagcttccgattgcccgtcgtcgtcgtggagagacggtacagtccgggagaccttacctccgaagctgcaggcccaaagaaccaatccaccactgctgggggatggcccccccccggacccttatggaccccttgtgcaagaaggccccccacagaaacgggaaatttggggcccggacgccaagggggtccaaaaacaaatcctaggccccaaaagaaagggcccataaaccaaactggggaaacaaagcccgggggaaaaacccgcccaaaatctggagggggct

SEQ ID NO: 28693 - DNA, 746 bp, Zea mays
  misc_feature: Ceres CLONE 1403001-F
  misc_feature: Encodes the peptide sequence at SEQ ID NO. 28694
  misc_feature (504)..(504): n is a, c, t, g, unknown, or other
aaagctggagctccccgcggtggcggccgctctagaactagtggatcccccgggctgcaggaattcgcacgagaccattacctagaacatcctaatcgaaaaatcttcgccgccgctaaacgttccccccacgccccaacctatccacgcgaaaccttctttcccccgggagacgattcgtcagggagaggaaagaggcaagaggggccatggacgctgccaagttggtgacgccggtcgctgtgtctcacattctggcgcacccgtcggcgggctccgacggcgcagtgaccgatctcgtcgttcaggtcctcgacctgaagtccgtcggcacgggcagccggttcagtttcacagcaactgacgggaaggataagatcaaggcgatgcttcccaccaacttcgggtcggaggtccgctctggcaacctgaagaaccctcggctcatccgcatcatcgactacacttgcaacgtcgtcaaaggcaaagatgacaaagtctggnttgtcatcaaatgcgagcttgtgtggcaagcgcttgacgccgagatcaacggcgaggccaaaaaagagagcctccaattgtgctgaagcctaaggacgaatgatgggcgtgacatccccactcgctatgaagcccagcaggaaggtgagtctgcgtcccagaacgtgaatgagcagcgtggaatactgctcctggcaagcccctttcatgacaaagagggcccatctttgatcctctgaccc

SEQ ID NO: 28694 - protein, 126 aa, Zea mays
  misc_feature: Ceres CLONE 1403001-F
  misc_feature (6)..(108): Pfam Name: Rep-A_N Pfam Description: Replication factor-A protein 1, N-terminal domain
  misc_feature (99)..(99): Xaa is any aa, unknown, or other
MDAAKLVTPVAVSHILAHPSAGSDGAVTDLVVQVLDLKSVGTGSRFSFTATDGKDKIKAMLPTNFGSEVRSGNLKNPRLIRIIDYTCNVVKGKDDKVWXVIKCELVWQALDAEINGEAKKESLQLC

SEQ ID NO: 28695 - DNA, 709 bp, Zea mays
  misc_feature: Ceres CLONE 1403002-F
  misc_feature: Encodes the peptide sequence at SEQ ID NO. 28696
tggagctccccgcggtggcggccgctctagaactagtggatcccccgggctgcaggaattcgcacgagaccattacctagaacatcctaatcaaaaaaacaatccagttctcctttcgccggaatctgtccctcctccccctcctccccgcctctgcgggtactggaccaccgtggagcgggcattcatccaggctaggtccattccttcctttgctcgtaagtgaccctgatttttgctctacgagtttgtttcgtgctccattgaatctaaatcccactccgcatttgcggattcatgccctactactattacaacccctttcatccatccattcctcgactaggttctcttctccatcgcggaagctccacccgagttgacgccagaagagaatcggtgcccctagggtgttctcgcagaattattttccagaagatttgcagatcgagtcgaaccctatgccccacgttaagcctgccgccggcctgcccccttaccaccacgggcgctccctggccccggggcagggtccagttcccacgggacatgggatgatgcacccgggaggtccgtgatcagtacgggccgcctggggccgagatgcacctaccaccgctggggcacgggcccgctccgttcccctaacacatggtgcctccgctgcccccaacggaggtcctggacaaaagctggttgccagcacggg

SEQ ID NO: 28696 - protein, 38 aa, Zea mays
  misc_feature: Ceres CLONE 1403002-F
MPHVKPAAGLPPYHHGRSLAPGQGPVPTGHGMMHPGGP

SEQ ID NO: 28697 - DNA, 757 bp, Zea mays
  misc_feature: Ceres CLONE 1403003-F
  misc_feature: Translation starting site: 212
  misc_feature: SWISSPROT Homolog: EC 5.5.1.4 Inositol-3-phosphate synthase
  misc_feature (331)..(331): n is a, c, t, g, unknown, or other
  misc_feature (414)..(414): n is a, c, t, g, unknown, or other
  misc_feature (415)..(415): n is a, c, t, g, unknown, or other
  misc_feature (420)..(420): n is a, c, t, g, unknown, or other
  misc_feature (421)..(421): n is a, c, t, g, unknown, or other
  misc_feature (676)..(676): n is a, c, t, g, unknown, or other
  misc_feature (682)..(682): n is a, c, t, g, unknown, or other
  misc_feature (683)..(683): n is a, c, t, g, unknown, or other
  misc_feature (732)..(732): n is a, c, t, g, unknown, or other
  misc_feature (757)..(757): n is a, c, t, g, unknown, or other
aagctggagctccccgcggtggcggccgctctagaactagtggatcccccgggctgcaggaattcgcacgagaccattacctagaacatcctaatcgaaaacacacaacccaaagcagccacagcagcctccttcctcctctcactctcgctcgcgctgcgctcgctacctcgcttcgcattccattcgaaaagaggggaggaaaggcaagatgttcatcgagagcttccgcgtcgagagcccccacgtgcggtacggcccgatggagatcgagtcggagtaccggtacgacacgacggagctggtacacgagggcaaggacggcgcctcnacgctgggtcgtccgccccaagtccgtcaagtacaacttccggagcagaaccgccgtcccaagctcggggtgatgcttgtggnngtggnngaggcaacaacgggtccacgctgacggctggggtcattgcaacaggggaggggatctcatgggcgaccaaggacaaggtgcagcaagccaactactacggctccctcacccaggcctccaccatcagagtcggagctaccacggggggaggagatctatgcgccgttcaagagcctccttcccatagtgaacccagacgacattggtgtttcggaggctgggacattagcaacatgaacctggccgactcctgancagggnncaagggtgctggatattgacctgcagaagcagctcaggccctacatggnagtccatggtgccacttcccgggan

SEQ ID NO: 28698 - DNA, 806 bp, Zea mays
  misc_feature: Ceres CLONE 1403004-F
  misc_feature: Encodes the peptide sequence at SEQ ID NO. 28699
  misc_feature (311)..(311): n is a, c, t, g, unknown, or other
  misc_feature (314)..(314): n is a, c, t, g, unknown, or other
  misc_feature (348)..(348): n is a, c, t, g, unknown, or other
aaagctggagctccccgcggtggcggccgctctagaactagtggatcccccgggctgcaggaattcgcacgagaccattacctagaacatcctaatcgaaaaaaccgaagcaatccgacctgagaccaagacccgcaccacgcggctcgccgccgatggcgaacgccgacgccgacgaagcgccgctgctctctgtggaacacctccgtccaggatcctgcagccgcgagctcgagctgcgggagttccgcgaccgctacgtgatccgttcgctcgacggcgccgccgctttcgccgtccttcgctccggnggntccatcccgcctctctcccccagagaaagcgtanctgaaagcgactggcaggttccagattattacggggtgtaggcaacataagaatgctccgtgggaagcaaggaacccgttaccccttccaaaaaaaaggttggttcttaatgggcgctccccgggggaccaggggaccccaagggaatttctagggcggaaaggggttttaaaggctttgccccccggaaaaagaggggggggggtacctttttggcccccccggaaaagggaaaaccactggggggggggttgtaatatccccccgggggggtttgggcataatctgtgggaggggctccccgggggtgggggggggggggccctaacccaccctgggaggcggggcggcccccctgttttgttggaaacaaaatttttggggaagaaattttttgagggcacggtgggggggcccccccccccccggagaggagaggtttttttcgcgccaacatt

SEQ ID NO: 28699 - protein, 77 aa, Zea mays
  misc_feature: Ceres CLONE 1403004-F
  misc_feature (65)..(65): Xaa is any aa, unknown, or other
MANADADEAPLLSVEHLRPGSCSRELELREFRDRYVIRSLDGAAAFAVLRSGGSIPPLSPRESVXESDWQVPDYYGV

SEQ ID NO: 28700 - DNA, 726 bp, Zea mays
  misc_feature: Ceres CLONE 1403005-F
  misc_feature: Encodes the peptide sequence at SEQ ID NO. 28701
  misc_feature (369)..(369): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
tggagctccccgcggtggcggccgctctagaactagtggatcccccgggctgcaggaattcgcacgagaccattacctagaacatcctaatcgaaaaatctctctcgctttctctagccatgacgctggtgaggatgccttgccgcctctgctgcttcctgctcgtcgtcgccgcctccgccgtctccgggcggggggcgggtggtcaccaccctcccgggctacgagggccgcctccccttccacctcgaaacaggttatgtggaggtggacgaggacgccggcgcggagctcttctactacttcgtccgggccgagtccggcgccgacgacagcgacaccccgttcgtcctccggatccccggcggncaacgctgctccgccttcagcggcctcgcctacgagataggtcccatcatgttcgtcgtggagccctaacacggcagcttgccgcgcctgcgctacaacccaaactcgtggacaagggtgcgcatattcttttttgtggatttcgcagttgggggccgggttttcccttctcccgagatggcaaaggctacacggctggaagcggtatcaaccacgctgcaacttgggcggaagttccccaacaagggggttcaacggaccattcctgaagaaccaggcaaatccctttctaactggaaggggaaaaacctaccctggggaaaaatcgggnnnnnnnnnnnnnnnnnnnnnnnnnnn

SEQ ID NO: 28701 - protein, 51 aa, Zea mays
  misc_feature: Ceres CLONE 1403005-F
MAKATRLEAVSTTLQLGRKFPNKGVQRTIPEEPGKSLSNWKGKNLPWGKIG

SEQ ID NO: 28702 - DNA, 742 bp, Zea mays
  misc_feature: Ceres CLONE 1403006-F
  misc_feature: Encodes the peptide sequence at SEQ ID NO. 28703
  misc_feature (459)..(459): n is a, c, t, g, unknown, or other
  misc_feature (475)..(475): n is a, c, t, g, unknown, or other
  misc_feature (522)..(522): n is a, c, t, g, unknown, or other
aaagctggagctccccgcggtggcggccgctctagaactagtggatcccccgggctgcaggaattcgcacgagaccattacctagaacatcctaatcgaaaaatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcagnagcatgacgggccggnctcggggcggcggcgtcagcatggccaacgccgccaacatccccggnaagtgcggcgtctccgtcggcgtgcccatcagccccaccgtcgactgcaccaagatcaactgatcgatggaaccatagtgggaggtagctcgctcgttggatggcagcgtacgtggccatcagcagcatgcagccgtcgtcgtaacagagatgccctacctacgtgggtgccatgcatcagactggcacataataaagaaagagatcctgcacccactag

SEQ ID NO: 28703 - protein, 127 aa, Zea mays
  misc_feature: Ceres CLONE 1403006-F
  misc_feature (36)..(123): Pfam Name: Tryp_alpha_amyl Pfam Description: Protease inhibitor/seed storage/LTP family
  misc_feature (86)..(86): Xaa is any aa, unknown, or other
  misc_feature (92)..(92): Xaa is any aa, unknown, or other
MAARSSSQQLVAAAVLAAALLLLAAGAGTASAAVSCGEVTSSVAPCLGYAMGSAASPSAACCSGVRSLNSRASSAADRQATCNCLXSMTGRXRGGGVSMANAANIPGKCGVSVGVPISPTVDCTKIN

SEQ ID NO: 28704 - DNA, 742 bp, Zea mays
  misc_feature: Ceres CLONE 1403008-F
  misc_feature: Encodes the peptide sequence at SEQ ID NO. 28705
  misc_feature (528)..(528): n is a, c, t, g, unknown, or other
aaagctggagctccccgcggtggcggccgctctagaactagtggatcccccgggctgcaggaattcgcacgagaccattacctagaacatcctaatcgaaaaatctctctcgctttctctagccatgacgctggtgaggatgccttgccgcctctgctgcttcctgctcgtcgtcgccgcctccgccgtctccgggcgggggcgggtggtcaccaccctcccgggatacgagggtcgcctccccttccacctcgaaacagggtatgtggaggtggacgaggacgccggcgcggagctcttctactacttcgtccggaccgagtccggagccgacgacagcgacaccccgttcgtcctccggatccccggcggccaacgctgctccgccttcagcggcctcgcctacgagataggtcccatcatgttcgtcgtggagccctacaacggcagcttgccgcgcctgcgctacaacccaaactcgtggacaaaggtggcgcatattctttttgtggattcgccagttggggnccgggttttcgttctccagagatgccaaaggctacaacgctggagcgatatcaccacgctgcactttgccgagttccctcacaagtggttcaacgaccatcctgagtaccatgcaaatcctttctacatcgatggagaatcatacgctggaaaaatgtaccattccctgcacagatgatttccagaaggtatgggagcagggatgaagccggcc

SEQ ID NO: 28705 - protein, 193 aa, Zea mays
  misc_feature: Ceres CLONE 1403008-F
  misc_feature (33)..(194): Pfam Name: Peptidase_S10 Pfam Description: Serine carboxypeptidase
  misc_feature: SWISSPROT Homolog: EC 2.3.1.91 Sinapoylglucose--choline O-sinapoyltransferase
  misc_feature (135)..(135): Xaa is any aa, unknown, or other
MTLVRMPCRLCCFLLVVAASAVSGRGRVVTTLPGYEGRLPFHLETGYVEVDEDAGAELFYYFVRTESGADDSDTPFVLRIPGGQRCSAFSGLAYEIGPIMFVVEPYNGSLPRLRYNPNSWTKVAHILFVDSPVGXRVFVLQRCQRLQRWSDITTLHFAEFPHKWFNDHPEYHANPFYIDGESYAGKMYHSLHR

SEQ ID NO: 28706 - DNA, 709 bp, Zea mays
  misc_feature: Ceres CLONE 1403010-F
  misc_feature: Encodes the peptide sequence at SEQ ID NO. 28707
  misc_feature (412)..(412): n is a, c, t, g, unknown, or other
aaagctggagctccccgcggtggcggccgctctagaactagtggatcccccgggctgcaggaattcgcacgagaccattacctagaacatcctaatcgaaaactgattacaaacccgtcctctgtccgtcctaccaccaccgctcacctcggtttggctttctcccctcttccgcacccgcttctcgctccggattccggattccctctgctctttccctaacgaaggtagccatggcggggagaggtaaggcgatcggctcaggcgccgccaagaaggtcacgtccaggagctccaaggctggcctccagttccccgtgggaaggatcgccaggttcctcaaggccggcaagtatgccgagagagtcggcgccggcgcccctgtctacctcgctgccgtgctcgagtatcnggctgctgaggttcttgagctggccggcaatgcggcacgtgacaacaagaagacccgcatcgtaccgcgccacatccagctcgccgtccgcaacgacgaagagctctcccgcttgctgggcacggtgacatcgctagcggtggtgtaatgcccaacatccataaccttttgctcccgaagaaggccggcggcggcagcgccagggctgcggctggtgacgaggactaagttcttgactacgcctggtggcactccgggatgctgccgatcaccatgtggctgtggagaaagttagct

SEQ ID NO: 28707 - protein, 108 aa, Zea mays
  misc_feature: Ceres CLONE 1403010-F
  misc_feature (19)..(92): Pfam Name: Histone Pfam Description: Core histone H2A/H2B/H3/H4
  misc_feature (60)..(60): Xaa is any aa, unknown, or other
MAGRGKAIGSGAAKKVTSRSSKAGLQFPVGRIARFLKAGKYAERVGAGAPVYLAAVLEYXAAEVLELAGNAARDNKKTRIVPRHIQLAVRNDEELSRLLGTVTSLAVV

SEQ ID NO: 28708 - DNA, 760 bp, Zea mays
  misc_feature: Ceres CLONE 1403012-F
  misc_feature: Translation starting site: 613
  misc_feature: SWISSPROT Homolog: EC 3.2.1.23 Beta-galactosidase
  misc_feature (330)..(330): n is a, c, t, g, unknown, or other
  misc_feature (382)..(382): n is a, c, t, g, unknown, or other
  misc_feature (393)..(393): n is a, c, t, g, unknown, or other
  misc_feature (447)..(447): n is a, c, t, g, unknown, or other
  misc_feature (466)..(466): n is a, c, t, g, unknown, or other
  misc_feature (539)..(539): n is a, c, t, g, unknown, or other
  misc_feature (548)..(548): n is a, c, t, g, unknown, or other
  misc_feature (549)..(549): n is a, c, t, g, unknown, or other
  misc_feature (554)..(554): n is a, c, t, g, unknown, or other
  misc_feature (571)..(571): n is a, c, t, g, unknown, or other
ctggagctccccgcggtggcggccgctcttaaaaagtggatcccccgggcttgcaggaattcgcaacgagaccattacctagaacatcctaatccaaaaagttccccaccatcgtgctccgtacacgctccgctccggccaaggccgccgccgcggcctcctttttcggcccttgccgttccttctacttttgctgctggtgccgtcgctcgacggcgcctccaatgtgacgtacgaccaccgctccctcatcatcttcggccgccgccgcctcgtcatctccacctccatccactaccccccgcagcgtccccgaaatgtggcccaagnttggtggctgaagccaaggaccggcggcgccgactgcatcgagacctacgtncttctggaacnggccatgagatcgccccaggccatacctaacttcgaggaccggtttgaccctgntgcggttttcgtgaaggtncgttagagacgctggggctgctcttgatcctgcgcatcgggccctatgtcgccgccgagtggatttatggagncgtgcccgnntgtgnttgcactacgtgccagnaaacggttttcaggacaaacaacgagccattcaagaaccatatgaagagtttcacgacatacatcgtggatatgatgaagaaagagcagctcttcgtttctcagggagggaacattatcctagctcagatagagaacgaatatggagattattatgaacagccgtatggagctggcggcaaccatacgc

SEQ ID NO: 28709 - DNA, 759 bp, Zea mays
  misc_feature: Ceres CLONE 1403013-F
  misc_feature: Translation starting site: 138
  misc_feature (548)..(548): n is a, c, t, g, unknown, or other
  misc_feature (581)..(581): n is a, c, t, g, unknown, or other
aaagctggagctccccgcggtggcggccgctctagaactagtggatcccccgggctgcaggaattcgcacgagaaccattacctagaacatcctaatcgaaaaagggcagcgcgtgcggaaaccctagtcgccgccgatgtcggaccctttctacccgtactaccgcggagccttcccgggcggcgacggtgcgcagccgccgccacgttactcggattttgaggtcgacctcatcgcggcccgttacgccggcaccctattgccttatccatcctctgccgacgtcggcgccttcgactcgtatgtcggcgcgagacgattccgcggaagttctctatcaccaatcttttatgggaagtcatagtactgttggccagaatgaggctttatattcatcgaatactatggctaaacgccctaggcttgaaagcagccttcctatatatccacaacgaccgggagcaaaaggactgtgccttctatatgagcactggaacctgtaagtatggagagacctgcaaatttgaccatccacacgggttccagnaagggtggggttccaaactggaaagaggcccgnaaatgttgaagattcttatcctgagcgaccaggggaaccagattgtccttatttattgaataaatagatgtaagtttaattctaaatgcaagttcaaccatccgaaaggatatgggtggatgcattaggaacaggaacaaacaatgaatctctaattggctgatagcgctgtcttacc

SEQ ID NO: 28710 - DNA, 755 bp, Zea mays
  misc_feature: Ceres CLONE 1403014-F
  misc_feature: Encodes the peptide sequence at SEQ ID NO. 28711
  misc_feature (381)..(381): n is a, c, t, g, unknown, or other
  misc_feature (406)..(406): n is a, c, t, g, unknown, or other
  misc_feature (450)..(450): n is a, c, t, g, unknown, or other
  misc_feature (451)..(451): n is a, c, t, g, unknown, or other
  misc_feature (671)..(671): n is a, c, t, g, unknown, or other
  misc_feature (672)..(672): n is a, c, t, g, unknown, or other
caaagctggagctccccgcggtggcggccgctctagaactagtggatcccccgggctgcaggaattcgcacgagaccattacctagaacatcctaatcgaaagtcactcttgtgtcctcctaaaaccctaaccctccgccgcccctcggacccccaaccagcagctgccgcggccatccgccggcgagatggcgctgtacctgctgttcgagtcggcgtccggctacggtctattccacgcgtacggcatcgatgagatcgggcagagcgtggaggccgttcgctcctccgtgctggacctcgatcgcttcggcaaggccgtcaagctcaccgccttcaaccctttctcctctgccgtcgatgcactcaatcagtgcaacngctatatccgaagggatcatgaccngatgaactgaggagtttcctggagctgaacctgccgaagcccannggagggggaagaaggccaaaacaggccctcggggtcgtcgagcccccaaggtcggttctcacaatctccgaggtcaccggcattccctgccagagcaacgaattcgtccagagctgggctcccgcggtgtccgcctccacttcgaccgtttcacaacgagctttaaggattctgaacttggaaaaggcccagcttggcctggggcatagctacagcaggnnccaaggtggagttcaatggtgaatcgtgttgacccacatggtgatccaggcaatctttctattgaatacgcttgacaaggaca

SEQ ID NO: 28711 - protein, 75 aa, Zea mays
  misc_feature: Ceres CLONE 1403014-F
  misc_feature (3)..(69): Pfam Name: NOP5NT Pfam Description: NOP5NT (NUC127) domain
  misc_feature (65)..(65): Xaa is any aa, unknown, or other
  misc_feature (73)..(73): Xaa is any aa, unknown, or other
MALYLLFESASGYGLFHAYGIDEIGQSVEAVRSSVLDLDRFGKAVKLTAFNPFSSAVDALNQCNXYIRRDHDXMN

SEQ ID NO: 28712 - DNA, 645 bp, Zea mays
  misc_feature: Ceres CLONE 1403019-R
cgaggtcgacggtatcgatattttttttttttttttttatttttttttttttttttttttttttttttggaaatttttgtcttcatgtaacaacgctttacagttacattcatttaccactttcaacccccaccggcaattcttgctgtgcaagcggtactttcaaatttcagttacacccacgtaagcccacatatgcaaaaaaaaaaaattaaaaaaaaataccagaattttacaggaggcatacggttgtcggctcagcagacctcaacgatcaaattgtttgtccagcagaattctaaaggctctgaaagcagtctgctggaaacattttgcctctgttgcaactaaaaagctctgtaaactatttggttgaatatataaacaaataacgactgcactgtcgtgactgtcatgaaccttctcacattgatctcaacattgcggaagatggtttcacatgatggcgttaaaaggacctcccactcgagttttcatgcaataactcgtccattggtatgttaggattttaccgctttgcaagtctaaaaaaactgggaaaaaaaaacttggttaaaccatttaccaaaatgaacgggatatctagcagggttttaccaaatgctcttccacaaggggggcaag

SEQ ID NO: 28713 - DNA, 729 bp, Zea mays
  misc_feature: Ceres CLONE 1403019-F
  misc_feature: Encodes the peptide sequence at SEQ ID NO. 28714
  misc_feature (351)..(351): n is a, c, t, g, unknown, or other
  misc_feature (352)..(352): n is a, c, t, g, unknown, or other
  misc_feature (389)..(389): n is a, c, t, g, unknown, or other
  misc_feature (390)..(390): n is a, c, t, g, unknown, or other
  misc_feature (409)..(409): n is a, c, t, g, unknown, or other
  misc_feature (428)..(428): n is a, c, t, g, unknown, or other
aaagctggagctccccgcggtggcggccgctctagaactagtggatcccccgggctgcaggaattcgcacgagaccattacctagaacatcctaatcgaaaaaaagcaaagccaacgggatctccctctcattccagaggactccgcgtcgtcaggcccgcttcgcgtgcgacgccggcatatagggtttcgccggcgccggcgatggacccaccccccgtgagccccgatcgctgggggcccgttcagggcggctggcgtcgggccctccggcctccgccgatatggcctcaatttctccgcctccagcctcctccaggcccccatcgcggccctccttgagtactccgnncgtagtccagtccggccctgccctggcggcgcacacnnccgtccgcggggccctcgntcgccgttgtcgggcgtcnggaggtcgatggtcttctctccgctgccgccgctgggggaacggggaggtttcgatccggattcagggcggcccaggcgacacggaggccacgggcgggccggatgcggggacctcgtccgaggatttgatcgaggcgaccgccgggctctgaggttgaccaggcctccgctgcgggcaggggtgcaggcgctacggatgcggaggcaaacgggggcggggccggcacgtcggggaaagggggcggggaccgcgcgtaccagcgctacgacgtgcacacggttgcgcgggggttcgaacac

SEQ ID NO: 28714 - protein, 98 aa, Zea mays
  misc_feature: Ceres CLONE 1403019-F
  misc_feature (23)..(23): Xaa is any aa, unknown, or other
  misc_feature (36)..(36): Xaa is any aa, unknown, or other
  misc_feature (42)..(42): Xaa is any aa, unknown, or other
MASISPPPASSRPPSRPSLSTPXVVQSGPALAAHTXVRGALXRRCRASGGRWSSLRCRRWGNGEVSIRIQGGPGDTEATGGPDAGTSSEDLIEATAGL

SEQ ID NO: 28715 - DNA, 675 bp, Zea mays
  misc_feature: Ceres CLONE 1403020-F
  misc_feature: Encodes the peptide sequence at SEQ ID NO. 28716
aaagctggagctccccgcggtggcggccgctctagaactagtggatcccccgggctgcaggaattcgcacgagaccattacctagaacatcctaaaaaaaaaaacctagctagatttagaggaaaaaaaaaactgtccccaaccgtgagatggctgagtacggcgagcgctaccagggcaacggcgacccggccacgcccgagggtggctacgcgcagaccgagtacgccgccgccggtggctcgccgcccgccgaccgcaagccctccgtgttctccgaccacgctgacggtcgctcctcccagccccagcatgagactcaatcacatggcagtggttcctccaaatctcgagaaagggaccgagaacgtgataagggaaaggacagggagcgaggcagagaccgtgtccgcgaaaaggagagggaccgagacagggacaaggatcgtgaaagaggtgacagagacagggatcgtgatcgccaccacatggatcgtcgcgagcgcagcgagataagggaacaccgtgatcgttctgatgatcgtgaccgtcaccgcgatgatcgtgaccgtcgcaggagtcatgattctgagaggagaagagatcgtgacagagatggccatcgtaggcatcgctcccgttccccttctaagagtcgtgaccgtgaccgcagat

SEQ ID NO: 28716 - protein, 175 aa, Zea mays
  misc_feature: Ceres CLONE 1403020-F
MAEYGERYQGNGDPATPEGGYAQTEYAAAGGSPPADRKPSVFSDHADGRSSQPQHETQSHGSGSSKSRERDRERDKGKDRERGRDRVREKERDRDRDKDRERGDRDRDRDRHHMDRRERSEIREHRDRSDDRDRHRDDRDRRRSHDSERRRDRDRDGHRRHRSRSPSKSRDRDRR

SEQ ID NO: 28717 - DNA, 708 bp, Zea mays
  misc_feature: Ceres CLONE 1403021-F
  misc_feature (342)..(342): n is a, c, t, g, unknown, or other
  misc_feature (518)..(518): n is a, c, t, g, unknown, or other
  misc_feature (584)..(584): n is a, c, t, g, unknown, or other
  misc_feature (684)..(684): n is a, c, t, g, unknown, or other
ggagctccccgcggtggcggccgctctagaactagtggatcccccgggctgcaggaattcgcacgagaccattacctagaacatcctaatcgaaaaaaaatagcaatttttccccctgggagcccgagacgcagcgcgaggtgcggccccgtcccctcgccaccggaggagcaggacgacgaggtggcgtcggcgcgaggtagtcgcgcgcctggaagagcggcggcatcggagtcgcaggcggaggcgaggaagtgaggggagagccctatagccaccgcccgcggggcgtcgtgctcgctgcacgcactcccaccattttgtcccaactcgaagctcagnactcgtggctgtcgtgctgtgcacgacccctcccctagcatcccaagctcctaactgagaaaacaggagatgggaagagacggggaacagactaggcgccggagccgcaagagatcccgcgacgccctcccctcctcgtcggattccgattccttcgactcccatccctctcgagnagtagccctgagcgacggagccgcagcagtaagcgggatagattatcctcatcgcaccgccccagncgaagaaaagggaccgggtcggggaaatccccggacgaagaacggccggggggggaaaaaaacgggccagaaaaaaggggcccccgggggggattgtttnaaaacccccccaactcccaaaggg

SEQ ID NO: 28718 - DNA, 735 bp, Zea mays
  misc_feature: Ceres CLONE 1403024-F
  misc_feature: Encodes the peptide sequence at SEQ ID NO. 28719
  misc_feature (383)..(383): n is a, c, t, g, unknown, or other
  misc_feature (399)..(399): n is a, c, t, g, unknown, or other
  misc_feature (440)..(440): n is a, c, t, g, unknown, or other
  misc_feature (450)..(450): n is a, c, t, g, unknown, or other
  misc_feature (459)..(459): n is a, c, t, g, unknown, or other
  misc_feature (460)..(460): n is a, c, t, g, unknown, or other
  misc_feature (463)..(463): n is a, c, t, g, unknown, or other
  misc_feature (467)..(467): n is a, c, t, g, unknown, or other
  misc_feature (493)..(493): n is a, c, t, g, unknown, or other
  misc_feature (552)..(552): n is a, c, t, g, unknown, or other
  misc_feature (569)..(569): n is a, c, t, g, unknown, or other
  misc_feature (571)..(571): n is a, c, t, g, unknown, or other
  misc_feature (677)..(677): n is a, c, t, g, unknown, or other
tggagctccccgcggtggcggccgctctagaactagtggatcccccgggctgcaggaattcgcacgagaccattacctagaacatcctaatcgaaaaaaaaccaatcacatctcctccccctgaccccctcccaccaccgaggacccttccccaagaactgccccgagtcctggagcgggagagaggtcgagggaggagtccaataagagtttctcctcgcctctctctctttctgctcgaaaaattattgtcgcattggtttggttcccttgccaaaggaggcggctttctgtcctcgctgatctaacatgatggcgagcaccgcgtcagcgaccggccgccgccgccgtggggcattcggggcagccgccaagccgcgggnaccgggcggcggcgcntccgcgcaagagtgcctggccggcggcaggcggcgtccggnaatggggggntggcgctgnnacnccgnccgcggaggccccaggcgcaggcggngggccaaggccggccagcatcgccgcggctcgagcaggtcaagatctccgcagaccggnacatgaaggaaaggagnanggcagctgggatagggctcagtgtacacacaggaccagggcagatgcgggaaaaacttggggttggagaagaaatatggcccccgggctattcaggaactaactantctaaaccataagggaaagggcgctggtccaagtacttggaggagaacgggaacttat

SEQ ID NO: 28719 - protein, 44 aa, Zea mays
  misc_feature: Ceres CLONE 1403024-F
  misc_feature: SWISSPROT Homolog: EC 1.2.1.70 Glutamyl-tRNA reductase
  misc_feature (5)..(5): Xaa is any aa, unknown, or other
  misc_feature (6)..(6): Xaa is any aa, unknown, or other
  misc_feature (41)..(41): Xaa is any aa, unknown, or other
MKERXXAAGIGLSVHTGPGQMREKLGVGEEIWPPGYSGTNXSKP

SEQ ID NO: 28720 - DNA, 757 bp, Zea mays
  misc_feature: Ceres CLONE 1403025-F
  misc_feature (359)..(359): n is a, c, t, g, unknown, or other
  misc_feature (448)..(448): n is a, c, t, g, unknown, or other
  misc_feature (458)..(458): n is a, c, t, g, unknown, or other
  misc_feature (527)..(527): n is a, c, t, g, unknown, or other
  misc_feature (528)..(528): n is a, c, t, g, unknown, or other
aaagctggagctccccgcggtggcggccgctctagaactagtggatcccccgggctgcaggaattcgcacgagaccattacctagaacatcctaatcgaaaagcatccccttttcccgtccatgcgcgcgccggcgggcggtgccagtgccaccgcgctcgcggcggccatgaacattaagcagccgctgcacggcgcatcgacgctgttcgcgctgctctctctctcgctgctcctcctccgcctgctcctccgcctccgcctggccgccttccgcgacgcggcgctgtcgctccacctgctggcgcgcctccgcctccgccccgtcctcctctgcctcccggcagcctgccacgacnggcggcgcccggcgccggcgccaccacgcttgcgcgtctggtgccccgccaccccatcctccaagccgccgctgctcctcctccagggntttcggcggngaacgccagtgggacgtggggcgcgcaacctcccgcgcctgtcccgccacttccacgtgtacgcgccgnnacctcgtgttcttcggcgcgcagtcccggtccgcgtcgccgctgcgcttccgtggcgttccaggcccgctgcgccgccgaggccatgcgcctcctcggcgtgccccgctacgaacgtgcggggatccgctaccgcggcttctcgcctaccggatggcgcccgccaagccagggacgccgtgggcaggctcgtcatcttgaccacgggggtcgcggccagccccgggaaa

SEQ ID NO: 28721 - DNA, 679 bp, Zea mays
  misc_feature: Ceres CLONE 1403026-R
  misc_feature: SWISSPROT Homolog: EC 2.3.1.15 Glycerol-3-phosphate O-acyltransferase
ccgattgggtaccgggccccccctcgaggtcgacggtatcgataagcttttttttttttttttttctgacgaaactttgtattaagacggctctaacaactcttccgcccttcttccggaaaggaagaattgtattatctggggaccaccatcgagcttgcccttttacacgggccacatcacactggccaacttgtcggcaaggatcaataaactggaataattttgaacagtacttaatcgggagtctgtcgcgcagggcccgagagcgacgctggccgttagttcttatccttctccttctccttctccttctccttgttcttgggacggacacggccgtcagagccagcgagcatgccgtacttctccttgcgcgtgatggacgtgcactccaatccaaggtgtccactcaccgtcttctggatataagtggccacctcgatgggagacttgccgccgctgcacctgaggtctttgattagctgagtgaggaacgtgatctcgtacatccggcgcgctttcttgaaaaagaagtaggcatccatgatcttctaaccgcgcacggtggagccgtggaacatgttctccattggcgttgatgagcccggccaccatgtcgttcggtgagctcggccaaaagcgcgctaacccgcaccaggaaggacctcgcgcccgc

SEQ ID NO: 28722 - DNA, 750 bp, Zea mays
  misc_feature: Ceres CLONE 1403028-F
  misc_feature: Encodes the peptide sequence at SEQ ID NO. 28723
  misc_feature (272)..(272): n is a, c, t, g, unknown, or other
  misc_feature (292)..(292): n is a, c, t, g, unknown, or other
  misc_feature (418)..(418): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (552)..(552): n is a, c, t, g, unknown, or other
  misc_feature (553)..(553): n is a, c, t, g, unknown, or other
  misc_feature (596)..(596): n is a, c, t, g, unknown, or other
  misc_feature (600)..(600): n is a, c, t, g, unknown, or other
  misc_feature (601)..(601): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (611)..(611): n is a, c, t, g, unknown, or other
  misc_feature (718)..(718): n is a, c, t, g, unknown, or other
tggagctccccgcggtggcggccgctctagaactagtggatcccccgggctgcaggaattcgcacgagaccattacctagaacatcctaatcgaaaaatcacacactaatcaacaagcaggaccagctagctagctcctctcactgctatcacccgcccagccatctcgctgaaagagaaaagcgcagccatgaagactactagctcgggcattgcagtcgtcctactggtggccatgctggcagtccattccgcgttggccgacatctcgntgctccgacgtgctcaacgnacctgtcgccgtgcctgcccttcctgcagggcaaggcagccaaacccagcgagagcaacaaccagtgctgcgaacggcgtgagggccctgtaccgcggcggcggacaccaggcccgacaggcaggncacggtgccggtgcctcaggtcggccttacgttcaggggtccacgctgtgctcccccgcggcggcaggagctgccccggcgactgcgnnncctctcgctgtcctacaacatcacccccgacatcgactgcgacnnagatcgaatgaaaggggatactgttcccttaccagatcctacnacgnngnnngggggnagatgttcagggcccctgctagcagtaggctgcatctgcactgagtgctagaataaaaggatttttggggagagttgggttcaaaaatagggggttcgcccgaaccnggggaagggggcccgcgttgcttttcttaata

SEQ ID NO: 28723 - protein, 33 aa, Zea mays
  misc_feature: Ceres CLONE 1403028-F
  misc_feature (14)..(14): Xaa is any aa, unknown, or other
  misc_feature (15)..(15): Xaa is any aa, unknown, or other
MKGDTVPLPDPTTXXGGRCSGPLLAVGCICTEC

SEQ ID NO: 28724 - DNA, 739 bp, Zea mays
  misc_feature: Ceres CLONE 1403029-F
  misc_feature (331)..(331): n is a, c, t, g, unknown, or other
  misc_feature (349)..(349): n is a, c, t, g, unknown, or other
  misc_feature (376)..(376): n is a, c, t, g, unknown, or other
  misc_feature (566)..(566): n is a, c, t, g, unknown, or other
ctggagctccccgcggtggcggccgctctagaactagtggatcccccgggctgcaggaattcgcacgagaccattacctagaacatcctaatcgaaaaactagtaccgccactcgaatgtcccgaccccgatggagacctctgccccgctagaaccctagctccggcgagtccttctctatgcgtcgagcctcgcagccgcggcgctcgaggtgcccgtgagcgtatggagatccctcgttgcgtgcttccctccgctcccggactcctccagcttccttgctggcgtctccgacctccggctccggtacttcggcaacagacggcccggnccgccgcaggcgatgcgntctacctctcctgctccgcacggtggnactgtactctgctcggattgctagtgagatgaccaaggctttgtgatcttagattgatgttggcatcaaacccggagtaattgggagggatttggaaaggttactatttggaaagggcaggtttgtgaaaaaatttccaaaaggggacttttttgattttgggagggcccaggggcctttggaggggggnaatttttaaatacataaaatggggagacagggccccctcccaaaaatttttgaattcgcgcccaaaagggggggcaaaaaaccggtgcccaaaaaaagaggaaaacggtggggggcttttttttgaagggggtttttttaaaaaaaaaaaacgggggggaggtataaaaaaaa

SEQ ID NO: 28725 - DNA, 675 bp, Zea mays
  misc_feature: Ceres CLONE 1403030-F
  misc_feature: Encodes the peptide sequence at SEQ ID NO. 28726
  misc_feature (368)..(368): n is a, c, t, g, unknown, or other
  misc_feature (369)..(369): n is a, c, t, g, unknown, or other
  misc_feature (452)..(452): n is a, c, t, g, unknown, or other
  misc_feature (461)..(461): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
tggagctccaccgcggtggcggccgctctagaactagtggatcccccgggctgcaggaattcgcacgagaccattaacctaagaacatcctaatcgaaaaaggccgcagctactccacggtgacggccgccatgagagccctcctctccctctcccgtctcgcccgacggcttccagcttctctcagccctgtaagggcgccgacaacattactcctccggcacatccatgcggatgcccctccgccgccgccatctcatgactcgacgcccttcgtctcccgcatcctcgaatcggagccgtgcctgaccccgaacgacgaagtcggagccggcatccgaatccgaccctcgacgagttcctcgcgnncgcttcgtggctgccttccggcccgcgactggcggctgccttcccaaccatggaccgtgaccgtgctcgacgagatgctccgncctcgtcgncggaacgcccgtgctgtgccgcctcaccggaccgaaacgggggggggcgatgctattgagctcaatgacacctcctgggcgccccnnnaatggaaaggcagcgccttcctgcgcgagctattgcccccgggataagggccggggcgaccttcgcaatacttcttggcgacgaggtgagaaaaaatgcgcgggttcctttggaatgtcggattcc

SEQ ID NO: 28726 - protein, 50 aa, Zea mays
  misc_feature: Ceres CLONE 1403030-F
  misc_feature (35)..(35): Xaa is any aa, unknown, or other
  misc_feature (36)..(36): Xaa is any aa, unknown, or other
MLRPRRRNARAVPPHRTETGGGDAIELNDTSWAPXXWKGSAFLRELLPPG

SEQ ID NO: 28727 - DNA, 687 bp, Zea mays
  misc_feature: Ceres CLONE 1403036-R
  misc_feature: SWISSPROT Homolog: EC 1.1.1.95 Phosphoglycerate dehydrogenase
cgattgggtaccgggccccccctcgaggtcgacggtatcgataagctttttttttttttttttacggataggtcttttttatacataaaaaaagtcgaaggaattatagattgaagcacggagtacatattattttttatcacctgggaaacagtgactgagaatggccccccgttcaaaaaatgggctgcatattgcaccaaattccagagcgccacttctagaataaccctcaaagcttatttaaggagaaccatccgtcctctatattgctaagctacattcaaagtgagcacaaagcgttgcaacttgaaacgatacatttgcgctaaattgcctaaagcttgaggaaaacaaactcttcaattgctggaatctccccaatctttctcaacgtgaccttgattgggtcctcatcgacaccgattgccatgaccgcatgcttgcgaggagcaatgcttccgacactcatgaaactgacattaatgttctcctcacccaaaaaacttcctaccgacccaatcatacctggctgatcgacctgcctgcaaaggatcaggtttccttccaagctcacatccacctggaatgatccaacctttgttagatgaggaacgccaaccttcactctcccctccactgtgatctctccagtctcagatatcgcactaggaaatttggacttga

SEQ ID NO: 28728 - DNA, 748 bp, Zea mays
  misc_feature: Ceres CLONE 1403038-F
  misc_feature: Encodes the peptide sequence at SEQ ID NO. 28729
  misc_feature (421)..(421): n is a, c, t, g, unknown, or other
  misc_feature (477)..(477): n is a, c, t, g, unknown, or other
  misc_feature (604)..(604): n is a, c, t, g, unknown, or other
  misc_feature (681)..(681): n is a, c, t, g, unknown, or other
aaagctggagctccccgcggtggcggccgctctagaactagtggatcccccgggctgcaggaattcgcacgagaccattacctaaaacatcctaatcgaaaactagctgatcgcgcgcgcacagggcgagcggacaagaaagcttgctttgtgctcaccggcggcacggaccccctgcgatggaagccgtcggcgtcactcctgcccccgtggcggcgccggagaagaagaagctgcttgacctcaaggaccccttccccgccgccgcgaacggcggcgccaggcgtcccgggcggcgaagtgggcgatgaagaagaagctggtgggcggcgacgccggctacgtgctcgaggacgtgccgcacctcacggattacatgccccagctcccgacatacccgaatcctctccaagacaacccnggcgtattcagtcgtcaagcaagtatttcgtcaacccagacgacaccgtcacgcanaaaagattgttgttcataagaccagtgccaggggcaccaacttcccggcgtgccgggccacggggcagcgggtgtacttcccagtccgatgaggtgaacgccgccattgtcaacctgtggaggcctnctgcccgggattgaacacggtcatcccgcgagcttgtttgcggcttgtaatgatatgtatggcgtctccagcgtcgnccggcatagaggtgggaataccagggtttctattctaaaaatactgttgcgttgacaccaaagtcgg

SEQ ID NO: 28729 - protein, 62 aa, Zea mays
  misc_feature: Ceres CLONE 1403038-F
  misc_feature (57)..(57): Xaa is any aa, unknown, or other
MKKKLVGGDAGYVLEDVPHLTDYMPQLPTYPNPLQDNPGVFSRQASISSTQTTPSRXKDCCS

SEQ ID NO: 28730 - DNA, 720 bp, Zea mays
  misc_feature: Ceres CLONE 1403040-F
  misc_feature: Encodes the peptide sequence at SEQ ID NO. 28731
  misc_feature (260)..(260): n is a, c, t, g, unknown, or other
  misc_feature (355)..(355): n is a, c, t, g, unknown, or other
  misc_feature (460)..(460): n is a, c, t, g, unknown, or other
  misc_feature (474)..(474): n is a, c, t, g, unknown, or other
  misc_feature (476)..(476): n is a, c, t, g, unknown, or other
  misc_feature (477)..(477): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (503)..(503): n is a, c, t, g, unknown, or other
  misc_feature (505)..(505): n is a, c, t, g, unknown, or other
  misc_feature (506)..(506): n is a, c, t, g, unknown, or other
  misc_feature (508)..(508): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (523)..(523): n is a, c, t, g, unknown, or other
  misc_feature (529)..(529): n is a, c, t, g, unknown, or other
  misc_feature (545)..(545): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (551)..(551): n is a, c, t, g, unknown, or other
  misc_feature (557)..(557): n is a, c, t, g, unknown, or other
  misc_feature (558)..(558): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (573)..(573): n is a, c, t, g, unknown, or other
  misc_feature (580)..(580): n is a, c, t, g, unknown, or other
  misc_feature (582)..(582): n is a, c, t, g, unknown, or other
  misc_feature (583)..(583): n is a, c, t, g, unknown, or other
  misc_feature (585)..(585): n is a, c, t, g, unknown, or other
  misc_feature (588)..(588): n is a, c, t, g, unknown, or other
  misc_feature (589)..(589): n is a, c, t, g, unknown, or other
  misc_feature (593)..(593): n is a, c, t, g, unknown, or other
  misc_feature (598)..(598): n is a, c, t, g, unknown, or other
  misc_feature (606)..(606): n is a, c, t, g, unknown, or other
  misc_feature (607)..(607): n is a, c, t, g, unknown, or other
  misc_feature (609)..(609): n is a, c, t, g, unknown, or other
  misc_feature (612)..(612): n is a, c, t, g, unknown, or other
  misc_feature (613)..(613): n is a, c, t, g, unknown, or other
  misc_feature (615)..(615): n is a, c, t, g, unknown, or other
  misc_feature (616)..(616): n is a, c, t, g, unknown, or other
  misc_feature (619)..(619): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (631)..(631): n is a, c, t, g, unknown, or other
  misc_feature (632)..(632): n is a, c, t, g, unknown, or other
  misc_feature (635)..(635): n is a, c, t, g, unknown, or other
  misc_feature (636)..(636): n is a, c, t, g, unknown, or other
  misc_feature (638)..(638): n is a, c, t, g, unknown, or other
  misc_feature (639)..(639): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (650)..(650): n is a, c, t, g, unknown, or other
  misc_feature (651)..(651): n is a, c, t, g, unknown, or other
  misc_feature (653)..(653): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (660)..(660): n is a, c, t, g, unknown, or other
  misc_feature (661)..(661): n is a, c, t, g, unknown, or other
  misc_feature (663)..(663): n is a, c, t, g, unknown, or other
  misc_feature (664)..(664): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (700)..(700): n is a, c, t, g, unknown, or other
  misc_feature (701)..(701): n is a, c, t, g, unknown, or other
  misc_feature (703)..(703): n is a, c, t, g, unknown, or other
  misc_feature (704)..(704): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
aaagctggagctccccgcggtggcggccgctctagaactagtggatcccccgggctgcaggaattcgcacgagaccattacctaaaacatcctaatcgaaaaaacacacgcgggcgcgctagctagtgagaagtcggagatgtcgtcgccgcggccacacttcctcgtgctcaccttccctttccagggccacatcgccccggctctccgcctcgccaggcagctgctcgcggcggcgcccgacgcgctcgtgacctttnccaccaccgaggtcgcgcacaggcgcatgttcccggcaaagcccaacgacggcgccaggaactccgacgaagacgcccgcctcgagttcctccgnttctccacggcacggagggccgggtacgtccggagcgccgaacctgggctcgttcaacgcctacatgacgtctccacgggcccgcgggggcggaagcgcccgcgnagatcgtgacgcgncnnccggggggggggnnnnnnncnnnggncnngngnnnnngnnnnnncngccccnccccgggggcggccgncnnncncgcggnncccccnnnnncccgnccgcgcncnncnggnncccncccgnccccccgnncnccnncnnccnccnnnnnnnccnnggnncnnccnnnnnnncnncnccnnncnncnncnnnnnncgnnnnnnnnnnnggnnnnnccnnnnncnngnnccnnnnnnnnnnnnnt

SEQ ID NO: 28731 - protein, 109 aa, Zea mays
  misc_feature: Ceres CLONE 1403040-F
  misc_feature (41)..(41): Xaa is any aa, unknown, or other
MSSPRPHFLVLTFPFQGHIAPALRLARQLLAAAPDALVTFXTTEVAHRRMFPAKPNDGARNSDEDARLEFLRFSTARRAGYVRSAEPGLVQRLHDVSTGPRGRKRPRRS

SEQ ID NO: 28732 - DNA, 789 bp, Zea mays
  misc_feature: Ceres CLONE 1403041-F
  misc_feature: Encodes the peptide sequence at SEQ ID NO. 28733
  misc_feature (371)..(371): n is a, c, t, g, unknown, or other
  misc_feature (402)..(402): n is a, c, t, g, unknown, or other
  misc_feature (403)..(403): n is a, c, t, g, unknown, or other
  misc_feature (409)..(409): n is a, c, t, g, unknown, or other
  misc_feature (421)..(421): n is a, c, t, g, unknown, or other
  misc_feature (436)..(436): n is a, c, t, g, unknown, or other
  misc_feature (479)..(479): n is a, c, t, g, unknown, or other
  misc_feature (691)..(691): n is a, c, t, g, unknown, or other
  misc_feature (703)..(703): n is a, c, t, g, unknown, or other
  misc_feature (705)..(705): n is a, c, t, g, unknown, or other
  misc_feature (706)..(706): n is a, c, t, g, unknown, or other
  misc_feature (747)..(747): n is a, c, t, g, unknown, or other
  misc_feature (760)..(760): n is a, c, t, g, unknown, or other
  misc_feature (761)..(761): n is a, c, t, g, unknown, or other
  misc_feature (767)..(767): n is a, c, t, g, unknown, or other
  misc_feature (769)..(769): n is a, c, t, g, unknown, or other
  misc_feature (780)..(780): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (787)..(787): n is a, c, t, g, unknown, or other
aaagctggagctccccgcggtggcggccgctctagaactagtggatcccccgggctgcaggaattcgcacgagaccattacctagaacatcctaatcgaaaagtatcgtctcctctccttcctgacattggcactggcagctgcactcaccggaagccatggaagacttgctctactactccctcaccatagccatctgcatcgcagtcatcgccctcctctccatccttcgttcgttcaccgctaccggacggccgccggcgctcccgcccggcccgtcgctgctgtcgctgatcaccccgctcctcttcctcggccgaacgaacttcggcatcgagcggatctctcccgccgcgcggtcccgctacggncccgtcttcacgctctacctgctcccgtccnngccggncatcttcatcgnccgacacgccgtggngcaccgcgtggctggtgccaggggcgcgccgccttcgccgacnggggcggcggccaggctcccccttccgcttcttcctcagtgaccaggggaaaattcattccgggccttaggggcccggtttgggggggggtttcggaaaaaccttaggggaaaaggggttccccccccccgccatgggcccgtttccccccccccccccccccgggggtgggggggtttccccccccggggttccggcgggaaacccaaaanggggcccccctntnnaaaaggggctccttcccacgggaatttttcccccccccccnccaagggtgtttnngggggngnccccccccccnaannngnat

SEQ ID NO: 28733 - protein, 120 aa, Zea mays
  misc_feature: Ceres CLONE 1403041-F
  misc_feature (82)..(82): Xaa is any aa, unknown, or other
  misc_feature (84)..(84): Xaa is any aa, unknown, or other
  misc_feature (88)..(88): Xaa is any aa, unknown, or other
  misc_feature (93)..(93): Xaa is any aa, unknown, or other
MEDLLYYSLTIAICIAVIALLSILRSFTATGRPPALPPGPSLLSLITPLLFLGRTNFGIERISPAARSRYGPVFTLYLLPSXPXIFIXRHAVXHRVAGARGAPPSPTGAAARLPLPLLPQ

SEQ ID NO: 28734 - DNA, 764 bp, Zea mays
  misc_feature: Ceres CLONE 1403044-F
  misc_feature: Translation starting site: 373
  misc_feature: Pfam Name: PFK Pfam Description: Phosphofructokinase
  misc_feature (342)..(342): n is a, c, t, g, unknown, or other
  misc_feature (474)..(474): n is a, c, t, g, unknown, or other
  misc_feature (475)..(475): n is a, c, t, g, unknown, or other
  misc_feature (561)..(561): n is a, c, t, g, unknown, or other
ggagctccccgcggtggcggccgctctagaactagtggatcccccgggctgcaggaattcgcacgagaccattacctagaacatcctaatcgaaaactagctgatcgcgcgcgcacagggcgagcggacaagaaagcttgctttgtgctcaccggcggcacggaccccctgcgatggaagccgtcggcgtcactcctgcccccgtggcggcgccggagaagaagaagctgcttgacctcaaggaccccttccccgccgccgcgaacggcggcgccaggcgtcccgcggcggcgaagtgggcgatgaagaagaagctggtgggcggcgacgccggctacgtgnctcgaggacgtgccgcacctcacggattacatgccccagctcccgacatacccgaatcctctccaagacaacccgggcgtattcagttcgtcaaagcagtatttcgtcaacccagacgacaccgtcacgcannaaagattggttgttcataagaccagtgccaggggcacccaacttccgggcgtgccgggccacggggcagcgggttgtacttccagncccgatgaggtgaacgccgccattgtcaacctgtggaggctcttgcccgggattgaacacggtcatcccgcgagcttgtttgcggcttgaatgatatgtatggcgtctcccgcgcgtccggcaataaaggtgggataccaggggttctattctaaaaaaacttgtgcgttgaccccaaagtcgtgaacgactccataaaaaat

SEQ ID NO: 28735 - DNA, 741 bp, Zea mays
  misc_feature: Ceres CLONE 1403046-F
  misc_feature (237)..(237): n is a, c, t, g, unknown, or other
  misc_feature (333)..(333): n is a, c, t, g, unknown, or other
  misc_feature (373)..(373): n is a, c, t, g, unknown, or other
aagctggagctccccgcggtggcggccgctctagaactagtggatcccccgggctgcaggaattcgcacgagaccattacctagaacatcctaatcgaaaaacattagattttttgtatgaaacgcccgcaaccgacttgctcctcaagcctccctgcctgccagctcactcgccttcttcctcccattcccctcgaatcaaccagcagcgattcagatcgaaacgaaacgaaccanaccaaccaactcgccaccctccaaagccgcagccccaatcccaccgcccggccagcaggcagagcgcgccccgcgccatgtcagccacgtcgtcgntcacagcggggggagtcgtctcgagctggcgagcaaccgnagcgcgacgagggtggtcgagtttctggactgcccttggggtagcactctcctccgccatcgtcgtaatcggggccaacgacgaggggggcacgaagctcggggccgggggctcccaaaattttttttcaacctcaagccccccggtggtgggggcccccctaatttgggcccggcccaaagcgatatcgcccggaaataaaggggtttttcggggtacaaaccccgggggtttgtggcccccggggcccaagggggcccccctttgggggaaacaaaagagcgaaggggggtttaaaaaccgggttttttttcccggaaaaaaccccccccccacacgggttcctctcccccccccaagaccccccc

SEQ ID NO: 28736 - DNA, 735 bp, Zea mays
  misc_feature: Ceres CLONE 1403048-F
  misc_feature: Translation starting site: 145
  misc_feature (338)..(338): n is a, c, t, g, unknown, or other
  misc_feature (345)..(345): n is a, c, t, g, unknown, or other
  misc_feature (353)..(353): n is a, c, t, g, unknown, or other
  misc_feature (375)..(375): n is a, c, t, g, unknown, or other
  misc_feature (410)..(410): n is a, c, t, g, unknown, or other
  misc_feature (411)..(411): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (635)..(635): n is a, c, t, g, unknown, or other
  misc_feature (642)..(642): n is a, c, t, g, unknown, or other
  misc_feature (652)..(652): n is a, c, t, g, unknown, or other
  misc_feature (655)..(655): n is a, c, t, g, unknown, or other
  misc_feature (657)..(657): n is a, c, t, g, unknown, or other
  misc_feature (661)..(661): n is a, c, t, g, unknown, or other
  misc_feature (662)..(662): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (683)..(683): n is a, c, t, g, unknown, or other
  misc_feature (684)..(684): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (735)..(735): n is a, c, t, g, unknown, or other
tggagctccccgcggtggcggccgctctagaactagtggatcccccgggctgcaggaattcgcacgagaccattacctagaacatcctaatcgaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacaaccctcaatccgttgggcggcggcaacggccggggtgcccgctggncgccacngctgtcgngagcgcttccgcgtgctgctgnctggagcgcggcgcctccgccctacgacgacgacnncgcatcggggacatggcnnncgcttcgcggacacgctgtcggacacctccccgggctcgcccgcgcagcggcttcgtggtcggaggacggcgtcatcaactccgcgcccgcggggtgctgggcggcggcagctgcatcaacgccggcttctacacgcgggccagcgacgactacgtgcgggggcgtcgggtgggacctgggccgcccccgggccggcgtacggngggtggnaggcccgggnggngntccnncccggagctgnnnccccgggnngnnnnnnnnnnnngnnnnnnnggnnnnggnnnnnngnnnnnncggnnnncn

SEQ ID NO: 28737 - DNA, 742 bp, Zea mays
  misc_feature: Ceres CLONE 1403052-F
  misc_feature: Translation starting site: 189
  misc_feature (644)..(644): n is a, c, t, g, unknown, or other
  misc_feature (657)..(657): n is a, c, t, g, unknown, or other
  misc_feature (658)..(658): n is a, c, t, g, unknown, or other
aaagctggagctccccgcggtggcggccgctctagaactagtggatcccccgggctgcaggaattcgcacgagaccattacctagaacatcctaatcgaaaaatcgtacaaatgctccgcaacttcacagcgtatcatcgctttccatcgctcctactcctatcatccaaaaaatctgagcggtattgatggcgaccgaggaggacaagaaagcgtcggctaataaggtggcggaggaggagccctcggagaatgcggttcctgcggataacgcccccgcgctgaacaaggtcaaggcggacaatcggctacctgcggacaagtccgccggcaaggaggtaggctgacatagaaggggaggaagaaggcgaagaacagcgtggagacctacgacatctacatcttcaaggtctccgttctcccccaattcgccttgacctagccggttcctccttgaccgccaccgttgacgtcgtgttgccggcgagatacctcgccggaagacctcacctggacttttgcgacgcacgctccacacactcttgtaccctccggaatggacgactgcttctaggtcgtcgacgccaccatctccgcttggctgctcgacagccccatccgcctcttctcgctctcgatacggntcctctgcctgtnncgccatgaggatccggatcaccgtctctactccaggttacgtggcggaaaaacatcgcagaggcggtcggccaccgcttctgcc

SEQ ID NO: 28738 - DNA, 594 bp, Zea mays
  misc_feature: Ceres CLONE 1403055-F
  misc_feature: Encodes the peptide sequence at SEQ ID NO. 28739
aaagctggagctccccgcggtggcggccgctctagaactagtggatcccccgggctgcaggaattcgcacgagaccattacctagaacatcctaatcgaaaagtcgagttaacaaagtcacctcatccaatcttgcatccccatctctgtctttgctcctccatggccatggccatggcccgaccttgtgctttccttctcttcttcctagttcttttctcctacgacggatccggtcctgggagcagcagcaggaggagtggcgtcgctcaggccacgcagagagtcttcctgtatccacagggctccaaaggtctccctcatcctgaacagcaagtaagggaccgggaaccacttccagcccccccaagaactggattcaacgatccaaaggggcccaagggactacaatgggttcaacccccgttttccaaaaaaaccccaaagggtccttttggggaaaaaaaaaattggggggaaaaccttttcccccaaaaatccgaaaagggaccccccccccccccaaaaaaaggggattccccaggaaaatatggggtgggggaggggttccccccccctctcaaaaaggggggg

SEQ ID NO: 28739 - protein, 144 aa, Zea mays
  misc_feature: Ceres CLONE 1403055-F
  misc_feature: SWISSPROT Homolog: EC 3.2.1.26 Beta-fructofuranosidase
MAMAMARPCAFLLFFLVLFSYDGSGPGSSSRRSGVAQATQRVFLYPQGSKGLPHPEQQVRDREPLPAPPRTGFNDPKGPKGLQWVQPPFSKKTPKGPFGEKKNWGENLFPQKSEKGPPPPPKKGDSPGKYGVGEGFPPPLKKGG

SEQ ID NO: 28740 - DNA, 729 bp, Zea mays
  misc_feature: Ceres CLONE 1403058-F
  misc_feature: Encodes the peptide sequence at SEQ ID NO. 28741
  misc_feature (409)..(409): n is a, c, t, g, unknown, or other
  misc_feature (431)..(431): n is a, c, t, g, unknown, or other
  misc_feature (516)..(516): n is a, c, t, g, unknown, or other
caaagctggagctccccgcggtggcggccgctctagaactagtggatcccccgggctgcaggaattcgcacgagaccattacctagaacatcctaatcgaaaaaaaaaccccccctgccccagacgtcgcgcgcatgaaatgaaaccctagtgagtagtgaccctgtccggatcactgcgtggcgccgccatggcaccctccgctctggcctccctcccggcgccgctccggtcactgcggctcaagacgaagcagcaggagctactgctccgcgtctcggcgctggcgctcatctacgttctcgccttcgccgtccgcctcttctccgtcctccgctacgagtctatgatccacgagttcgacccctacttcaattaccgcaccacgctcttcctcacagagaacggntttagcgagttctggaactggntcgattccgagagctgtaacccgctcggggcggtttcttcggggggattcttcttccggggtctcatggttgacggcggggttgnttcaacgccttcctccgggggttttccctcgttgtcaaattccggggaggcttgggcctcacggggctttttttgcccgccaaacaatttttgtgctaccctttggggccggaattggggcatcccggggggggttttgaaccccccggtttatccccccgcccgggttattcccccctcccgggggggggccaaaaaaaaaaagggtcccct

SEQ ID NO: 28741 - protein, 179 aa, Zea mays
  misc_feature: Ceres CLONE 1403058-F
  misc_feature: SWISSPROT Homolog: EC 2.4.1.119 Dolichyl-diphosphooligosaccharide--protein glycotransferase
  misc_feature (81)..(81): Xaa is any aa, unknown, or other
  misc_feature (109)..(109): Xaa is any aa, unknown, or other
MAPSALASLPAPLRSLRLKTKQQELLLRVSALALIYVLAFAVRLFSVLRYESMIHEFDPYFNYRTTLFLTENGFSEFWNWXDSESCNPLGAVSSGGFFFRGLMVDGGVXSTPSSGGFPSLSNSGEAWASRGFFCPPNNFCATLWGRNWGIPGGVLNPPVYPPARVIPPSRGGAKKKKGP

SEQ ID NO: 28742 - DNA, 768 bp, Zea mays
  misc_feature: Ceres CLONE 1403059-F
  misc_feature: Encodes the peptide sequence at SEQ ID NO. 28743
  misc_feature (683)..(683): n is a, c, t, g, unknown, or other
  misc_feature (753)..(753): n is a, c, t, g, unknown, or other
  misc_feature (757)..(757): n is a, c, t, g, unknown, or other
acaagctggagctccccgcggtggcggccgctctagaactagtggatcccccgggctgcaggaattcgcacgagaccattacctagaacatcctaatcgaaaagtcgagttaacaaagtcacctcatccaatcttgcatccccatctctgtctttgctcctccatggccatggccatggcccgaccttgtgctttccttctcttcttcctagttcttttctcctacgacggatccggtcctgggagcagcagcaggaggagtggcgtcgctcaggccacgcagagagtcttcctgtatccacaggctcccaaggtctcctccatcgtgagcagcaagtacaggaccgcgtaccacttccagcctcccaagaactggatcaacgatccaaatggaccaatgtactacaatggtatctaccaccagttctaccagtacaacccaaacggctcgctctggggcaacatagtctgggcgcactcgttctccacagatctcgtgaactggatccggctcgcgccggcgatagagcggacgactccgagcgacatcaatggcttgctggacaggttcagccaccatcctcaagagcggccggcctgccatcatatacaccggcgccgacaccgaagaagcgtcaggtccaggaacttggcgttccccagaaactgtcgatccgacaccngggggggaagtgggtgagcaacaaaaaaaaccgttggattccaagccggttcggaacgaggctgaacccnaagncagttcagaga

SEQ ID NO: 28743 - protein, 178 aa, Zea mays
  misc_feature: Ceres CLONE 1403059-F
  misc_feature (64)..(175): Pfam Name: Glyco_hydro_32N Pfam Description: Glycosyl hydrolases family 32 N terminal
  misc_feature: SWISSPROT Homolog: EC 3.2.1.26 Beta-fructofuranosidase
  misc_feature (174)..(174): Xaa is any aa, unknown, or other
MAMAMARPCAFLLFFLVLFSYDGSGPGSSSRRSGVAQATQRVFLYPQAPKVSSIVSSKYRTAYHFQPPKNWINDPNGPMYYNGIYHQFYQYNPNGSLWGNIVWAHSFSTDLVNWIRLAPAIERTTPSDINGLLDRFSHHPQERPACHHIHRRRHRRSVRSRNLAFPRNCRSDTXGGSG

SEQ ID NO: 28744 - DNA, 704 bp, Zea mays
  misc_feature: Ceres CLONE 1403060-F
acaagctggagctccccgcggtggcggccgctctagaactagtggatcccccgggctgcaggaattcgcacgagaccattacctagaacatcctaatcgaaaactcactatatactcactcctgctgttttccgtccatccgcccaccggttcgcagcccgcgcctcaaaccctagccccgggcggatcgcggtgcggccttcgcggtggcagcgacgcggctcgtttgatccgattggtggtcgagccccggcctcgctgccgcgcttcgcttcgggtgtgcaagggcgtgagcacccagcacactcgcggatgggggaactggtgtgggtggccggatcaaagaatgggagcccttaccctggggcctccaagaatgttctccaagaggtatgggaaggatggggagaaggtttatcgctgtagaaaacaagccccttcaacttctattgcacaaggggggagaatggatgggggaacctgcgagaccgccaaggtgaaaaccttccccttataaaaccccagggggcccccaggaatttctcgcccgataagggctaagggaggaaggggttggttccttttctttaagggggggaggatgagaaacattttataccttgcgaaacgggcatgggaatgcccgtttgtgggggaaaaaaaccacccccagggggtggcaggcaaccacaaaaggggggggg

SEQ ID NO: 28745 - DNA, 632 bp, Zea mays
  misc_feature: Ceres CLONE 1403061-F
  misc_feature (27)..(27): n is a, c, t, g, unknown, or other
  misc_feature (227)..(227): n is a, c, t, g, unknown, or other
  misc_feature (246)..(246): n is a, c, t, g, unknown, or other
  misc_feature (252)..(252): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (264)..(264): n is a, c, t, g, unknown, or other
  misc_feature (265)..(265): n is a, c, t, g, unknown, or other
  misc_feature (267)..(267): n is a, c, t, g, unknown, or other
  misc_feature (268)..(268): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (304)..(304): n is a, c, t, g, unknown, or other
  misc_feature (313)..(313): n is a, c, t, g, unknown, or other
  misc_feature (314)..(314): n is a, c, t, g, unknown, or other
  misc_feature (332)..(332): n is a, c, t, g, unknown, or other
  misc_feature (337)..(337): n is a, c, t, g, unknown, or other
  misc_feature (364)..(364): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (572)..(572): n is a, c, t, g, unknown, or other
aaaaagctgggagcttccaccggcggntggggcggccgcttctagaaactagtgggatcccccccgggcttgcaggaattcgcacgagaaccattaacctaaaacatcctaatcgaaaaacgcacaccgcgacccagtccagagccagtacgtgcgaagcagcacgcacgctgcttgtccgcgtacgcgagaacgacgtcagggtcggcggtggcttttcagttggnaaaatatgacgggacgacnacaacngccgccgnnngnngnnaggtgcannncgggcgggctggcccggggggcttgnccttggtgnntgttccgggggttgcaanggggntttgggcggggggccccaaggcccccnaaaggggcgggggaaatttgggggggttggcccccctgttgggggccaaagggggacccttggggggggagagattccccgcggcccccgggaaaaagagtgttcccccccccggtgggggcggtacaaaaaatttccccctcggaaaaaattttttattttaaaaaccctcccgcgaaaaggggctcctccccccccnnnntttggnaaaaaaaaggtgtttataaacccccgggggggttgcggggaaaaaaaagggggccccccc

SEQ ID NO: 28746 - DNA, 750 bp, Zea mays
  misc_feature: Ceres CLONE 1403066-F
  misc_feature: Encodes the peptide sequence at SEQ ID NO. 28747
  misc_feature (486)..(486): n is a, c, t, g, unknown, or other
  misc_feature (498)..(498): n is a, c, t, g, unknown, or other
  misc_feature (550)..(550): n is a, c, t, g, unknown, or other
  misc_feature (675)..(675): n is a, c, t, g, unknown, or other
aaaagctggagctccccgcggtggcggccgctctagaactagtggatcccccgggctgcaggaattcgcacgagaccattacctagaacatcctaatcaaaaatcactcccagactgctccctcatacgtccattatttccgcaaagtgcaaccgagaatgacatgcagtcgtagtatcgtagataaccaccttatgtcgtacttcaccatcctactgctttcttcttttgctgcaacggtagcatatcctgctcgcagtgaattactgccttaccagatgaaaaaccaccattctgtatcgtcacacaacccacaaccgaaggatttcccaactgagcaactctaccgcgcctaccttgtaatccagcgcttcaagagcaccgtcaccagcgaccccaagaacgtcaccgcccacctggattggtcatgatctctgcggagaacgaccctacgtggggttctactgcggatcgccggcaggaggnagataagttganggtcatagggggtcattttgaatggctatagactacatgcacaaacgttggnaaaggtttcgttaatcagctccctgatctatctcttttccatgctgcttcaacccattttgggtggcgatataccccaattaacccggcctagggtactggtaccagcttcagtgtcggccgatnaagatctgcaattacggctcacaaaaaaaaagggatggtcctatgaatcctataaagtggggggggcggcggcaa

SEQ ID NO: 28747 - protein, 90 aa, Zea mays
  misc_feature: Ceres CLONE 1403066-F
MTCSRSIVDNHLMSYFTILLLSSFAATVAYPARSELLPYQMKNHHSVSSHNPQPKDFPTEQLYRAYLVIQRFKSTVTSDPKNVTAHLDWS

SEQ ID NO: 28748 - DNA, 758 bp, Zea mays
  misc_feature: Ceres CLONE 1403067-F
  misc_feature: Translation starting site: 184
  misc_feature (680)..(680): n is a, c, t, g, unknown, or other
  misc_feature (706)..(706): n is a, c, t, g, unknown, or other
  misc_feature (707)..(707): n is a, c, t, g, unknown, or other
  misc_feature (744)..(744): n is a, c, t, g, unknown, or other
caaagctggagctccccgcggtggcggccgctctagaactagtggatcccccgggctgcaggaattcgcacgagaccattacctagaacatcctaatcgaaaaaagctccttcgcctcgaaccctctcgcgcttggcttgctttcactctccagggccccactcccacctcgccgccgcagccatggcgatcacagcgccaactcccgacatcctcggcgagcgccagtccggccaggacgtccgcacgcagaacgtgatggcttgcggggcggtggccaacatcgtcaaatcctcgctcggccccgttggtctcgacaagatgctagtggacgatattggtgatgttacaatcactaatgatggagcaaccatacttaagatgttggaagttgagcatccagccgccaaggttcttgttgagttggctgagctccaagatcgtgaggtaggagatggaaactacttccgttgtcatcatagcggcagagttactcaagagaggcaatgatcttgtgaagaataagatccatccaacctctataatcagtggctacaggcttgctatgcgtgaagcctgcaaatatgttgaggaaaagttagcagtcaaggttgacaaacttggaaaagaatcccttatcactctgcaaaaactagcatgtcttcgaattgattaatagntgacagtgtttcttgccaactttggnntggtgaggcagttcaagccggaagactacaatgcccnagggagacgtgaaa

SEQ ID NO: 28749 - DNA, 763 bp, Zea mays
  misc_feature: Ceres CLONE 1403069-F
  misc_feature (686)..(686): n is a, c, t, g, unknown, or other
aaagctggagctccccgcggtggcggccgctctagaactagtggatcccccgggctgcaggaattcgcacgagaccattacctaaaacatctaatcgaaaaatcaaagcctctagagttatgccttgctttcactctccggtggcccactaccacctcgcctgcgaacacatgatcgattagcagcgcacgagtcccaacatcctcggggagagccaatgctggcagtgcggacccacgccgaatctgatgccttgagccccgttaacctgcatctgcacatgctggttcggtgcctctgctatcgactcgatgctagggaacgatatggttaatgttaggatcatcacagatgcagcaaccatactcaacatgctgtaatgggagaatccacccggcaagtctcttgctgaactgaccgagctccaagatcgtgagttaggagatggaactacttgcgctgccgtcataacgggagacctactcaagagaggccatgatcttgtgaagaataagatccatccaacctctataatcagtgactacaggcttgctatgcgtgaagcctgctgatatgttgaggaaaagttagcagcacggttgacaaaacttggaaaagatcccttatcaactctgcagagactagcatgtcttcgaattgattaatagtgacagtgatttcttgcnactttggtttgctgaggcagttcaagccgtgaagactacaatgcccaagggagacgtgaaatatccgatccagagca

SEQ ID NO: 28750 - DNA, 761 bp, Zea mays
  misc_feature: Ceres CLONE 1403071-F
  misc_feature (346)..(346): n is a, c, t, g, unknown, or other
  misc_feature (728)..(728): n is a, c, t, g, unknown, or other
aaaagctggagctccccgcggtggcggccgctctagaactagtggatcccccgggctgcaggaattcgcacgagaccattacctagaacatcctaatcgaaaaatctctctcgctttctctagccatgacgctggcgaggatgccttgccgcctctgctgcttcctgctcgtcgtcgccgcctccgccgtctccggacgagaggcggctggtcacacaccctcgggggctacgacggccgcctcccctaccacctagaagctgccatgcgagaggcggctgaagactccaatgatttccactcgtaatagttcgtgctgaccgagcgcgcagaccaccatgatgancaacattacgtgcttctgcgccctggtcactgcgcagagtaagcattctagggctggactacgggtgctacccaacgagtgcgcccagggagagctaacaatggccctagggggaaccgggaaaaaaacaaaaaaatggggggaatggggggaaaaaattctttggaaaagccccggaggggacaggttttggccccacagagagggcaaagtttacaaaaggggggggaaaaccccctctctttttctaaggtatacggaaaaaaaaacgccggggaaaaaaaaaacctcccccccgctgaaattttgggggaatttaatttggggaaggtttctcccctcccccccaatttttcaaaccctttggcaaaaagaaaaaaanccccttctcccccaaaaaaaaagaagcgccccc

SEQ ID NO: 28751 - DNA, 775 bp, Zea mays
  misc_feature: Ceres CLONE 1403077-F
  misc_feature (605)..(605): n is a, c, t, g, unknown, or other
  misc_feature (613)..(613): n is a, c, t, g, unknown, or other
  misc_feature (614)..(614): n is a, c, t, g, unknown, or other
  misc_feature (648)..(648): n is a, c, t, g, unknown, or other
  misc_feature (650)..(650): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (668)..(668): n is a, c, t, g, unknown, or other
  misc_feature (670)..(670): n is a, c, t, g, unknown, or other
  misc_feature (671)..(671): n is a, c, t, g, unknown, or other
  misc_feature (755)..(755): n is a, c, t, g, unknown, or other
aaagctggagctcctcgcggtggcggccgctctagaactagtggatcccccgggctgcaggaattcgcacgagaccattacctagaacatcctaatcgaaaagttgggtgccgtgcgagctccaagtacccctgtctccctcccgtcttgcgggcttgcctttgcctgttccatttccggctcctccagttggcaaaagactggggaagcttcccaccgggggggggggcgtgcccgccttcctaaaaaaataagggggaatccccccggggtttgtgggggagaatttgcccgcggggaaaccttttttcccaagaaaaatctccttaattggaaaaaaaacttttttttttttttttcttttggggggggggccccccaattttttgtgggaaaaaaagggggggggaaaaaaaaatttccttctcttccccccgcaaaccacaaagaggagaaacacaccccccccccccccccccccccggcgggggtggtggggggggggggcccaaaaaaaaaaagggggagaaaaaaaaaaaaaaaagggggggtgtgttttttttctcccccccccctccccccccccccccccttttttcctaatntttttttnnaaaaaaaaaaaaaaagaaagggaggggggcgccnanaaaannnncccctttttncnngttttttttgtggggaggagaaaagaaaaaacaccctccctctttttttttcttgtttgggggggtgggggggggggggggggnggaaaaaggaacaaaccccg

SEQ ID NO: 28752 - DNA, 760 bp, Zea mays
  misc_feature: Ceres CLONE 1403079-F
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (243)..(243): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (249)..(249): n is a, c, t, g, unknown, or other
  misc_feature (252)..(252): n is a, c, t, g, unknown, or other
  misc_feature (253)..(253): n is a, c, t, g, unknown, or other
  misc_feature (257)..(257): n is a, c, t, g, unknown, or other
  misc_feature (259)..(259): n is a, c, t, g, unknown, or other
  misc_feature (260)..(260): n is a, c, t, g, unknown, or other
  misc_feature (270)..(270): n is a, c, t, g, unknown, or other
  misc_feature (466)..(466): n is a, c, t, g, unknown, or other
  misc_feature (474)..(474): n is a, c, t, g, unknown, or other
  misc_feature (484)..(484): n is a, c, t, g, unknown, or other
  misc_feature (490)..(490): n is a, c, t, g, unknown, or other
  misc_feature (522)..(522): n is a, c, t, g, unknown, or other
  misc_feature (527)..(527): n is a, c, t, g, unknown, or other
  misc_feature (536)..(536): n is a, c, t, g, unknown, or other
  misc_feature (538)..(538): n is a, c, t, g, unknown, or other
  misc_feature (539)..(539): n is a, c, t, g, unknown, or other
  misc_feature (554)..(554): n is a, c, t, g, unknown, or other
  misc_feature (573)..(573): n is a, c, t, g, unknown, or other
  misc_feature (603)..(603): n is a, c, t, g, unknown, or other
  misc_feature (629)..(629): n is a, c, t, g, unknown, or other
  misc_feature (643)..(643): n is a, c, t, g, unknown, or other
  misc_feature (661)..(661): n is a, c, t, g, unknown, or other
  misc_feature (662)..(662): n is a, c, t, g, unknown, or other
  misc_feature (664)..(664): n is a, c, t, g, unknown, or other
  misc_feature (665)..(665): n is a, c, t, g, unknown, or other
  misc_feature (668)..(668): n is a, c, t, g, unknown, or other
  misc_feature (669)..(669): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (687)..(687): n is a, c, t, g, unknown, or other
  misc_feature (688)..(688): n is a, c, t, g, unknown, or other
  misc_feature (690)..(690): n is a, c, t, g, unknown, or other
  misc_feature (692)..(692): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (703)..(703): n is a, c, t, g, unknown, or other
  misc_feature (706)..(706): n is a, c, t, g, unknown, or other
  misc_feature (709)..(709): n is a, c, t, g, unknown, or other
  misc_feature (711)..(711): n is a, c, t, g, unknown, or other
  misc_feature (718)..(718): n is a, c, t, g, unknown, or other
  misc_feature (720)..(720): n is a, c, t, g, unknown, or other
  misc_feature (722)..(722): n is a, c, t, g, unknown, or other
  misc_feature (723)..(723): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (749)..(749): n is a, c, t, g, unknown, or other
caaagtgggagcttccccgcgggggcggccgctcttagaacttagtggatcccccgggctgcaggaattcgcacgagaaccatttaacctaagaacatcctaatcgaaaaacgggtcaccagtcaccacatccctccctccctgccatttgtttggttgttcctctcgcagtctcgctcgccaccaggcagcaggcatcccaatctcgcgagagcatttagcccggcggcggcnnntnnnttntnnntngtnncttncnngttcccttcnccttggcctcctctatggctgtacgactccaagagggcgatctcgctctctcgcgacggctagggggccgatgtccgaggcatgcaagttcccggccaacggcacctgatcgccaagaggccagtccaaaaaggcgggagtgcaatttagcgaagttctcgtagaaggaagccagatggcaaaaccagcacaagcnggcgcagntcacgaaaangaaccnttacaggccgcacagtgaaagtatagaggaancagcnaaccccaantnnggccccccgaaaacngatccctgccaccgaaaancggggcgtgccccaggacgcgaaggggggnaaggaaaaaaccaaagaaacaagggnaaccgcccaagaangcccccgaccgaaaaccnngnnggnnagnnnnnaaacgggaagnncngnggggggnnnanagnccnancctaagnangnngnnnnncnnngnnnnnnnnnnnnaanatgtttatttt

SEQ ID NO: 28753 - DNA, 765 bp, Zea mays
  misc_feature: Ceres CLONE 1403080-F
  misc_feature: Encodes the peptide sequence at SEQ ID NO. 28754
  misc_feature (626)..(626): n is a, c, t, g, unknown, or other
  misc_feature (713)..(713): n is a, c, t, g, unknown, or other
  misc_feature (731)..(731): n is a, c, t, g, unknown, or other
  misc_feature (746)..(746): n is a, c, t, g, unknown, or other
  misc_feature (747)..(747): n is a, c, t, g, unknown, or other
caaagctggagctccccgcggtggcggccgctctagaactagtggatcccccgggctgcaggaattcgcacgagaccatttacctaaaacatcctaatcgaaaaacttcttttcccccagttgcgttgcgtgcccctcgtttccacactttgttgcgctcctttagcgccggcggcccgtagcctcaatcatcatttccatttccatccggtttcttccgacgacggtgtgtacagagagcaggatcggacaagtctctgctggtagaagcattggcgcagcgccggctgttgggcacggcgccggcgcccgcgtgcgatgcggcgtcgcacggctcgggctccagccccgacgcgatgcggatcatgcctgggcgtgctgctaacggtcatcgtctgcacgctgctctactgcgtctactctggcggtggcggaagcgcaatgcccatccggagatccctgctggacagctaattgccggcggtcgagctcggacctgccgctcatggacctcgcctccatcctcgctgccaccgacaacttctccaggccacaaggcttcgggcgagggcggcttcggccccgtctacagagtgagaatcaaccccagggtcgatggatgtgcnacagctttagctgttttgttactctacatctaatagcaatatgcatgattttgcaggccgtgctgagcggcggctcccagatcgcgntgaacgttttttttcggncgggtcgcgcaaggnncccggcggaattccccga

SEQ ID NO: 28754 - protein, 100 aa, Zea mays
  misc_feature: Ceres CLONE 1403080-F
MRIMPGRAANGHRLHAALLRLLWRWRKRNAHPEIPAGQLIAGGRARTCRSWTSPPSSLPPTTSPGHKASGEGGFGPVYRVRINPRVDGCATALAVLLLYI

SEQ ID NO: 28755 - DNA, 723 bp, Zea mays
  misc_feature: Ceres CLONE 1403083-F
  misc_feature: Encodes the peptide sequence at SEQ ID NO. 28756
  misc_feature (420)..(420): n is a, c, t, g, unknown, or other
  misc_feature (421)..(421): n is a, c, t, g, unknown, or other
  misc_feature (439)..(439): n is a, c, t, g, unknown, or other
  misc_feature (610)..(610): n is a, c, t, g, unknown, or other
  misc_feature (641)..(641): n is a, c, t, g, unknown, or other
  misc_feature (671)..(671): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (683)..(683): n is a, c, t, g, unknown, or other
catagctggagctccccgcggtggcggccgctctagaactagtggatcccccgggctgcaggaattcgcacgagaccattacctagaacatcctaatcgaaaaaccgcatcgcctcgccgctgttccccgcaacctatcgacccaatctcgtccgacccggcgcgtcgtcccctccagatctccgtcgccctctccaggtagcagaaactgttctgctgcattctgacaaagtggagggcttaggagcttctgcttcttttatgtctgaacaatctttgctttatttgggattggttgggagagtactctcgtgcaactaggaaaaggcacaaggttccgtcccactgcatgcgtcaagagactgtctgggttttcttgttctgatttgtcatttgctggtgctcaaagcccggcttggnnttcctcgaaggatcagcnatctactcttgattggtggactttgtcgcatctgatatcaacttcataaatctttatccaagatggcgctgcaaaacattggtgcttaaaaccagggatgatgccttctacaggtacaagatgcccagaatgattaccaagatagcaaggcgcgtggtaatggtatcaagnacaaatgtttgtgaacatgttgacatagcanaagcacttgccaggccagcttcctaccacnagnnnaactttnaatgtgagtttggtgcacagtccaatttgatgagaaagaa

SEQ ID NO: 28756 - protein, 54 aa, Zea mays
  misc_feature: Ceres CLONE 1403083-F
  misc_feature (17)..(17): Xaa is any aa, unknown, or other
  misc_feature (28)..(28): Xaa is any aa, unknown, or other
  misc_feature (38)..(38): Xaa is any aa, unknown, or other
  misc_feature (39)..(39): Xaa is any aa, unknown, or other
  misc_feature (42)..(42): Xaa is any aa, unknown, or other
MPRMITKIARRVVMVSXTNVCEHVDIAXALARPASYHXXNFXCEFGAQSNLMRK

SEQ ID NO: 28757 - DNA, 755 bp, Zea mays
  misc_feature: Ceres CLONE 1403084-F
  misc_feature: Encodes the peptide sequence at SEQ ID NO. 28758
  misc_feature (507)..(507): n is a, c, t, g, unknown, or other
  misc_feature (553)..(553): n is a, c, t, g, unknown, or other
  misc_feature (557)..(557): n is a, c, t, g, unknown, or other
  misc_feature (558)..(558): n is a, c, t, g, unknown, or other
  misc_feature (610)..(610): n is a, c, t, g, unknown, or other
  misc_feature (624)..(624): n is a, c, t, g, unknown, or other
  misc_feature (657)..(657): n is a, c, t, g, unknown, or other
aaagctggagctccccgcggtggcggccgctctagaactagtggatcccccgggctgcaggaattcgcacgagaccattacctagaacatcctaatcgaaaagatctggaagggccaggtgggaggaccaagcttcgtcgacgtcgactcctcgtcctccctcagctcgctcgcttctctgcaattctccgcagccctccttttcccgctggcttcctcttttcaaaaccctcgctaatctcgtgccccgtcccacccacctctagcgcctcgcctccgcattctagggtttccccgcccccggcgccggccatgggaggcggtggtcgtcgacgcgggctctaagctgctcaaggccggcatcgcggcgcccgaccaggcacccccactggtaatgccgtcgaagatgaagctggacgttgaagaccaggagctggttggacggcgcggtggtaaaaagggaggtggtgcaccctggtggtgcgcggcttcgtcaaggactggganggccatggaggacctactcaactacgttctgacagggacattgggntggnnaaaatggggggacgagggccagattctcttcaccgaacccctcttcacgccnaagactcttcgggnagcattgggtgcagcttatggttggaaaagttncatggtttcaggcttttatgctctgaacaagctgtattgtcactctatgctggtggacgcatttccaggatgtacagttgacattggtcacgggaaaa

SEQ ID NO: 28758 - protein, 120 aa, Zea mays
  misc_feature: Ceres CLONE 1403084-F
  misc_feature (38)..(38): Xaa is any aa, unknown, or other
  misc_feature (55)..(55): Xaa is any aa, unknown, or other
  misc_feature (77)..(77): Xaa is any aa, unknown, or other
  misc_feature (88)..(88): Xaa is any aa, unknown, or other
MPSKMKLDVEDQELVGRRGGKKGGGAPWWCAASSRTGXAMEDLLNYVLTGTLGWXKWGDEGQILFTEPLFTPKTLRXALGAAYGWKSXMVSGFYALNKLYCHSMLVDAFPGCTVDIGHGK

SEQ ID NO: 28759 - DNA, 772 bp, Zea mays
  misc_feature: Ceres CLONE 1403085-F
  misc_feature: Encodes the peptide sequence at SEQ ID NO. 28760
  misc_feature (318)..(318): n is a, c, t, g, unknown, or other
  misc_feature (338)..(338): n is a, c, t, g, unknown, or other
  misc_feature (406)..(406): n is a, c, t, g, unknown, or other
catagctggagctccccgcggtggcggccgctctagaactagtggatcccccgggctgcaggaattcgcacgagaccattacctagaacatcctaatcgaaaaaaaaccgaagaggaggacaaaatttctcctctcgaagaaccctagcggcaaaacctttgctccgtcccgccgtcgcctgctcccatcccgccgccggcgctgccacccgcatctgccaaggggctcgccgccgtagaggctgctcgcggtgccgcgctctctcccgcgtccgatcttgattctcgcctcctccatgatctgcgcgatctcatggngaggtggcgggacgagccgntcgtgtctaagaagtcgaggctactcttcgagcgccggatcatcgagcgctacattgaaggacatggnaagtgtcccggccaccatggagacctccacatgaatggaatcgtggcgggaaagacccaaaccgatcgggaagccaagggctttggagggggaagggatcccgggacccctgggaattttcaaaacgggggggaggccccaggggttcaaaatttggtttggggaaaaagttttccccgggaaccaaaatttgggggggccctcccccaaaggccccccccgcggggttttaccccaaaaaaaaaggaaaaaagggccccaaaaccttttgggcaaaggggaaaaaaaacccgggcaaagagggggaggttcccccgcggggttgttcccggggaaaaaaatttttaaaaaatttcccccccacat

SEQ ID NO: 28760 - protein, 146 aa, Zea mays
  misc_feature: Ceres CLONE 1403085-F
  misc_feature (2)..(2): Xaa is any aa, unknown, or other
  misc_feature (9)..(9): Xaa is any aa, unknown, or other
MXRWRDEPXVSKKSRLLFERRIIERYIEGHGKCPGHHGDLHMNGIVAGKTQTDREAKGFGGGRDPGTPGNFQNGGEAPGVQNLVWGKSFPREPKFGGALPQRPPPRGFTPKKKEKRAPKPFGQRGKKTRAKRGRFPRGVVPGEKNF

SEQ ID NO: 28761 - DNA, 752 bp, Zea mays
  misc_feature: Ceres CLONE 1403087-F
  misc_feature: Encodes the peptide sequence at SEQ ID NO. 28762
  misc_feature (525)..(525): n is a, c, t, g, unknown, or other
  misc_feature (609)..(609): n is a, c, t, g, unknown, or other
caaagctggagctccccgcggtggcggccgctctagaactagtggatcccccgggctgcaggaattcgcacgagaccattacctagaacatcctaatcgaaaagccaagctttcctcaaaaactcgaaaaaggaacggagaaggcgtcctcgacgactgcccatggccgccgcccggacctagccagggattgttgtctcctgagtcccgacctaccaaggcggaaagggagagggggcgctgtggcgtcaggaaataactggaaggcgagggctgagggcgagcgcacagtcgggtggctatcgctttctttttcgttttctttttccggaggagagagtattagggatgccggttgctaggccggagccgcaggagccccgggtgatcgcccatgtcgacatggactgcttctatgctcaagtcgagcagcgcaggaacccggtgctcaggggacagccgaaccgaccgtggtgcagtacaacgactgcaaaggcggcggcttgatctgcgtcagctacgagnctcagtggatttgttcgtcgacaggtccatgccgcgtagatgacgccaagagtatgtcctgctattagtcttcgccaaagtccnaggggcgctgtggcatgctgaccttaccctttaccgaagtgtggggggctaaggtttctgcaatccttgcaaggaatgacagcggggacgggctcccgttcgacgaatcgtgatctgaccattactgatgcagcaaaggaaat

SEQ ID NO: 28762 - protein, 52 aa, Zea mays
  misc_feature: Ceres CLONE 1403087-F
  misc_feature: SWISSPROT Homolog: EC 2.7.7.7 DNA-directed DNA polymerase
MPVARPEPQEPRVIAHVDMDCFYAQVEQRRNPVLRGQPNRPWCSTTTAKAAA

SEQ ID NO: 28763 - DNA, 748 bp, Zea mays
  misc_feature: Ceres CLONE 1403091-F
  misc_feature: Translation starting site: 234
  misc_feature (553)..(553): n is a, c, t, g, unknown, or other
  misc_feature (631)..(631): n is a, c, t, g, unknown, or other
  misc_feature (702)..(702): n is a, c, t, g, unknown, or other
acaagctggagctccccgcggtggcggccgctctagaactagtggatcccccgggctgcaggaattcgcacgagaccattacctagaacatcctaatcgaaaaattccaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggctcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggaagaaggagtggtacttcttctcgccgcgcgaccgcaagtacccgaatggctccaggcctaaccgggcggccgggacaggtttactggaaggccaccggcgccgacaaagccggtagggtcgccgcgccccgtggncatcaagaaggcgctcgtcttctacgccgggaagccgcccaagggcgtcaagaccaactggatcatgcacgagaccgncctcgcggacgtcgaccgctcgggcgccgcacgcaagaagaccacaacgcgctcaggctggatgaactgtntgctgtgacggatctacaacaagaagggtgttatcgagcggtacga

SEQ ID NO: 28764 - DNA, 655 bp, Zea mays
  misc_feature: Ceres CLONE 1403098-F
aagctggagctccccgcggtggcggccgctctagaactagtggatcccccgggctgcaggaattcgcacgagaccattacctagaacatcctaatcgaaaaattggggcaggatcccgcgatggctcccagctcggtggcgtggaacccgtccgtggcgcccgcgaggccgaggtcgagctcggtgagcgccgcggctgctgccgggtgcgctgcgagcgccggcccgatgtcctccgtccagcagtagaactcggagaggtcgagcgccctgagcgctgggcagtccccgaggagcggctcgagatccgcgccggcgtcgaggcccggcgggcgctggtgccagcgcacgagcttgacgctgcggaggcgggacctccagtgcggggtgaggctgacgagcgtggtggggtcgcggcagtagacggcgagcgaggacacggcggggaagcagtaggcgaggcgcgccgcgaccagctcgttctgctccgcgacctgctgcggcgtcacggacggcgcgacggcgtcggccgacggcgccgcggaggagaggaacgggtggccccacggggacgccagcgagaggtcgagccgctccagcgccgggaagcagaacgccggcctgaggaagaggaacgcgggcgaccgtgggtccc

SEQ ID NO: 28765 - DNA, 685 bp, Zea mays
  misc_feature: Ceres CLONE 1403112-F
  misc_feature: Encodes the peptide sequence at SEQ ID NO. 28766
  misc_feature (372)..(372): n is a, c, t, g, unknown, or other
  misc_feature (373)..(373): n is a, c, t, g, unknown, or other
  misc_feature (406)..(406): n is a, c, t, g, unknown, or other
  misc_feature (492)..(492): n is a, c, t, g, unknown, or other
  misc_feature (651)..(651): n is a, c, t, g, unknown, or other
  misc_feature (685)..(685): n is a, c, t, g, unknown, or other
aagctggagctccccgcggtggcggccgctctagaactagtggatcccccgggctgcaggaattcgcacgagaccattacctagaacatcctaatcgaaaaattatcaagaaaccatgagttctaggttagctgaaatctcccttattgtaatctgttcatctcctggcgtgagtctgtggcgctagtgtgatgccttctcctagctcatggcttccggttcgcaatccctaatcctgatctcacttaagcgctcgtgagctctctccagtggctaaagattgcagatttgagttatagtccaagaaaacggtggtggtccgccatggaggtgaggtccgagcaagggctgatggcggggagggatctattnncgtatgcaaagagcccgccggcgccggtttccnggggccgcggcgtccgccgcatgcagagcgtgcgcatggcgtacacctcgacggcaccgctgtgttcgcttcgatgagatcctcgnccgcgacgccgtcttaccagccgcagggtgcagcccacggggctagcatgtccgcggcgacaatcattggaggcaatgccgcgcaagctgcgccaagcatggggggagccggtgccaaaaaagaagcgcggcgaacaaaggagtatggggcccgacggncccctggcgttggattttggggccctggtcgccn

SEQ ID NO: 28766 - protein, 52 aa, Zea mays
  misc_feature: Ceres CLONE 1403112-F
  misc_feature (16)..(16): Xaa is any aa, unknown, or other
  misc_feature (17)..(17): Xaa is any aa, unknown, or other
  misc_feature (28)..(28): Xaa is any aa, unknown, or other
MEVRSEQGLMAGRDLXXYAKSPPAPVSXGRGVRRMQSVRMAYTSTAPLCSLR

SEQ ID NO: 28767 - DNA, 713 bp, Zea mays
  misc_feature: Ceres CLONE 1403121-F
  misc_feature (405)..(405): n is a, c, t, g, unknown, or other
  misc_feature (516)..(516): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatgggtgggcgttctcctggtcggcgggggtgtggctgtcgtaccaccacgggcggggcggaggacggagtggtccaacgggaccgcaaggaggacctggggtgggggcaagcaggcgtgccaggggcaatacgggaaaggacaccccggcggaagagggaagccnaagagcgaggtgcccccagcggcaccagcaagcttgaccggggcgaggacggcaaccggcggcggggaaccgcctactctccgcttccggaaggggggggaagggccgggngccaggggcctggggcccgccacgaggggcccggccgggggaaaacccaggaaggggcttggggggggggcccgcccgccggggaatggggcggtccacatgggggggaaggagtaccggccggggcgacggaggaggccggggaaaaggggccgggggggggggggaaaccccacccccgggggggggaggggggg

SEQ ID NO: 28768 - DNA, 688 bp, Zea mays
  misc_feature: Ceres CLONE 1403126-F
  misc_feature: Translation starting site: 164
  misc_feature (347)..(347): n is a, c, t, g, unknown, or other
  misc_feature (639)..(639): n is a, c, t, g, unknown, or other
  misc_feature (669)..(669): n is a, c, t, g, unknown, or other
caaagctggagctccccgcggtggcggccgctctagaactagtggatcccccgggctgcaggaattcgcacgagaccattacctagaacatcctaatccaaaaacaaagctagcttatttcccttcccttcacgcggcaagcggcggccggccttccgccgccatggccaccaccaccgctcccgtcctcctcgtcttcctcgttgccattgccacgtccgtcgccccctcaccattccccatcctgacgatggcggcggacgcggacaacggcaccacccacctgagcttcttcatgcacgacatcacgtcgggcgccagcccgaccgcggtgaaggtgatcaagngggcccggcgcggggtccacgccgacggcgccggcgcttgggcatgacgttcggcgacaccatggtgatcgacgaccgcttgacgggaggaggcgtcgcccgcgtcccgccgcgctgggccgcatgcagggcttctaacatgctggcgtccagaaccggggcggcgcctttatggtgtgcgccaacctgtggttcaacgtcgggggcccacaacgggaccacgctccgccgtgctggggccgcgacgaaccggggcaggaaaggtcccggagaaatccccgtcgtcggcggnaaacgggaaccgttccggatggccacgggnctacgttgcttggggaaaa

SEQ ID NO: 28769 - DNA, 767 bp, Zea mays
  misc_feature: Ceres CLONE 1403130-F
  misc_feature: Encodes the peptide sequence at SEQ ID NO. 28770
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (34)..(34): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (47)..(47): n is a, c, t, g, unknown, or other
  misc_feature (767)..(767): n is a, c, t, g, unknown, or other
ttcaccaaccnnnnnntnnnnaaataaaaatcannggggccnnnncnccatagctggagctccccgcggtggcggccgctctagaactagtggatcccccgggctgcaggaattcgcacgagaccattacctagaacatcctaatcgaaaaacccatattattgataccaactagcaacatacatagtgaagtacactagcaacatcttagcaccaatggcagccaagatttttgccatccttgccctccttgctctttcagcaagcgttgctaccgcgactattattccacaatgctcacaacaatacctctctccggtgacagccgcgagatttgaatacccaactatacaatcctacaggctacaagaggccatcgcagcaagcatcttacggtcgttagcattgaccgtccaacaaccatatgccctattgcaacaaccatccttaatgaatctatatctccaaagaatcgcagcacaacaactacgacaacaggttgcttccaacaatcaatcaagtagttgcagcgaaccttgctgctaacctccagaaacaccaattttcttccattcaatcaactagctggggtgaaccctggctgcttacttgggagggacaacaggttactaaccattccaacccaactggtcagggagcccttgctggccttctttactgggaagcaacaggttggtttccatttcccatctaaaaaggtgggggcccaaaacatttggcttggcttttcttggccaaccaaccan

SEQ ID NO: 28770 - protein, 109 aa, Zea mays
  misc_feature: Ceres CLONE 1403130-F
MAAKIFAILALLALSASVATATIIPQCSQQYLSPVTAARFEYPTIQSYRLQEAIAASILRSLALTVQQPYALLQQPSLMNLYLQRIAAQQLRQQVASNNQSSSCSEPCC

SEQ ID NO: 28771 - DNA, 669 bp, Zea mays
  misc_feature: Ceres CLONE 1403132-F
  misc_feature: Encodes the peptide sequence at SEQ ID NO. 28772
  misc_feature (442)..(442): n is a, c, t, g, unknown, or other
  misc_feature (443)..(443): n is a, c, t, g, unknown, or other
  misc_feature (479)..(479): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (539)..(539): n is a, c, t, g, unknown, or other
  misc_feature (566)..(566): n is a, c, t, g, unknown, or other
  misc_feature (567)..(567): n is a, c, t, g, unknown, or other
aagctggagctccccgcggtggcggccgctctagaactagtggatcccccgggctgcaggaattcgcacgagaccattacctagaacatcctaatcaaaaaaaaacacacagcaagattccacgagaaccgtcaatgggttctataggaggacacacaaccacagctaccgccgaccggcgccgccgcgtgctgttcttcccgctcccgtaccagggccacatcaaccccatgttccaactcgccggcctcctccacttgcgcggtttctccgtcaccgtcttccacaccgacttcaacgctcccgacaagtcccgccaccctgcctacgacttcgtccccgttcccgtccgcggctgcttgccgaagggcagctcggatgccttgcaggtgaccgtggagcgcatcctcgtcgtgaaccgcgcctgcgaggctccgttccnnggagcgctggccgtctggctggcgcgagggacgtcncgtgcctggtcgctgacgccacctgctggcctgtgaacnnnggcgcggnnnnctcgcgtncccccaaccttggtgctgcccaccggnnaggcgcgggggctcccgatgggtccggggggttccggcgtctggggacaggggtatcagccgcgcagagcccagtttgggggggcctggttactgaactgcc

SEQ ID NO: 28772 - protein, 126 aa, Zea mays
  misc_feature: Ceres CLONE 1403132-F
  misc_feature: SWISSPROT Homolog: EC 2.4.1.195 N-hydroxythioamide S-beta-glucosyltransferase
  misc_feature (103)..(103): Xaa is any aa, unknown, or other
MGSIGGHTTTATADRRRRVLFFPLPYQGHINPMFQLAGLLHLRGFSVTVFHTDFNAPDKSRHPAYDFVPVPVRGCLPKGSSDALQVTVERILVVNRACEAPFXGALAVWLARGTSRAWSLTPPAGL

SEQ ID NO: 28773 - DNA, 687 bp, Zea mays
  misc_feature: Ceres CLONE 1403136-F
  misc_feature: Encodes the peptide sequence at SEQ ID NO. 28774
  misc_feature (467)..(467): n is a, c, t, g, unknown, or other
  misc_feature (561)..(561): n is a, c, t, g, unknown, or other
  misc_feature (581)..(581): n is a, c, t, g, unknown, or other
  misc_feature (582)..(582): n is a, c, t, g, unknown, or other
  misc_feature (621)..(621): n is a, c, t, g, unknown, or other
aaagctggagctcaccgcggtggcggccgctctagaactagtggatcccccgggctgcaggaattcgcacgagaccattacctagaacatcctaatcgaaaaatctgttcccatctcttctgcctccgtctcaatctcgaccggtcaccccatctccaccgccacatccgtcgtcttccgccgccgccgatggcccgcctcctcacgcaaaccctcaccctagcccgccccgcctcctccccctccactaccgccgcatccgcttccctccgtggcctcgccaccaaggtcgagatcatcgagatcgatctcgccgaggaagacgctggctcctcgtcccacggctccccctcctcgtccccgtcggtcgaggcggtcgggatccggcgcctggaggaggccatccacggcgtcatggtgcgccgcgccgcgcccgactggctccccttcgtgccgggagggccccnttttctgggtgcccccgctgcgccgcccgcacggggtcgccgagctcgttggccggatcgcggctgctgggggcaccgaagggggcgccggggncgtttgttggggggccgcgnnccaaggccttggagctcgacgcgcccatgacggaagaancaagggcgtttttgtttctccacaacggcgcggctggccctcggcctcttttccttcgtcgaaagg

SEQ ID NO: 28774 - protein, 140 aa, Zea mays
  misc_feature: Ceres CLONE 1403136-F
  misc_feature (93)..(93): Xaa is any aa, unknown, or other
  misc_feature (131)..(131): Xaa is any aa, unknown, or other
MARLLTQTLTLARPASSPSTTAASASLRGLATKVEIIEIDLAEEDAGSSSHGSPSSSPSVEAVGIRRLEEAIHGVMVRRAAPDWLPFVPGGPXFLGAPAAPPARGRRARWPDRGCWGHRRGRRGRLLGGRXPRPWSSTRP

SEQ ID NO: 28775 - DNA, 607 bp, Zea mays
  misc_feature: Ceres CLONE 1403137-F
  misc_feature (437)..(437): n is a, c, t, g, unknown, or other
aaagctggagctcaccgcggtggcggccgctctagaactagtggatcccccgggctgcaggaattcgcacgagaccattacctagaacatcctgatcggaaaactcttctcccctctctctcttccccgtcgccctctgtctcgatatcggagccgtaatcttctcagcctctcgccgataggatccatcgggcggtggtcggatactgcctatcggccgacgttgcccgtccgacacgcatcgagccagccggtcttgctgagcgccggcctgatccgacgcactctagtcacatctgcttggtgtcggcctctcgccgctactggtccgcatcctgagcttcctcaacgatgcacgatcgtgtcaccacgccacgccggtgtgctaccgctacatgagtaggacggacatatgcctgtgatgacgctgacaaggnacccaggatcgctcgggttactactcataaagccgaattgctcttctcgggcttggagcagcttggcccttcaccggggggggttggggaccccccatcgcccgtccggaccaatgttccgggttgcccaggcgaaaaggacccgggtggcaaatgggttggggaacccc

SEQ ID NO: 28776 - DNA, 639 bp, Zea mays
  misc_feature: Ceres CLONE 1403139-F
  misc_feature: Encodes the peptide sequence at SEQ ID NO. 28777
aaagctggagctccccgcggtggcggccgctctagaactagtggatcccccgggctgcaggaattcgcacgagaccattacctagaacatcctaatcgaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaaacctgcggcgttggcagcaccccgatcctgggccagtggcgtcgagtttctgaggcatcagggcagccccgacggcgacgccctactgctcgcctcaattgccagtcgttgcgggaaagcagg

SEQ ID NO: 28777 - protein, 56 aa, Zea mays
  misc_feature: Ceres CLONE 1403139-F
MPVPTAASKPVPAAGKPAALAAPRSWASGVEFLRHQGSPDGDALLLASIASRCGKA

SEQ ID NO: 28778 - DNA, 761 bp, Zea mays
  misc_feature: Ceres CLONE 1403144-F
  misc_feature (520)..(520): n is a, c, t, g, unknown, or other
  misc_feature (543)..(543): n is a, c, t, g, unknown, or other
  misc_feature (708)..(708): n is a, c, t, g, unknown, or other
  misc_feature (709)..(709): n is a, c, t, g, unknown, or other
acaagctggagctccccgcggtggcggccgctctagaactagtggatcccccgggctgcaggaattcgcacgagaccattacctagaacatcctaatcgaaaaccccaaccccgttcttctccctccgtccgaccgtccctcgacagtgccgaggcgcaacctagcagccgcccacgcggcgcgacatccactggcgcaagcgcaatccgcaagggccccccggcgcgccgccagcctcctggctcggccgcccccgcggctaacccaggggcggaaaggccggccagccgcccacaccccatccggccagccaggcggaaacgaccgtaagagggaagccgcagccggccgctgactccgatcccacctctagtcaaccccaggcagaccgatcctcttcgtctgaccacgacgtccatctcgcacgcctacttccactcaaccacataagtcttttctgccaggcctaacctttcccctgcgccgcctctactggttttgcacagtgccgtgacgtgngaagacgtggagatccaacgaanattagatttatttcttccttcttcggtccaacaggttcctcagcttgcgtaagatccggtctgggttgtccgccctccattggactacccaaggtgcggcgcatccaccaggtggaagatatctgcgtaagtcaaacatagaaaaagagtggactgctattagtnntcccatagatggaatccttgtggaagctgacctacttgctcgacccggcatc

SEQ ID NO: 28779 - DNA, 753 bp, Zea mays
  misc_feature: Ceres CLONE 1403145-F
  misc_feature: Encodes the peptide sequence at SEQ ID NO. 28780
  misc_feature (1)..(1): n is a, c, t, g, unknown, or other
  misc_feature (2)..(2): n is a, c, t, g, unknown, or other
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
nntttccctttttcccccccnntntaattcgtttgggtattacannnnnnnnccaagctggagctccccgcggtggcggccgctctataactagtggatcccccgggctgcaggaattcgcacgagaccattacctacaacatcctaatcgaaaaacaaaatctcatttgagcgtgcaagctccttcgcctcgaaccctctcgcgcttggctttctttcactctccagggctccactcccatctcgccgccgcagccatggcgatcacagcgccaactcccgacatcctcggcgagcgccaatccggccaggacgtccgcacgcagaacgtgatggcttgcggggcggtggccaacatcgtcaaatcctcgctcggccccgtcggtctcgacaagatgctagtggacgatattggtgatgttacaatcacgagtgatggagcaaccatacttaagatgttggaagttgagcatccagccgccaaggttcttgttgagttggctgagctccaagaccgtgaggtaggagatggaactacttccgttgtcatcatagcgggagagttactcaagaagaggcaatgatcttgggaagaataagatccatccaacctctataatcaacgggctacaggccttgctatgcgtgaagccctgccaaatatgtctgaggcaacaagctacaagccaaagggtggaccaacttggggaaaagaatccccttaataaactttgaaaaaaaccagcgatgggc

SEQ ID NO: 28780 - protein, 108 aa, Zea mays
  misc_feature: Ceres CLONE 1403145-F
MAITAPTPDILGERQSGQDVRTQNVMACGAVANIVKSSLGPVGLDKMLVDDIGDVTITSDGATILKMLEVEHPAAKVLVELAELQDREVGDGTTSVVIIAGELLKKRQ

SEQ ID NO: 28781 - DNA, 677 bp, Zea mays
  misc_feature: Ceres CLONE 1403146-F
  misc_feature (348)..(348): n is a, c, t, g, unknown, or other
tccccgcggtggcggccgctctagaactagtggatcccccgggctgcaggaattcgcacgagaccattacctagaacatcctaatcgaaaaactagtcccaactcccaaccaccgccagccgtccgctctccgcaagcgcgaccttccggccagatccgccgcgtcgcgccgacgagcggtccttctgcctagtttctccgcccagcgagcggcgggttcctcggagattcccgctggccgcggggatccatttgtgactgctcgcgttgcgcctggatctggtttgggacggaggagtgaaacgcgacggtgatcgtgcgaggtgggacgccatcagtgtcctgtcntggggttcggtctcttcttcggctgagatcctggaaggggtttcgtggtatccgtcgctacgatctgtcccagtcagagccctgcatcattctcgggtcgggccatggagactctgctcatctcggaggagcgcaaccaccagttccaccacttctccggccgccgggaagaaggcgttagcagcgtcgcctcagtccactcgcagctaccatgcgggccaccttgccgggcgttccactccgggcttcacggtcgggattcttggccgcccccgcccgggcaaaagggggcactggaccctctcttctccgggggccaagaaaccgaa

SEQ ID NO: 28782 - DNA, 662 bp, Zea mays
  misc_feature: Ceres CLONE 1403149-F
  misc_feature (237)..(237): n is a, c, t, g, unknown, or other
  misc_feature (368)..(368): n is a, c, t, g, unknown, or other
cgcggtggcggccgctctagaactagtggatcccccgggctgcaggaattcgcacgagaccattacctagaacatcctaatcgaaaaaccttgtctacaagggttttccgctgtcttatcccttcgtccacgctccctgcagccgccgcccaaaccctagcaacccgtcctccgccatggccgacgaccactactcctctaagaggaagtacgacgacccctcgccgccgccgcggntgcacgggtttctcttcgggcccgccgcctgctggccggctcgcgggaggtgccccgtcgtacaacagcgtgacacgtcccccccgatgagatccagctcgcgaagcagcgcgcagcacgagatcggccangcgcatcttttacgtcgcagacgcccagctgtcctctcgtctgagacgggcgatgatgacagcgctgtcttcgggtgtaggccgggcgagactgccggggcggcggcccccgaccgcctcggaaggatcccgcgtgccctccaagcgggggagcggcccccgtggatttaagtccgcgggggtccctccggggacagggggcaaccaggtaatcccctatggggggccccccgggccacaacccaaagaattggattctctaattccaaggcaatgttttacggcgctgttacg

SEQ ID NO: 28783 - DNA, 657 bp, Zea mays
  misc_feature: Ceres CLONE 1403150-F
  misc_feature (288)..(288): n is a, c, t, g, unknown, or other
  misc_feature (383)..(383): n is a, c, t, g, unknown, or other
  misc_feature (386)..(386): n is a, c, t, g, unknown, or other
  misc_feature (440)..(440): n is a, c, t, g, unknown, or other
tccccgcggtggcggccgctctagaactagtggatcccccgggctgcaggaattcgcacgagaccattacctagaacatcctaatcgaaaactgctagtgctcagtcctcgccctctcgctttccgagggagcctttgcctttcccctccgcccgccagccattaatggcggcggcatctccatccactcccccctcgcccccctcccactgctgctacttctagaagcgctggtggcagggcaggcgttatcccggccgctggcgctggcgcgagagttggttgggnggggggtgttcagcccccctccctcttcagggttaggggtggagcgatccgtgcaggcccaacgcggggtgcgtgaccccagaaagggaaaccgncgncttttttctcttctgcccgccccgctttcccaatccctcctcatcctcatccgncccgcccgcaccatcaaccaaaaaggtccccggccttcttcttcctcctctcctcggcccccgggttggcggttgggtcgggctcccccaccccctttctgattcagccagggttccttccggggggcgggggcggtccgctggggaaacgggtgggggggccaaaattaggtccaaagggcccctcccgggggggctccccccccggcaggggagg

SEQ ID NO: 28784 - DNA, 753 bp, Zea mays
  misc_feature: Ceres CLONE 1403152-F
  misc_feature (283)..(283): n is a, c, t, g, unknown, or other
  misc_feature (291)..(291): n is a, c, t, g, unknown, or other
  misc_feature (293)..(293): n is a, c, t, g, unknown, or other
  misc_feature (294)..(294): n is a, c, t, g, unknown, or other
  misc_feature (327)..(327): n is a, c, t, g, unknown, or other
  misc_feature (333)..(333): n is a, c, t, g, unknown, or other
  misc_feature (334)..(334): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (609)..(609): n is a, c, t, g, unknown, or other
  misc_feature (612)..(612): n is a, c, t, g, unknown, or other
  misc_feature (616)..(616): n is a, c, t, g, unknown, or other
  misc_feature (617)..(617): n is a, c, t, g, unknown, or other
  misc_feature (620)..(620): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (661)..(661): n is a, c, t, g, unknown, or other
  misc_feature (662)..(662): n is a, c, t, g, unknown, or other
  misc_feature (666)..(666): n is a, c, t, g, unknown, or other
  misc_feature (667)..(667): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (678)..(678): n is a, c, t, g, unknown, or other
  misc_feature (680)..(680): n is a, c, t, g, unknown, or other
  misc_feature (682)..(682): n is a, c, t, g, unknown, or other
  misc_feature (688)..(688): n is a, c, t, g, unknown, or other
  misc_feature (694)..(694): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (723)..(723): n is a, c, t, g, unknown, or other
tccccgacgtggcggccgctctagaactagtggatcccccgggctgcaggaattcgcacgagaccattacctagaacatcctaatcgaaaaatatataatggtattacccccgtcgtcaaatgcaccgccacccaaccccatggccgccgccaccggaagaaccatgaagacgatggcgctcgtcgtcgtcctcgccgccctcctctgctcatctcggtcgccgctgcagccagcggcggcctttcttcgtacgtggggtacctcgggcaagaaccccaccgnctggggcntnncccccaccgccccccaaaaatttaaggggtttntgggcnnaccctccgggnnnnnnnnnnnnnnnnnnnnnnnnnnntnnnnannnnnnnnnnnnnnnnngggnnnnannnnnnnnnnnnnntgggnnnannnnnnnnnnnnnnnnnnnnnnnnnnnnnnnncggnnnnnnnannnnnnnnnnnnnnnnnnnnnnnnnnnnnnnnnnnnnnnnnnnnttgtnnnnnnnnnnnnnnnnnnnnnnnnnnnnnnnnnnnnnnnnnnnnngcggnnnnnnnnnnnnnnnnnnnnnnnnnnnnnnnnnnnnnnnnnnncnagncccnnccncgcggacaaaccacaaccacaacacaaagagaaannnnnanncccnnccnnnccaccncncncccccncccccnccccccccnnnccccccccccaacacaanccacacaccccacccgttggcccccccccc

SEQ ID NO: 28785 - DNA, 660 bp, Zea mays
  misc_feature: Ceres CLONE 1403159-F
  misc_feature (460)..(460): n is a, c, t, g, unknown, or other
  misc_feature (478)..(478): n is a, c, t, g, unknown, or other
  misc_feature (514)..(514): n is a, c, t, g, unknown, or other
  misc_feature (564)..(564): n is a, c, t, g, unknown, or other
ccccgcggtggcggccgctctagaactagtggatcccccgggctgcaggaattcgcacgagaccattacctagaacatcctaatcgaaaaatctgttctacccccaccaactcctactaccgtgtctgcttgagtatctacttcttccttcaaacaagaagaaccccaacctacgaaccgcgaagacgagatgaagacgcgggcgatgacacatctcaaataccgcgccggtggccgacgcgagaaaggccgccgcgccgggctaggcaaacgactgctcatcgctcctaggtgctgagccaatatgactggcgcccatccctgagctgcaactcaggatccgctcgaacagccataaactacgccgcctcgaggcccagggtaacgacatcaactcccaagatacaatgctcctcaaagagatgctgccgctcccagagtgtgggtaaatgtctgcgcnggccgtcgaagccatagncacgaaacaggatccggagaaaggcaaatagcccgncgagtaatcggccgcttattgccaagaagcctcccgtacccaggacaaantcttggggatagagctgcgtctccggaatgacagctatatggtcattctgatcctacaagggaaggtgaattcattgacaatctcaggaaaaatgc

SEQ ID NO: 28786 - DNA, 673 bp, Zea mays
  misc_feature: Ceres CLONE 1403164-F
  misc_feature: Encodes the peptide sequence at SEQ ID NO. 28787
  misc_feature (278)..(278): n is a, c, t, g, unknown, or other
cgcggtggcggccgctctagaactagtggatcccccgggctgcaggaattcgcacgagaccattacctagaacatcctaatcgaaaacactactctggtcgtcctcgcgccgccgcagcagcagcagcgacgcgaccgccggtaatggcttccaccgttgtgctccggaacgccggctcccgccgactcttctgctactccactctccgcgccgccgcaatattgggacccgccgcgccacctgatgcgcccgcgggcggcgtcggcccagccgccanccgatggcaggaaccctcttgggcgaggtccatggccactttcacgcgcacgaagccacatggtgaacgtcggcaccattggggccacgtcgatcacggcaaaaccacactcactgctgcatttacaccagggttctgggcagaaggcaagggaaaggccaagcaattggcttttggacgagatcgacagggccccggaaagagagaggcaggaagaatcaccattgcaacagctcatgggcgagagatgagacggcctaaaagggattatggtccattggtggattgccagggtcaccgcaaaatatggccagaacatgatcacctggagctgctcaaagggggtggggggaattttttttgccggggcagctcctggaggggcccagggccac

SEQ ID NO: 28787 - protein, 176 aa, Zea mays
  misc_feature: Ceres CLONE 1403164-F
  misc_feature (45)..(45): Xaa is any aa, unknown, or other
MASTVVLRNAGSRRLFCYSTLRAAAILGPAAPPDAPAGGVGPAAXRWQEPSWARSMATFTRTKPHGERRHHWGHVDHGKTTLTAAFTPGFWAEGKGKAKQLAFGRDRQGPGKREAGRITIATAHGREMRRPKRDYGPLVDCQGHRKIWPEHDHLELLKGGGGNFFCRGSSWRGPGP

SEQ ID NO: 28788 - DNA, 685 bp, Zea mays
  misc_feature: Ceres CLONE 1403165-F
  misc_feature: Encodes the peptide sequence at SEQ ID NO. 28789
  misc_feature (415)..(415): n is a, c, t, g, unknown, or other
  misc_feature (465)..(465): n is a, c, t, g, unknown, or other
  misc_feature (521)..(521): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (552)..(552): n is a, c, t, g, unknown, or other
  misc_feature (553)..(553): n is a, c, t, g, unknown, or other
  misc_feature (599)..(599): n is a, c, t, g, unknown, or other
tccccgcggtggcggccgctctagaactagtggatcccccgggctgcaggaattcgcacgagaccattacctagaacatcctaatccgaaaactcctctcgctcgcgtccgcacaaatcccgtgctcccccgtctgaaaaccctccccacctccggcggcggcggcggcgctggcgaccgggtgtcttctccggcgagtctcccccctagtaacaagaaaatatggatgtacctgttgatgaccctgtggagaacctcactggaagtcctagtacccttgcaatgaggaagaagccactacttatgctaatgtgcaagatcagtccaaggaagaaccagaaaagctttacgaggaacccaaagacccaatgcaagacgagttgggtaaccaagggcatgtgagcatgacaatgangaatgtgggaggccagcaaagtggaccaagctacccccacagagcacggngaggaaagctggggtgaagcagatggatgctacagttcctgatgacagaatggggncctggtggctgnnnaaaaaaagagtggtccnnaatatactggttctacaccaaaaaaggggggggtgccgtcattggncggacaaaggggatttcatcaggaaaaatgtgtgaggaatcaaagccccgcattcaagggttcttgagggaacaccagctgtgcca

SEQ ID NO: 28789 - protein, 37 aa, Zea mays
  misc_feature: Ceres CLONE 1403165-F
  misc_feature (16)..(16): Xaa is any aa, unknown, or other
  misc_feature (33)..(33): Xaa is any aa, unknown, or other
MQDELGNQGHVSMTMXNVGGQQSGPSYPHRARXGKLG

SEQ ID NO: 28790 - DNA, 762 bp, Zea mays
  misc_feature: Ceres CLONE 1403169-F
  misc_feature: Translation starting site: 231
  misc_feature: Pfam Name: ketoacyl-synt Pfam Description: Beta-ketoacyl synthase, N-terminal domain
  misc_feature: SWISSPROT Homolog: EC 2.3.1.41 Beta-ketoacyl-acyl-carrier-protein synthase I
  misc_feature (1)..(1): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
naaagctggagctccccgcggtggcggccgctctagaactagtggatcccccgggctgcaggaattcgcacgagaccattacctagaacatcctaatcgaaaaagccagcaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggcggaatctccccggacgcctctccgtccgcgcctccgcgaaggtggtagcggcacccgcgcgggagacgatccaagaaagcggtgtgatcacggnnnatggggctggtctccgttttcgggaacgatgtaaacgcttacacgacccgctgctaatcgggggagacgggatcgggcccatcgacccgttcaaggcttctaagtcccaaccggttttgcggtaaaaatccggggtttcccccccagggaaaactcccacgaaaaaaacccccccccctttggggttgcccccaaatcggacccccgggggaaaaaaggtctcgggggccccggtttccccccggtcccacccctgggaaaaattacaaacccccccccggggggtgtggggacaatgtaagtggggcccccccggtgttttctggtgggcgcaaaatccttgggaaaggaaaaaaaaaaaccccttttttccct

SEQ ID NO: 28791 - DNA, 630 bp, Zea mays
  misc_feature: Ceres CLONE 1403172-F
  misc_feature (154)..(154): n is a, c, t, g, unknown, or other
  misc_feature (156)..(156): n is a, c, t, g, unknown, or other
  misc_feature (159)..(159): n is a, c, t, g, unknown, or other
cggtggcggccgctctagaactagtggatcccccgggctgcaggaattcgcacgagaccattacctagaacatcctaatccgaaaactcctctcgctcgcgtccgcacaaatcccgtgctcccccgtctgaaaaaacctcccaccctcggcggngncgncggcgctggcgaacgggtgtcttctccggcgagtctcccccctagtaacagaaatatggatgtaactggtgatggacctggggagaactcactgggaagtctagtaaccttggaagagggaaagcccctacttaggttatggggaaaacccggcccgggagaaaccaaaaagttttttggggaccccaaaaaccatgtggaagagttgggtaaccaggggtgggggaaggaaaatgagaaaggggggggccgccaaaaggggcacactatcccccccaagaacggggggaaattggggggaaaaacaagagggtacattcctgaggaaaaaatagggcgggggggctgcaaaaaaaaagggttccaaaacctaggggccaaaaaaaaggggggggggggcctcttgttgttcaagggaatttttttctaaaaaaagggggggggggagaaaaaaccccccccccgggtgtg

SEQ ID NO: 28792 - DNA, 527 bp, Zea mays
  misc_feature: Ceres CLONE 1403174-F
  misc_feature (377)..(377): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
tccccgcggtggcggccgctctagaactagtggatcccccgggctgcaggaattcgcacgagaccattacctagaacatcctaatcgaaaaccacaacaccagaatccgcgaatcacagacgcggctatctcaggttgctgcactgcactaccctgccctgccatcatatcgtacgtgagcccggccgagcgagagcgaggcacaggcatggctgctgcgagctcggacgctgagctgccggctctggcgagacgtgtggctcccaggcgggtgcgcgagggatgcatgctccacggtacgaagctatgcgggcatgcctcttcaaatggccggtcatgcggccagcgagtttcaaaaacccaggctgttggagggncaaacaccccgacgccggcatttgggtttccaaaaattccccctggccctgggaggggactaattgggggggcccttgtaaaaacgggggggcccccccaaaaaaannncccccgggggggcgggtttattggggggggcggcggggccc

SEQ ID NO: 28793 - DNA, 695 bp, Zea mays
  misc_feature: Ceres CLONE 1403176-F
  misc_feature: Encodes the peptide sequence at SEQ ID NO. 28794
  misc_feature (269)..(269): n is a, c, t, g, unknown, or other
  misc_feature (695)..(695): n is a, c, t, g, unknown, or other
ggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtttgcctggctctgtcagctgccagcgcctctgcaatgcagatgccctggccctgcgcggggctgcagggcttgtacggcgctggcgccggctgacnacgatgatgggcgccggcgggctgaacccctacgcggagtacctgaggaagcgcaagggaacccgctgggggggggggccaactagggggggggggggcaaccccaacgccctgatcccaccccccccggaaaagtggtttccaacagaaaaagggggggtttgtaccgtccctccggcccgcggcaccgttgggggtatatgttgattgttggggggcgcgttcccgcacaggtagccctcggcggggcccaggtggggggggacggcgggggggaggtggcgggcggccggggctccaccccggatagtaggggcgttatggtggatgcggcgtccggtgggggcgcgacacagagagggagagggggcaggcggggagactgcgcgggggcggcgggggaccaggggcggtgcggggaagggn

SEQ ID NO: 28794 - protein, 39 aa, Zea mays
  misc_feature: Ceres CLONE 1403176-F
MKMVIVLVVCLALSAASASAMQMPWPCAGLQGLYGAGAG

SEQ ID NO: 28795 - DNA, 683 bp, Zea mays
  misc_feature: Ceres CLONE 1403178-F
  misc_feature: Encodes the peptide sequence at SEQ ID NO. 28796
  misc_feature (423)..(423): n is a, c, t, g, unknown, or other
  misc_feature (491)..(491): n is a, c, t, g, unknown, or other
  misc_feature (591)..(591): n is a, c, t, g, unknown, or other
  misc_feature (679)..(679): n is a, c, t, g, unknown, or other
  misc_feature (680)..(680): n is a, c, t, g, unknown, or other
tccccgcggtggcggccgctctagaactagtggatcccccgggctgcaggaattcgcacgagaccattacctagaacatcctaatcgaaaaagcctgcgctccccttctttcccgttcggctcacagcgaagaaggaagccggttagggtttccacctcctttcccctcctctccttcagcgacgaccgcgggccacaccctcgatatccttcccctcggacccggaggcgagcagcagcctccagcgcctgccacgcctgcccgtctcgttattgggaggattcgccatgtctgacatggagtccgtcacagctcttatgaactcgacaagctccaagatacagcagcttcaggaggcatttgctgagcttgagagccagagcacggtttccatgaacctcaagtggaagcagcttgaaganccactttcgtggtcttgaacagtccctcaagaaaaagtttgacgagctaaaagagcagggagaaggangttccaggagactgtcgcaaaatcagagcagattctggagcagcgggagggcagctgttgtggcaaaggaactgactctttttggaggagttgcaggagnaagagggaagctgcattagctagatccctttagaaagtccaggcttttccttacctgttcctaccatcaacccatggacaagggtgannaaa

SEQ ID NO: 28796 - protein, 50 aa, Zea mays
  misc_feature: Ceres CLONE 1403178-F
  misc_feature (45)..(45): Xaa is any aa, unknown, or other
MSDMESVTALMNSTSSKIQQLQEAFAELESQSTVSMNLKWKQLEXPLSWS

SEQ ID NO: 28797 - DNA, 692 bp, Zea mays
  misc_feature: Ceres CLONE 1403182-F
  misc_feature: Encodes the peptide sequence at SEQ ID NO. 28798
cgcggtggcggccgctctagaactagtggatcccccgggctgcaggaattcgcacgagaccattacctagaacatcctaatcaaaaaacacacagctcaacaaaggagcgcggcggcccctcattccttcctcccacttctctcgcgctgcgctcgcttacctcgcttcgcattccgttcgagcaggggagcggccgtgagaagggaagggagggaattaaggcaagatgttcatcgagagcttccgcgtcgagagcccccacgtgcggtacggcccgacggagatcgagtcggagtaccggtacgacaggacggagctggtggacgaggccaaggacggcgcctcccgctgggtcgtccgccccaggggcggcaaggacaaattccggaccgagaccgccgccccatagctcgggggcatgattggagggaaggggcaaacagcacgtcctgcgccacttgatgcgatgtggaagatcgcccacaaggtgggtgcccccgacacacgtcgcgtcggggaggtttcacgtatccggatggtggaccgggtgcgctccggccggagatgcgggcgtgcggggcgaggggccggccactcgggcggggggcgcgcgcgggggaactccccggggtggggcgcccgcacaaacaagagaaagcaataaggtccaagattaggggggggcaacgcg

SEQ ID NO: 28798 - protein, 60 aa, Zea mays
  misc_feature: Ceres CLONE 1403182-F
  misc_feature: SWISSPROT Homolog: EC 5.5.1.4 Inositol-3-phosphate synthase
MFIESFRVESPHVRYGPTEIESEYRYDRTELVDEAKDGASRWVVRPRGGKDKFRTETAAP

SEQ ID NO: 28799 - DNA, 710 bp, Zea mays
  misc_feature: Ceres CLONE 1403184-F
  misc_feature (198)..(198): n is a, c, t, g, unknown, or other
  misc_feature (207)..(207): n is a, c, t, g, unknown, or other
  misc_feature (208)..(208): n is a, c, t, g, unknown, or other
  misc_feature (222)..(222): n is a, c, t, g, unknown, or other
  misc_feature (230)..(230): n is a, c, t, g, unknown, or other
  misc_feature (231)..(231): n is a, c, t, g, unknown, or other
  misc_feature (300)..(300): n is a, c, t, g, unknown, or other
  misc_feature (322)..(322): n is a, c, t, g, unknown, or other
acaagctggagctcaccgcggtggcggccgctctagaactagtggatcccccgggctgcaggaattcgcacgagaccattacctagaacatcctaatcgaaaaaaaataaaatccaattttctcagtctcgagcgcccgcgtccctcgccccgtcgcgactcgcgacttcgcgagtcgccccgtcccagccctccagncgtcccggnntccccgcgacccgnccctcggnnatgtcgggcgggggctcctcttccgatccgtgaggcgaacgaagaatcccactccccgaagaaagcggncacaggcagaggcagggtgggntcgggtcttccctcaaaaaatgggccccaaaagcctaaaggtcgggttggaaccgcttcccggcgggtggggcccccgggcccccgcccctgttggctaaaattcggctggggacaaaaaaaaattgcttccaaagaacgcccctggctgcccccttggggggtctgggggggccccaaaccaccaaaaacgcatttggttccccaaaaaagggggggggggggtggggtcttctaaaaaatttccccccgaaagaatttacggggggggggggggggctctctccccccgggggaggggattctcccccccgaaaaaacctccgcgggaaaaaaaaaccccccccccccggggggacaaaaaaaaaagaccccccccccccgggggg

SEQ ID NO: 28800 - DNA, 637 bp, Zea mays
  misc_feature: Ceres CLONE 1403185-F
  misc_feature: Encodes the peptide sequence at SEQ ID NO. 28801
  misc_feature (226)..(226): n is a, c, t, g, unknown, or other
  misc_feature (231)..(231): n is a, c, t, g, unknown, or other
  misc_feature (233)..(233): n is a, c, t, g, unknown, or other
  misc_feature (235)..(235): n is a, c, t, g, unknown, or other
  misc_feature (243)..(243): n is a, c, t, g, unknown, or other
  misc_feature (250)..(250): n is a, c, t, g, unknown, or other
  misc_feature (260)..(260): n is a, c, t, g, unknown, or other
  misc_feature (326)..(326): n is a, c, t, g, unknown, or other
  misc_feature (348)..(348): n is a, c, t, g, unknown, or other
  misc_feature (357)..(357): n is a, c, t, g, unknown, or other
  misc_feature (394)..(394): n is a, c, t, g, unknown, or other
tccaccgcgggtggcggccgctctagaactagtggatcccccgggctgcaggaattcgcacgagaccattacctagaacatcctaatcgaaaaaattgtaaactgtgatcttccaggctgcaccaactccatctccaggtggaatggagttagcttgcctgcacactcagtcacggtggcgtccctataaggcgtaggcctgacgtcacccacgcccctcgctcgnacggngngncgcggcgnccggcgnagggaatggncgagcgaagcagaagcagcggcagcgtcacggacgcggcgtcaaaagcggacgccgccgcgatgcngatggtgtcccgaagggcgccntggcgcttntgctcctgtccggcaaccgcctgggccatgttcgggnttctgtggggttcccttccacctccgggcatgaaggtcccgcgggcgcaattcccttccagtctttggaaaaagaaaaggaaaggtcttctcccggggttggaacccaagggggtttcaaaacaaaaacacccacccggtgcggaaaatgtgttggggggggaccaaaaaggtggttggggcatacccaaaaaggccctccccacaatttggggggaagggagggggaaaataaaaccggtgg

SEQ ID NO: 28801 - protein, 127 aa, Zea mays
  misc_feature: Ceres CLONE 1403185-F
  misc_feature (2)..(2): Xaa is any aa, unknown, or other
  misc_feature (24)..(24): Xaa is any aa, unknown, or other
  misc_feature (34)..(34): Xaa is any aa, unknown, or other
  misc_feature (47)..(47): Xaa is any aa, unknown, or other
MXERSRSSGSVTDAASKADAAAMXMVSRRAPWRXCSCPATAWAMFGXLWGSLPPPGMKVPRAQFPSSLWKKKRKGLLPGLEPKGVSKQKHPPGAENVLGGDQKGGWGIPKKALPTIWGEGRGKIKPV

SEQ ID NO: 28802 - DNA, 693 bp, Zea mays
  misc_feature: Ceres CLONE 1403187-F
tccccgcggtggcggccgctctagaactagtggatcccccgggctgcaggaattcgcacgagaccattacctagaacatcctaatcgaaaaacaccttccctcggtcccttccatctcctagccgccgccgccgccgccgctgcccaaaaccctacctaccctcttcttcccctcactctcctttcatctccattctaatggcggcccaacccgtccggcgaagctgctagtgcttgtatctactatcttcatcaggtacttcgcgatcctactgaagtattccccgccgccgctgccatgtccaccctcaaccctttcgaactccttggcgccgacgacaacgacgacccgacccagctgattgcggggggggccggctgctgctcagaaagccaaaactaaaaagcccgccggggcgcctcgttggaaaggctgcccaaccctggggggaacaccagtttccgaacaagaccgctcctcccccgaaaaaaggttccaaattcaccccgggggtgggctctaaaaaaccttgaggaggctcttgccccccgggataccatgccccgcgtccaagcggacgacactagaaaataacacacaagggcgcgcgttcacaacggacaacacgggccccaccttctccccgggcgcgagatgtgtgggtgcgctacgtaaggttgaacaagggaggg

SEQ ID NO: 28803 - DNA, 747 bp, Zea mays
  misc_feature: Ceres CLONE 1403188-F
  misc_feature (318)..(318): n is a, c, t, g, unknown, or other
  misc_feature (447)..(447): n is a, c, t, g, unknown, or other
  misc_feature (450)..(450): n is a, c, t, g, unknown, or other
  misc_feature (455)..(455): n is a, c, t, g, unknown, or other
  misc_feature (456)..(456): n is a, c, t, g, unknown, or other
  misc_feature (466)..(466): n is a, c, t, g, unknown, or other
  misc_feature (486)..(486): n is a, c, t, g, unknown, or other
  misc_feature (495)..(495): n is a, c, t, g, unknown, or other
  misc_feature (503)..(503): n is a, c, t, g, unknown, or other
  misc_feature (527)..(527): n is a, c, t, g, unknown, or other
  misc_feature (571)..(571): n is a, c, t, g, unknown, or other
  misc_feature (576)..(576): n is a, c, t, g, unknown, or other
  misc_feature (588)..(588): n is a, c, t, g, unknown, or other
  misc_feature (627)..(627): n is a, c, t, g, unknown, or other
  misc_feature (638)..(638): n is a, c, t, g, unknown, or other
aaagctggagctccccgcggtggcggccgctctagaactagtggatcccccgggctgcaggaattcgcacgagaccattacctagaacatcctaatcgaaaaccaaaaagcccaatcttttactcgtgctcttttcttcctttctttgtcccggtgcggcgtgtgctcgcgtggcgtcaagagcggcggcagctcggcggtgttcacggccgagtgctcccacgccttccacttcccctgcatcgcagcccacgcgcgctcctcctccgccaacggcgttctgtcctgccccgtctgcgcctcgccgtggcgccaggngcccttcctcgcctccctccgcctccactgctccttccacgacgacaagcaccgaggaagaggcgacggccgcaagacgccgccgcccgccaagctatacgacgacgacgagccgctgctggcgcccanggncgcgnncaacggtggncggcttcacccgatccccgnagccgacgnagacgacnagtaggagcaggccgccgccgagntcaggggcttcttcccatgcccccagagtaggaccacctcgggnctggncatcaacgtggncgccgaagcccggctccgtgtcttccggcgccgccacgnaaagaacgtgntggcccgccaaggtaaaggcgccggggctgggctccttcggggggggcccgcggggggggcccaatcgacctgggcccccgggttgaaggcaacccagggcttgagggg

SEQ ID NO: 28804 - DNA, 675 bp, Zea mays
  misc_feature: Ceres CLONE 1403189-F
  misc_feature (215)..(215): n is a, c, t, g, unknown, or other
  misc_feature (332)..(332): n is a, c, t, g, unknown, or other
  misc_feature (346)..(346): n is a, c, t, g, unknown, or other
  misc_feature (352)..(352): n is a, c, t, g, unknown, or other
  misc_feature (355)..(355): n is a, c, t, g, unknown, or other
  misc_feature (367)..(367): n is a, c, t, g, unknown, or other
  misc_feature (369)..(369): n is a, c, t, g, unknown, or other
  misc_feature (396)..(396): n is a, c, t, g, unknown, or other
  misc_feature (411)..(411): n is a, c, t, g, unknown, or other
  misc_feature (609)..(609): n is a, c, t, g, unknown, or other
tggagctccccgcggtggcggccgctctagaactagtggatcccccgggctgcaggaattcgcacgagaccattacctagaacatcctaatcgaaaaattgttgattgattgatcctccccgcctcactcctttgtctcctcgcctcgtgctcgctcgctcccctcgccctggcgaggagggcagcagaaaccctagcggctcaggccgggcggnggttagatgctccaaggttcgagagggaagggtaggttagtggtgcgccatcgactatgggctgcgtctttcggcgggcggctgcgtcgtcctctgcagcgccgaagaagaagtggncaaggggggagtcntccccncancccgaaccgggncncccctcgggaagcgagacacggagggnaacgggacgacccgnggaagaatgggagcccccaacctggaaaaacaaggggaatataaaaggaaaaaaaagaacggcagctttttgtttttaagggaagcctgggaaacccctttttcccatttaaccagggattttcctttttcccaagaaaaattaggtccttttttcctcggaaaattaaacatccccttggaaaaaggggcctccccntgctggccctggcctggaaaaatggaagtttcaaactaaacccctggggatataaaaaaaccccca

SEQ ID NO: 28805 - DNA, 707 bp, Zea mays
  misc_feature: Ceres CLONE 1403190-F
  misc_feature: Encodes the peptide sequence at SEQ ID NO. 28806
  misc_feature (707)..(707): n is a, c, t, g, unknown, or other
cgcggtggcggccgctctagaactagtggatcccccgggctgcaggaattcgcacgagaccattacctagaacatcctaatcgaagtatctgaccacgtcacacgacaccaccaccagccctccccttcatcaattggagcacggcgcccgttcattcccctcttctccgctgcttgcctccggctccccaattccacgagatctccaattccaccgcgtcgtctctgcatccggaccccataccccgatcgatccctaaggcccatggttttctccgccgccgcgtcgcctctagtagccaccgctgctgactctgcttcctcctgcgtcgcccacctccgctgctgctgtcgcgttattgggctgccggttgttgaagacgcgaactttctttaggggttcgcgattctccccctgatcgggtccgagaattggaaagcctatgaatcctctcgcggcccaacaatccgtcggaccttcctcgctcgggtccaaattcatcacggtcacgcccacgccaacgctctaaagggaaacccggtagccgcgccgctgggccctgttcaaaaaaacaccgggaggaaaccaaaccgggaaaccgggcttgggggccccgaaagggcccaaccccgttaaaaggggtaaaacacgagctcgcggggggaaaaaaaaaacttttccccctcctccgggcactcccttcttn

SEQ ID NO: 28806 - protein, 43 aa, Zea mays
  misc_feature: Ceres CLONE 1403190-F
MVFSAAASPLVATAADSASSCVAHLRCCCRVIGLPVVEDANFL

SEQ ID NO: 28807 - DNA, 663 bp, Zea mays
  misc_feature: Ceres CLONE 1403194-F
  misc_feature: Encodes the peptide sequence at SEQ ID NO. 28808
  misc_feature (184)..(184): n is a, c, t, g, unknown, or other
  misc_feature (366)..(366): n is a, c, t, g, unknown, or other
tccccgcggtggcggccgctctagaactagtggatcccccgggctgcaggaattcgcacgagaccattacctagaacatcctaatcaaaaatccccgctactagttggtggttagcaaatcccaccaagcaggaagcagccgcgagcgagccatggccatggatcccgttctgaaggtggcccntgggctcggcggcgttcgccgtgttctgggtgctggcggtgttcccggcggtgccgttcctgcccatcgggcgcacggcgggctccctgctgggcgccatgctgatggtgctgctgggcgtgatgagcgccgacgacgcctacgccgccgtggacctgcccatcctgggcctgctgttcggnaccatggtggtgagcgtgtacctggagcgcgccgacatgttccggcacctggggcgcctgctgtcgtggaggagccagggcgggcgggacctgctggtgcgcacctgcgccgggtccgcgctcgcctccgcgctcttctccaacgactcctgtttgcatgtgctcaccgatttcctcctccagatcgcgcccccggaaccccctgtgcccgccgccttcctgctgggcccggtgttcttcgtctatcttctttgtgccgtctctgaccgatcttaactccttactccggctcttttg

SEQ ID NO: 28808 - protein, 119 aa, Zea mays
  misc_feature: Ceres CLONE 1403194-F
MLMVLLGVMSADDAYAAVDLPILGLLFGTMVVSVYLERADMFRHLGRLLSWRSQGGRDLLVRTCAGSALASALFSNDSCLHVLTDFLLQIAPPEPPVPAAFLLGPVFFVYLLCAVSDRS

SEQ ID NO: 28809 - DNA, 710 bp, Zea mays
  misc_feature: Ceres CLONE 1403195-F
  misc_feature (444)..(444): n is a, c, t, g, unknown, or other
  misc_feature (461)..(461): n is a, c, t, g, unknown, or other
  misc_feature (503)..(503): n is a, c, t, g, unknown, or other
  misc_feature (506)..(506): n is a, c, t, g, unknown, or other
  misc_feature (507)..(507): n is a, c, t, g, unknown, or other
  misc_feature (519)..(519): n is a, c, t, g, unknown, or other
  misc_feature (538)..(538): n is a, c, t, g, unknown, or other
  misc_feature (541)..(541): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (627)..(627): n is a, c, t, g, unknown, or other
  misc_feature (628)..(628): n is a, c, t, g, unknown, or other
  misc_feature (648)..(648): n is a, c, t, g, unknown, or other
  misc_feature (649)..(649): n is a, c, t, g, unknown, or other
ggagctccccgcggtggcggccgctctagaactagtggatcccccgggctgcaggaattcgcacgagaccattacctagcatcctaatcaaaaaaagtctctcaaatctggaatcctttcacgccgccactctcccctttttccttctctcttcgtcgttgtggctcctgccttcctgcctcggcgcatcgactcgcggagagggacagcacagcgcctcctccccatcctttctccattcccagatcgaaggtccataaaaaaccatccttttgcatctgattgagcactgtctttgtgcaagagaacaatttagttgtacatacaaacaaaaagaagtgggagtatttttcagagtttattagaagagactgtttcgaggacccaggtcagagaaaggcgagaagctttagcaagcggcaatggtctggtcatgggacccgncaggtgaccgtccaggncggactgggtggtcagccgtgggtgccgctgatgaagctggntgnncccggggggggngatcggcctgctctccccnaanccgggggggnnncggggtccgtgcccagggccacctttcaagctcctgaagcaaagctccgtctttcgcgcttcttcctccccggnncctcatcttcgtccactctnnggggaaagtcggtcaccaaatagacacgtcctgggggaaggggggggttcatcccccggcc

SEQ ID NO: 28810 - DNA, 751 bp, Zea mays
  misc_feature: Ceres CLONE 1403198-F
  misc_feature: Encodes the peptide sequence at SEQ ID NO. 28811
  misc_feature (381)..(381): n is a, c, t, g, unknown, or other
  misc_feature (424)..(424): n is a, c, t, g, unknown, or other
  misc_feature (450)..(450): n is a, c, t, g, unknown, or other
  misc_feature (474)..(474): n is a, c, t, g, unknown, or other
  misc_feature (630)..(630): n is a, c, t, g, unknown, or other
  misc_feature (648)..(648): n is a, c, t, g, unknown, or other
  misc_feature (649)..(649): n is a, c, t, g, unknown, or other
  misc_feature (674)..(674): n is a, c, t, g, unknown, or other
  misc_feature (680)..(680): n is a, c, t, g, unknown, or other
acaagctggagctccccgcggtggcggccgctctagaactagtggatcccccgggctgcaggaattcgcacgagaccattacctagaacatcctaatcgaaaaaaccacgatgctctgctcgaccaccgccgatatctatggtcggattaggttcgctgccctcttcgcctcagctgtttcccgaggtctccctgcggcgacggtcaccgtagtggactccggcctcccccacggcgaccgacaaaagggtgagagagtgcaagaacctacggtacaccggcctcacgaacagctccatcaacaatctctttgatctcatcacggaccaaggtacgggagacctacgcttcaccgcctttgccctctcctccagctagaanattgttcctgattccatcaataaccaaggtatgaacagttaanagctattgcaatatactactgcaacnattcattgttttgtgccactttgncttatgtcagtaatttcgacagcgctctgctttatttagttgacactagtttgatatgattggtgcttgccgtcccataagtgagttctaaggaactatcgatttcattgacgatttttaatcttatgtacctatttttattgactattggctggnccttgttgatgctatacnnccatactgtggccctcggaaaaaantatagnttttccatttggccctttactgagattaaggaattggaaacccccaattgtgttaacaaaaatatcctaaa

SEQ ID NO: 28811 - protein, 67 aa, Zea mays; identical to SEQ ID NO: 27643
  misc_feature: Ceres CLONE 1403198-F

SEQ ID NO: 28812 - DNA, 675 bp, Zea mays
  misc_feature: Ceres CLONE 1403200-F
tccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggcctgtaggggagtcttaggggggagcaaaagggataggatagggagagatgaagcaatcaatttcttcgtccgccttcgcccctgcttacgtccccgctactaaccctaggatcattctgtcttttctcgtttcttatccgactcttcttcggtttatgcctatcaggttatgaggttgaacgccttcagaagcttctctactagattagtgtaaatagtagaccttgttcgagtttagcgtggctggaagaagtagtctcctgggccgtgtttatatctgctagcaataatggctgcgaggaacggagaaggattgggtgaattgtggaaggaacataaatagtctcaagagaaagcgggagagccccgctgcatatgctgctggcgtattctgcacctctgaattgcatcagcatactgtcaa

SEQ ID NO: 28813 - DNA, 691 bp, Zea mays
  misc_feature: Ceres CLONE 1403202-F
  misc_feature (346)..(346): n is a, c, t, g, unknown, or other
ggagctccccgcggtggcggccgctctagaactagtggatcccccgggctgcaggaattcgcacgaaaccattacctagaacatcctaatcaaaaagactcacgattctgcatctgctcgtgtcgcatccgcctcaacgcgattctgcatctgctcgcgtcgcatccgcctcaacgccgcccagcgacctggatcctggcctctcgccttcgcgttcgcaccagccggtccccgcgccacgcttcggccgctggtcaccagctccgtcgctgcctcaacaactttatccggtcattcgagggcgcaacatcattccattcgacttccgctagcgccaagacctacnacctcggcggttggccacgccggtgaagaagccatactcactcgccacgatacgcaggtgaagcgtcggattactgccatcaaagcgacaaaagatgcacaggctgggaacatacctttcctggttgtaattagtacaattccactattcaaagaacaattgggaagggtattgcgatgccatatcttcaggagaaagtgccgaattcaattggtcgtttcaatgaaggaaatatgatgttgttgagctgaaatggaatatcaggacgaatggatggattggaagtttgcagatgatagaactatgccgagctttgattgcatcattccacgggggaaaggaacg

SEQ ID NO: 28814 - DNA, 724 bp, Zea mays
  misc_feature: Ceres CLONE 1403203-F
  misc_feature: Translation starting site: 261
  misc_feature (250)..(250): n is a, c, t, g, unknown, or other
  misc_feature (285)..(285): n is a, c, t, g, unknown, or other
  misc_feature (291)..(291): n is a, c, t, g, unknown, or other
  misc_feature (293)..(293): n is a, c, t, g, unknown, or other
  misc_feature (294)..(294): n is a, c, t, g, unknown, or other
  misc_feature (325)..(325): n is a, c, t, g, unknown, or other
  misc_feature (331)..(331): n is a, c, t, g, unknown, or other
  misc_feature (332)..(332): n is a, c, t, g, unknown, or other
  misc_feature (430)..(430): n is a, c, t, g, unknown, or other
  misc_feature (469)..(469): n is a, c, t, g, unknown, or other
  misc_feature (470)..(470): n is a, c, t, g, unknown, or other
  misc_feature (486)..(486): n is a, c, t, g, unknown, or other
  misc_feature (504)..(504): n is a, c, t, g, unknown, or other
  misc_feature (505)..(505): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (533)..(533): n is a, c, t, g, unknown, or other
  misc_feature (548)..(548): n is a, c, t, g, unknown, or other
  misc_feature (565)..(565): n is a, c, t, g, unknown, or other
  misc_feature (566)..(566): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (615)..(615): n is a, c, t, g, unknown, or other
  misc_feature (616)..(616): n is a, c, t, g, unknown, or other
  misc_feature (633)..(633): n is a, c, t, g, unknown, or other
  misc_feature (635)..(635): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (694)..(694): n is a, c, t, g, unknown, or other
  misc_feature (695)..(695): n is a, c, t, g, unknown, or other
  misc_feature (704)..(704): n is a, c, t, g, unknown, or other
  misc_feature (705)..(705): n is a, c, t, g, unknown, or other
  misc_feature (720)..(720): n is a, c, t, g, unknown, or other
aaagctggagctccccgcggtggcggccgctctagaactagtggatcccccgggctgcaggaattcgcacgagaccattacctagaacatcctaatcgaaaaactactagtgatcagaccagtgagctagcgactgtaccatgcagcagctgtaggagagcctggtggtaggtaggataggagtagcgccagccgccaagtgcgcgtccgggctggctgcttcgacgagcaggaaggagccgcaccgccngggctccgcaatgtcgcctcctccgccccccgcgntggtgngnnacgagctgtcgcgcagggacggcgtgctggncctgcnngctgtggtgctgtggggcatcggcgtcggggccgccctccgggtgttcctcggggtcctctccctcccctccccgggggggggggggggcgccctggngggggggtcggcgggtgccggggcccgggcgggtggggnnccccccttggcccggnccccttccttccgggctnntgggcctccggccgnnnnttcccccccngccccggcctgggcntccccctggcgccgtcnngcggctnnnncttcgtgctcccccttccggtgnnngtttgtgggcgccnngggccgcttctccttgngnccctcctcctcccctggtgcnnnngggggcggtcgccgcctcctttttctggnnnnggnnctttccccnntcctccctcccctgntcgt

SEQ ID NO: 28815 - DNA, 762 bp, Zea mays
  misc_feature: Ceres CLONE 1403204-F
  misc_feature: Encodes the peptide sequence at SEQ ID NO. 28816
  misc_feature (632)..(632): n is a, c, t, g, unknown, or other
  misc_feature (643)..(643): n is a, c, t, g, unknown, or other
aaagctggagctccccgcggtggcggccgctctagaactagtggatcccccgggctgcaggaattcgcacgagaccattacctagaacatcctaatcgaaaagatttcctcgtcatttctctcatccgctgcgctccctctcccactcggcgaagaagggggaaaaaagctcgaaagcgggagccggcgagcgagatgggcgcagggagcagccgcgcggacgcgccgtcgcggcgccgggcgcgcctcagcctcggcgggtgcttcggggccggatcctcctcgtccgcgcacgacggcgggagcttcgccgcggacgggccctcctcctcgcgcgccatcgaggtacaatcacgacagtcagggcgacaagtgagtgccctgaattttcaggcttctctagctgctaaggatctccaggtttccagtgagtcaaatccaaggctgcattcgtcttcgagcaccataagccatcatctcagattcaatcacctcaatgaccatgaaaacaaggaagatggcctgtggtctgaaaacgctgaaacaattgctcttcaaagctcatctaggtaacctgtcatgggtaaggcgaagtctcattaatgaagctggtgatggtgactatcaggaanaaggcataagntctgtaggatcagaagctggaaaatgttcctagcacagcctccactaagtgaaattggtggctcactttcgggaatctggttttgggcaccctcatcgatgacatctggaaaggatctt

SEQ ID NO: 28816 - protein, 125 aa, Zea mays
  misc_feature: Ceres CLONE 1403204-F
MGAGSSRADAPSRRRARLSLGGCFGAGSSSSAHDGGSFAADGPSSSRAIEVQSRQSGRQVSALNFQASLAAKDLQVSSESNPRLHSSSSTISHHLRFNHLNDHENKEDGLWSENAETIALQSSSR

SEQ ID NO: 28817 - DNA, 650 bp, Zea mays
  misc_feature: Ceres CLONE 1403207-R
  misc_feature: SWISSPROT Homolog: EC 1.1.1.34 Hydroxymethylglutaryl-CoA reductase (NADPH)
  misc_feature (650)..(650): n is a, c, t, g, unknown, or other
caattgggtaccgggccccccctcgaggtcgacggtatcgatacagagatgagggacagctccgcggctaggaccgcaccggcaaccaccgtggccaagagccgcgcgttggaccctggggattccctgttagcacctttgacgccaagcaggtccaagcaggcagattgtgaggccagctgcgtgcctccaccaactgtgccaacctcaatagatggcatagtaacggagacgtgcagatctttgccatcatttatagcttccaacatggtgatacactgggaactctccacgttctgtgcagggtcctgaccagtggcaatgaagatggccgccacaatgttacttgcatgggcattgaaacccccaagagcgccagcaacagctgaaccagcgaggttcttgatcacgttcaattctaaagagcctgaacatttgttttgagaacctttttcacaacttcttccttgattactgcctcacaaaccaccgacttcccacggccatcaatccagttcacagcagctgacttcttgtcagaacagaagttacctgatatgctgatgacatccatgtcagggaagtcggcctggaggtagtccagcacgttctgcacacccttggagaccatgttcatccccatggcatcn

SEQ ID NO: 28818 - DNA, 759 bp, Zea mays
  misc_feature: Ceres CLONE 1403208-F
  misc_feature: Encodes the peptide sequence at SEQ ID NO. 28819
  misc_feature (576)..(576): n is a, c, t, g, unknown, or other
  misc_feature (635)..(635): n is a, c, t, g, unknown, or other
  misc_feature (727)..(727): n is a, c, t, g, unknown, or other
aaaagctggagctccccgcggtggcggccgctctagaactagtggatcccccgggctgcaggaattcgcacgagaccattacctagaacatcctaatcgaaaaaacgcatttcgctccccacagcggctcggccacaacccacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacaagctccgccaggttgctgtgtgaagtccaaggttgtcacatggattcagcacaagatttccaacccaggacattctctataaagttgtggccaccaagtgaaagcacacggatcatgcttgttgacaggatgacaaacaatctgtctacagagtccattttctctcgcaaatatcgccttttgggaaagcaagaggctcatgagaatgcaaaaacgattgaagaactttgctttgccttggctgatgagcatttcagagaggnagccagatggtgatgggagttctgctgtccagctatatgcaaaggaacgagcaaagggnatgttgggagttctgaaaaaagcccaaggactactgcagaactggagggcactgtagctgacacacctcttgtgtctgctgatactgactanatatatctgggtggcagccgtgcttttattga

SEQ ID NO: 28819 - protein, 78 aa, Zea mays
  misc_feature: Ceres CLONE 1403208-F
  misc_feature (75)..(75): Xaa is any aa, unknown, or other
MDSAQDFQPRTFSIKLWPPSESTRIMLVDRMTNNLSTESIFSRKYRLLGKQEAHENAKTIEELCFALADEHFREXARW

SEQ ID NO: 28820 - DNA, 682 bp, Zea mays
  misc_feature: Ceres CLONE 1403211-F
  misc_feature: Encodes the peptide sequence at SEQ ID NO. 28821
  misc_feature (441)..(441): n is a, c, t, g, unknown, or other
  misc_feature (547)..(547): n is a, c, t, g, unknown, or other
tggagctccccgcggtggcggccgttctagaactagtggatcccccgggctgcaggaattcgcacgagaccattacctagaacatcctaatcgaaaagattcggaaggacggtttgcctacctctggttccggcggccatggcggtggcggcccctggccagctcaacctcgacgaggccccgtcatggggctcccgcagcgtagactgcttcgagaagctcgagcagatcggcgagggcacctacgggcaagtgtacatggcgaaggagacgggcaccaacgagatcgtcgcgctcaagaagatccgcatggacacgaggcgcgaagggttcccgatcaccgccatacgcgagatcaagattcctgaagaagcttcacccaccagaacgttatcaggcttccagggagatcgtcacctccccaggcccaggagcgggacngagcaagggaagcccaattggacggtaacaaggtacaaaggggagcattttaccatgggttttccgagtatatgggaccatgatcttcaccggggcttgctgatcngccacagaaatgggggttcttggggccccaaaaattaaagtgttacttggaggaggttgcttacaggccctgcacctattggcttggggccacccaagtttcttgcattcgaggaaattcccaggggttctaacc

SEQ ID NO: 28821 - protein, 148 aa, Zea mays
  misc_feature: Ceres CLONE 1403211-F
  misc_feature: SWISSPROT Homolog: EC 2.7.11.22 Cyclin-dependent kinase
  misc_feature (137)..(137): Xaa is any aa, unknown, or other
MAVAAPGQLNLDEAPSWGSRSVDCFEKLEQIGEGTYGQVYMAKETGTNEIVALKKIRMDTRREGFPITAIREIKIPEEASPTRTLSGFQGDRHLPRPRSGTEQGKPNWTVTRYKGEHFTMGFPSIWDHDLHRGLLIXHRNGGSWGPKN

SEQ ID NO: 28822 - DNA, 657 bp, Zea mays
  misc_feature: Ceres CLONE 1403213-F
  misc_feature: Encodes the peptide sequence at SEQ ID NO. 28823
  misc_feature (218)..(218): n is a, c, t, g, unknown, or other
  misc_feature (373)..(373): n is a, c, t, g, unknown, or other
  misc_feature (400)..(400): n is a, c, t, g, unknown, or other
  misc_feature (618)..(618): n is a, c, t, g, unknown, or other
  misc_feature (627)..(627): n is a, c, t, g, unknown, or other
  misc_feature (654)..(654): n is a, c, t, g, unknown, or other
  misc_feature (657)..(657): n is a, c, t, g, unknown, or other
tccccgcggtggcggccgctctagaactagtggatcccccggctgcaggaattcgcacgagaccattacctagaacatcctaatcgaaaactctcattccagaggactccgcgtcgtcaggcccgcttcgcgtgcgacgccggcatatagggtttcgccggcgccggcgatggacccaccccccgtgagccccgatcgctgggggcccagtcagggcntcctggcgtcgggccctccggcctccgccgatatggcctcaatttctccgcctccagcctcctccaggcccccatcgcggcccctccttgagtacttcggacgtaagtccagtccggccctggccctggcggagcaccccccggtccgcggggcnctcggttcggcggtgtcgggggtcggnagggcctatggtcttctctccgctggcggcgctgtgcaccgggaaagattcaattccgtgatgatgtcgtgccaagcccacctgcaggtcaccctccgggccggtatgccttgaacctcctgcagagggattgattcgagcggacgccggtttgtgaaggtgaccgggcctccgctggcggggagggggtgcaggcgctacggaatgcgagagcaaanggtggcggngccgccaccgagggtgaacgggggcgnggn

SEQ ID NO: 28823 - protein, 114 aa, Zea mays
  misc_feature: Ceres CLONE 1403213-F
  misc_feature (17)..(17): Xaa is any aa, unknown, or other
MDPPPVSPDRWGPSQGXLASGPPASADMASISPPPASSRPPSRPLLEYFGRKSSPALALAEHPPVRGALGSAVSGVGRAYGLLSAGGAVHRERFNSVMMSCQAHLQVTLRAGMP

SEQ ID NO: 28824 - DNA, 695 bp, Zea mays
  misc_feature: Ceres CLONE 1403214-F
  misc_feature: Encodes the peptide sequence at SEQ ID NO. 28825
  misc_feature (493)..(493): n is a, c, t, g, unknown, or other
  misc_feature (494)..(494): n is a, c, t, g, unknown, or other
  misc_feature (695)..(695): n is a, c, t, g, unknown, or other
cgcggtggcggccgctctagaactagtggatcccccgggctgcaggaattcgcacgagaccattacctagaacatcctaatcgaaaaattttttaactagtctaaatacttgacagaagaaattcccggtttcgcttgactattcttcttcggccctgatttttatccccaaactcaccgccggggaacaagaatccagttctcctttcgccggaatctgtccctcctccccctcctccccgcctctgcgggtactggaccaccagtggagcgggcattcatccaggctaggtccattccttcctttgctcgattctcttctccatcgcggaagctccacccgagttgacgccagaagagaatcgtgggccctagggtgttctcgcagaattattttccagaagatttgcagatcgagtcgaaccctatgccccacgttagccctgccgccggcctgcccccttaccaccaccgggcgtcccggccccccggnnaaggggtcagttcccacgggaaaaatgggatgggggacccggggaggggcccggggataagaccggggcccgctggggggcgaaggatgcacctaacccaccgcgtgggagaacggcgcaccgctttcccgtccccctaagaaaaatgcttgccatccgctgccccccaaacgaggagggacgtgggaagcagaagccttn

SEQ ID NO: 28825 - protein, 68 aa, Zea mays
  misc_feature: Ceres CLONE 1403214-F
  misc_feature (23)..(23): Xaa is any aa, unknown, or other
MPHVSPAAGLPPYHHRASRPPGXGVSSHGKNGMGDPGRGPGIRPGPAGGRRMHLTHRVGERRTAFPSP

SEQ ID NO: 28826 - DNA, 771 bp, Zea mays
  misc_feature: Ceres CLONE 1403215-F
  misc_feature: Encodes the peptide sequence at SEQ ID NO. 28827
  misc_feature (492)..(492): n is a, c, t, g, unknown, or other
  misc_feature (509)..(509): n is a, c, t, g, unknown, or other
  misc_feature (517)..(517): n is a, c, t, g, unknown, or other
  misc_feature (518)..(518): n is a, c, t, g, unknown, or other
  misc_feature (535)..(535): n is a, c, t, g, unknown, or other
  misc_feature (565)..(565): n is a, c, t, g, unknown, or other
  misc_feature (614)..(614): n is a, c, t, g, unknown, or other
  misc_feature (615)..(615): n is a, c, t, g, unknown, or other
  misc_feature (618)..(618): n is a, c, t, g, unknown, or other
  misc_feature (619)..(619): n is a, c, t, g, unknown, or other
  misc_feature (713)..(713): n is a, c, t, g, unknown, or other
  misc_feature (739)..(739): n is a, c, t, g, unknown, or other
  misc_feature (740)..(740): n is a, c, t, g, unknown, or other
aaagctggagctccccgcggtggcggccgctctagaactagtggatcccccgggctgcaggaattcgcacgagaccattacctaaaacatcctaatcgaaaaagcaggagcagcgcgcaccggtggagaagcctccgttcacctttgggtcagaatcaagaaggccatcccgccacacttgcttcgagcgctcggtgctcaagtcctttctcctacgtgcttccgtgacctcgtcaccgccgcggcgctcctgtacttggcgctggtcaccatcccggcgctcccgagcccgctccagtacgccgcctggccgctctactggatcgcacaaggctgcgtgtgcaccggcctgtgggtcatcgggcacgagtgtggccacaacgccttctcggagtacccgctcctcgacgacatcgttggcctggtgctgcactcgtcgctgatggtcccgtactttctcgtggaagtacagccaccggcgccaccactccnacattggctccctggancgcgaccnnaggtgtttgtgcccagnaaagaaggaagttgctgccgtggtacacgnccgtacgtgtgcaccaagcccccgtgggcgtctgctggcaatcgcgatnnaanncccccccccgcgggggggggggccatgtgaactggccaccaaaaggggggttggggtcgccccgttacccggcgtctttcgcctgccactaacnacccccttaccgccccgatctacggnngaaaacgggaggcggcgcccaggttcttttt

SEQ ID NO: 28827 - protein, 68 aa, Zea mays
  misc_feature: Ceres CLONE 1403215-F
  misc_feature (17)..(17): Xaa is any aa, unknown, or other
  misc_feature (23)..(23): Xaa is any aa, unknown, or other
  misc_feature (26)..(26): Xaa is any aa, unknown, or other
  misc_feature (31)..(31): Xaa is any aa, unknown, or other
  misc_feature (58)..(58): Xaa is any aa, unknown, or other
  misc_feature (59)..(59): Xaa is any aa, unknown, or other
MVPYFLVEVQPPAPPLXHWLPGXRPXVFVPXKEGSCCRGTRPYVCTKPPWASAGNRDXXPPPAGGGAM

SEQ ID NO: 28828 - DNA, 725 bp, Zea mays
  misc_feature: Ceres CLONE 1403217-F
  misc_feature: Encodes the peptide sequence at SEQ ID NO. 28829
  misc_feature (307)..(307): n is a, c, t, g, unknown, or other
  misc_feature (346)..(346): n is a, c, t, g, unknown, or other
  misc_feature (386)..(386): n is a, c, t, g, unknown, or other
  misc_feature (395)..(395): n is a, c, t, g, unknown, or other
  misc_feature (405)..(405): n is a, c, t, g, unknown, or other
cgcggtggcggccgctctagaactagtggatcccccgggctgcaggaattcgcacgagaccattacctagaacatcctaatcaaaaaaaactttagtctactcgtcctcggtcctcctcttctcgcagcagccagcagaccaatcgggacaagcaaactcccccgattagtttaagcagcccgggcccggcgacgaccagctccgttccgcgcggggatttaaacgcgcgaagcgagaaggcacgcagcaggcggcagcggcaagcaacgaacgcgatcgcgcgccgacgacgacgcgcggtgccgncgcctgggtggtgccgtgttgcggactccgctgcatcgntctcggtcgggtcgtcgtcgttaattcatgggtgtccggnctgcccggngggcgggggntccggccgtcctcgtacctcctcggtgcggggcgggcgtgggccgggggaaagtaaccgcgaccatctttcaaactttcgggggagctcccctgggaggtacggccggcaaaccttggggggttggaccgggaatcccggggactaacgtgggacccgggcgcgggcctgacccttacggcattgaccccactttcgggctacccccacccggccgcttggtgccgacgagccgggcttcgtgcgatgacttccatcgccgcaggaagctgggcggtgccgcttgctggccgccggtcgatggtgaggaacagcgactct

SEQ ID NO: 28829 - protein, 117 aa, Zea mays
  misc_feature: Ceres CLONE 1403217-F
  misc_feature (5)..(5): Xaa is any aa, unknown, or other
  misc_feature (8)..(8): Xaa is any aa, unknown, or other
  misc_feature (11)..(11): Xaa is any aa, unknown, or other
MGVRXARXAGXPAVLVPPRCGAGVGRGKVTATIFQTFGGAPLGGTAGKPWGVGPGIPGTNVGPGRGPDPYGIDPTFGLPPPGRLVPTSRASCDDFHRRRKLGGAACWPPVDGEEQRL

SEQ ID NO: 28830 - DNA, 714 bp, Zea mays
  misc_feature: Ceres CLONE 1403220-F
  misc_feature: Encodes the peptide sequence at SEQ ID NO. 28831
  misc_feature (143)..(143): n is a, c, t, g, unknown, or other
  misc_feature (406)..(406): n is a, c, t, g, unknown, or other
  misc_feature (432)..(432): n is a, c, t, g, unknown, or other
  misc_feature (448)..(448): n is a, c, t, g, unknown, or other
  misc_feature (491)..(491): n is a, c, t, g, unknown, or other
  misc_feature (492)..(492): n is a, c, t, g, unknown, or other
  misc_feature (522)..(522): n is a, c, t, g, unknown, or other
  misc_feature (523)..(523): n is a, c, t, g, unknown, or other
  misc_feature (609)..(609): n is a, c, t, g, unknown, or other
  misc_feature (610)..(610): n is a, c, t, g, unknown, or other
  misc_feature (640)..(640): n is a, c, t, g, unknown, or other
  misc_feature (641)..(641): n is a, c, t, g, unknown, or other
aaagctggagctccccgcggtggcggccgctctaaaactagtggatcccccgggctgcaggaattcgcacgagaccattacctagaacatcctaatcgaaaaatcgaactgttctcacagatcactctcaaactttttcacantttctctcaaaaagaagaaacagcgaaatttgtaattctcagtgacgccaaccctgactccgtttgacgcggctccgatggtcaccgccggcgacctcgccgctgccgccaactcctgagacctcgtcgcgcctaggccctaggggcgtgagcttgcctccgccgcgatccgggtaccagtcctcgaggatgcagtaccagcacgctggcagtcgaagccgcatgccgccattcgcgcgcggcggcggcgcctacagccgcgnacggaagcagttctacccgccgtctncccttccgtcgggggncgctgtctctgccgctgcagaacaagtatgaggtgctcatggnnagcagccgcctcgctgccgagtacctgtgnncgagggcgtgcttccaccgggctccttgcagcacgcagcgggaagcgtcccttgggaaggtggggccagctccctccctcgctccnntttcgggacttggaaagacagcttacacgnngcatcatgggcgcgggaaggcaaaaaaaaaatgggatattcgtatgcagtcgcgcgaaaacccggggtggtga

SEQ ID NO: 28831 - protein, 48 aa, Zea mays
  misc_feature: Ceres CLONE 1403220-F
  misc_feature (25)..(25): Xaa is any aa, unknown, or other
  misc_feature (34)..(34): Xaa is any aa, unknown, or other
  misc_feature (39)..(39): Xaa is any aa, unknown, or other
MQYQHAGSRSRMPPFARGGGAYSRXRKQFYPPSXLPSGXAVSAAAEQV

SEQ ID NO: 28832 - DNA, 713 bp, Zea mays
  misc_feature: Ceres CLONE 1403221-F
  misc_feature: Encodes the peptide sequence at SEQ ID NO. 28833
  misc_feature (341)..(341): n is a, c, t, g, unknown, or other
  misc_feature (342)..(342): n is a, c, t, g, unknown, or other
  misc_feature (346)..(346): n is a, c, t, g, unknown, or other
  misc_feature (353)..(353): n is a, c, t, g, unknown, or other
  misc_feature (361)..(361): n is a, c, t, g, unknown, or other
  misc_feature (402)..(402): n is a, c, t, g, unknown, or other
  misc_feature (418)..(418): n is a, c, t, g, unknown, or other
  misc_feature (644)..(644): n is a, c, t, g, unknown, or other
  misc_feature (666)..(666): n is a, c, t, g, unknown, or other
tccccgcggtggcggccgctctagaactagtggatcccccgggctgcaggaattcgcacgagaccattacctagaacatcctaatcaaaaaactgcaagtgcaaaggcttcatggcgagcgatactccccagtccccaaagcccagaaccccagagacgcacgcgcgagcgcgaacaacatgctgccggcgctcattgccctgctgctgtcctggctccccgcggtcgccgacgcagcgtcaatggatccaacagagaggggagacgctgttccgcgtcatgggaggccgtgtcctccggaccgggactggcgggcgtagagagccccgaccccctgcggnncggnccggggncgcggggnctggaagtgcaagccggcccccccagacggcgggcccgcgnagccgcatgcaccgtncacggcggctggaaactttcgggcgtgggagcccccaaccccgacgtgcaagggggactccggcggtccttcccccctccccgaaggtcttcaccccctccccgcacgggtccagtcccctccttccttccgtcggactggcttcacccaaccccggccgcccacccacgggcgcttcgcccctgcccgccgcccgcccaaccctctcgggccaccgggcctgcangcagctcagcatccgggccaancccggcggctgtccggcgtgatgccgccggcgctggccagcctccgg

SEQ ID NO: 28833 - protein, 46 aa, Zea mays
  misc_feature: Ceres CLONE 1403221-F
MLPALIALLLSWLPAVADAASMDPTERGDAVPRHGRPCPPDRDWRA

SEQ ID NO: 28834 - DNA, 658 bp, Zea mays
  misc_feature: Ceres CLONE 1403224-F
  misc_feature: Encodes the peptide sequence at SEQ ID NO. 28835
ggagctccccgcggtggcggccgctctagaactagtggatcccccgggctgcaggaattcgcacgagaccattacctagaacatcctaattgaaaaattttgttctccatcccagttcccccggcaaacacactctcggttctcccgtgcctctcgccgtctcgcgtcgcaacgactggccggccgccgggcgccgccgacctacgtgccaaggtccgcatattcggaaccttcgccggcgagcacccaccaggatttttttgtacatctaagatgtacagggcctcgaatttcatacctgatcctaatcaggtgctcctagatgccaaaccattaagatcgttagctccaatgttccctgcccccatgggagtcaatgttaatcagtcaagtacgccaccattggtctgtgtcactccggttggtcaattttcagcagggtttggtgcaggtaaccttcctgcctttggatcgttcactactttcagtgccacttcaaatggtgtttcttatgcaggcaccagtgctaatggtgccattgatgccacccctatctctgcatacaaaacaaggtcaaacatatcacttgatggtgatgatgatccttactcgggtaaccaaactgaacggaagcctaggagaggccgacctcccggtt

SEQ ID NO: 28835 - protein, 128 aa, Zea mays
  misc_feature: Ceres CLONE 1403224-F
  misc_feature: SWISSPROT Homolog: EC 2.1.1.43 Histone-lysine N-methyltransferase
MYRASNFIPDPNQVLLDAKPLRSLAPMFPAPMGVNVNQSSTPPLVCVTPVGQFSAGFGAGNLPAFGSFTTFSATSNGVSYAGTSANGAIDATPISAYKTRSNISLDGDDDPYSGNQTERKPRRGRPPG

SEQ ID NO: 28836 - DNA, 672 bp, Zea mays
  misc_feature: Ceres CLONE 1403226-F
  misc_feature: Encodes the peptide sequence at SEQ ID NO. 28837
  misc_feature (353)..(353): n is a, c, t, g, unknown, or other
  misc_feature (362)..(362): n is a, c, t, g, unknown, or other
  misc_feature (457)..(457): n is a, c, t, g, unknown, or other
ggagctccccgcggtggcggccgctctagaactagtggatcccccgggctgcaggaattcgcacgagaccattacctagaacatcctaatcgaaaaatgttctgcctccgcaccctccgatcgcccgccgcgtccgattcccctgaccccgcctcgccctcaatctccgccgccgcgcccgcgacatccatcacccccgcccgcgacatcccgcctcgcacgccatcaactcacagcggcccttctccgaacgtggtttgttttttcgtttgctcgagcagccagccgactcgtctccagcaatgcggccggggtcggctcgctggaggtgggcgccgccgccgacacctccnacgcctccnagcagggattaggtgagccgtcggctaatcactcgtcattgggaggatctcctcctcccgttcagatttgggcaagaaaggcccgggcgcgatgntccatgggccgaggaggggagtgaggccgaggcgctcgagaaagacggcagcaaggcttcttcaccttcggggccagttaggcgttcctgccgctcttcttcctcccgtgtcgtcagaggaagccgcgaaaagcacgcaggaatcaggcggtcttgaggacgaggagctacaggtgcaggatgcagtttgccagtggttccaagaggagcaaaga

SEQ ID NO: 28837 - protein, 73 aa, Zea mays
  misc_feature: Ceres CLONE 1403226-F
  misc_feature (2)..(2): Xaa is any aa, unknown, or other
MXHGPRRGVRPRRSRKTAARLLHLRGQLGVPAALLPPVSSEEAAKSTQESGGLEDEELQVQDAVCQWFQEEQR

SEQ ID NO: 28838 - DNA, 649 bp, Zea mays
  misc_feature: Ceres CLONE 1403233-F
  misc_feature: Encodes the peptide sequence at SEQ ID NO. 28839
  misc_feature (487)..(487): n is a, c, t, g, unknown, or other
  misc_feature (525)..(525): n is a, c, t, g, unknown, or other
  misc_feature (571)..(571): n is a, c, t, g, unknown, or other
  misc_feature (649)..(649): n is a, c, t, g, unknown, or other
cgctctatactagtggatcccccgggctgcaggaattcgcacgagaccattacctagaacatcctaatcgaaaaagaacttccagcatcctatcagataccgaaatctccaactcccgcatcgcatcgcatcgcatcgaaccttcggcctgcaagcgaattcgtcctcccctctcctaccggcgcgaattcaaccgcccgcaaagccctaggccgatgcgtccgatccggctacccgagccgccgggcgtcgacggcatggagacgcccgagatcttctctggcagcggcactggtggcgccgccgtcgttcgccgcgccgtcctcataggcaacggctcccccggcgcagaaaaccagtgtctcggcctcgcccgcgccctcggccttgccgacaacctcacattctaccgtgtcacgaggccgagaggagggatcaatgagtggctgcactttctccccatttccatgcacaagtttatagaccnaatactcaggcagttcttccggaacacaagttcgcaantagtgggttcaggggaggaagccgcgtgtgctgaatggtgcatcanttggggtgtctggagttctggaaccaaacgtccagaagattgttactgtagcacgcgatacgaatgaagaaggaaggn

SEQ ID NO: 28839 - protein, 140 aa, Zea mays
  misc_feature: Ceres CLONE 1403233-F
  misc_feature (91)..(91): Xaa is any aa, unknown, or other
  misc_feature (104)..(104): Xaa is any aa, unknown, or other
  misc_feature (119)..(119): Xaa is any aa, unknown, or other
MRPIRLPEPPGVDGMETPEIFSGSGTGGAAVVRRAVLIGNGSPGAENQCLGLARALGLADNLTFYRVTRPRGGINEWLHFLPISMHKFIDXILRQFFRNTSSQXVGSGEEAACAEWCIXWGVWSSGTKRPEDCYCSTRYE

SEQ ID NO: 28840 - DNA, 641 bp, Zea mays
  misc_feature: Ceres CLONE 1403237-F
  misc_feature: Encodes the peptide sequence at SEQ ID NO. 28841
  misc_feature (237)..(237): n is a, c, t, g, unknown, or other
  misc_feature (331)..(331): n is a, c, t, g, unknown, or other
  misc_feature (349)..(349): n is a, c, t, g, unknown, or other
  misc_feature (387)..(387): n is a, c, t, g, unknown, or other
  misc_feature (388)..(388): n is a, c, t, g, unknown, or other
  misc_feature (399)..(399): n is a, c, t, g, unknown, or other
  misc_feature (409)..(409): n is a, c, t, g, unknown, or other
  misc_feature (445)..(445): n is a, c, t, g, unknown, or other
  misc_feature (446)..(446): n is a, c, t, g, unknown, or other
  misc_feature (474)..(474): n is a, c, t, g, unknown, or other
  misc_feature (641)..(641): n is a, c, t, g, unknown, or other
cgctctagaactagtggatcccccgggctgcaggaattcgcacgagaccattacctagaacatcctaatcgaaaagtctcttttccagttccagacctgaagaaactccgaccggtggcggcaggatctgtgccgcgatggcgacgtcgaacaccgctcggatggaggacggcggcggtgacctgcggagcaccatcaagaagtggaacatcatctaccctgtctacctcaactccnagaagacggtcgccgagggccgccgcatcgccgctgccaaggcctgcccggaccccacctgcatcgagatcgctgactgctgttcgcacctcangatccccacgccatcgangtggataaggcgtaccctcgggatttcttcagggtggnngagggtcaggntgcagctaangaaagatgacggctcccccgttcatcctgctattannacaaggaagcagctgatggatccagtanccagagctaggtccccagcctcccgggaagggcaaagaaagcaggaggttcaatttgaggggaacctccatcctccccccaaaggatttgcttccccctaaagcttccccggagggttaagggggggggccttaatggggatccccccccccaaagggggggccccn

SEQ ID NO: 28841 - protein, 145 aa, Zea mays
  misc_feature: Ceres CLONE 1403237-F
  misc_feature (24)..(121): Pfam Name: SRP19 Pfam Description: SRP19 protein
  misc_feature (34)..(34): Xaa is any aa, unknown, or other
  misc_feature (65)..(65): Xaa is any aa, unknown, or other
  misc_feature (71)..(71): Xaa is any aa, unknown, or other
  misc_feature (84)..(84): Xaa is any aa, unknown, or other
  misc_feature (88)..(88): Xaa is any aa, unknown, or other
  misc_feature (91)..(91): Xaa is any aa, unknown, or other
  misc_feature (103)..(103): Xaa is any aa, unknown, or other
  misc_feature (113)..(113): Xaa is any aa, unknown, or other
MATSNTARMEDGGGDLRSTIKKWNIIYPVYLNSXKTVAEGRRIAAAKACPDPTCIEIADCCSHLXIPTPSXWIRRTLGISSGWXRVRXQLXKDDGSPVHPAIXTRKQLMDPVXRARSPASREGQRKQEVQFEGNLHPPPKGFASP

SEQ ID NO: 28842 - DNA, 650 bp, Zea mays
  misc_feature: Ceres CLONE 1403243-F
  misc_feature: Encodes the peptide sequence at SEQ ID NO. 28843
  misc_feature (355)..(355): n is a, c, t, g, unknown, or other
tggagctccccgcggtggcggccgctctagaactagtggatcccccgggctgcaggaattcgcacgagaccattacctagaacatcctaatcaaaagaaatcaatcctcttctcgtctagatctgagcctccgcgtggcttccagatcagatgcttggtccgatcaacgacggtgagtcttgctctgttagttgattgttcgaaatgcatggttttgtttttgtgatgatgtgcaggttccgatcagtttcgtttgattgatgagttgacgcatcggttcgaagcgagacgaggctgcatggtttttgtgcctggaggtttctgatcagcgtgtttaaggaaactggatgctacnatttgttatctgcagaccttcagagctgcgacgttccggctttcgggggatctggatcttggctgactggacattggcgaggcgttgacgggcttctaaagcgtggctggattgctggatctcctttctgcccccgcgactcgatgatatctcttttgtattggtaattattggatgaaatttcgataattattagatccggagagatgtaaagtcccgggcggtcggtgcctaactgaggggcaaggtaaggtccgagaacaaaggaagggaaaaagatacatggaaaaaagaa

SEQ ID NO: 28843 - protein, 74 aa, Zea mays
  misc_feature: Ceres CLONE 1403243-F
GAPRGGGRSRTSGSPGLQEFARDHYLEHPNQKKSILFSSRSEPPRGFQIRCLVRSTTVSLALLVDCSKCMVLFL

SEQ ID NO: 28844 - DNA, 862 bp, Zea mays
  misc_feature: Ceres CLONE 1403245-F
  misc_feature: Encodes the peptide sequence at SEQ ID NO. 28845
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (21)..(21): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (34)..(34): n is a, c, t, g, unknown, or other
ttggccctccctnnnnnnntntcttcttnnntantcccgggggaattacaaaaagctggagctccccgcggtggcggccgctctagaactagtggatcccccgggctgcaggaattcgcacgagaccattacctagaacatcctaatcgaaaaaccctacccctctctctctctctcctctacctccttttcctctaacctttagctttcctccctccctctcctctctcccccctcctctaacaagaactactcccagccattcagatcctaagttgctgaccttgctgctgcttgttggagatagatttgttggttctaagttcgaagtaccatgagtccaccgagtgtgatggggcagtttggggacacaacctacaccaaggttttttgttggggggactcgcggtgggaaaacccagaagggagacggatgagggaagtacttccgaggaggtttgggggaggaccctgggaggggtggtgggccatccatgggaaaagaaacactggggaagaaacccagggggcctaagggaattggggtaacctttccgggggaaccggggaacggggggggaaagagagggtttggggggtggtaccccggccccccgggggaattgggggggggggcggggggccaaaaaggggggagacttggggttgcccggggggggggggccaaagagagagagagggggtggcgagagccccgaggggggggggggggggggggtgggaggcgtgggggaggggggggaggtctctttgccgccgcggagacgggggacccaccgggggggagattgggggggatattttttttgtcttgtgggggggtcccgttccccacaattag

SEQ ID NO: 28845 - protein, 66 aa, Zea mays
  misc_feature: Ceres CLONE 1403245-F
MSPPSVMGQFGDTTYTKVFCWGDSRWENPEGRRMREVLPRRFGGGPWEGWWAIHGKRNTGEETQGA

SEQ ID NO: 28846 - DNA, 655 bp, Zea mays
  misc_feature: Ceres CLONE 1403248-F
  misc_feature (229)..(229): n is a, c, t, g, unknown, or other
  misc_feature (387)..(387): n is a, c, t, g, unknown, or other
tccccgcggtggcggccgctctataatagtggatcccccgggctgcaggaattcgcacgagaccattacctagaacatcctaatcgaaaaaacccaacccaacgacgcagctagcgcgcatctccgatctgcactgcaccttcgtctccgaagaacgtcgatcgtactcgtacaccatgaaggcagtcgtcgcggcgacgatgcttctgcttggtgctggtggccgcgncgacggtggcgagcgcagaccaccgtgatgacgacggccaccaccaccagcgccaccgcggccagagctggcaccgccacagcggcggcggtcgagatggccgccggtcgacccctctggcggccctgacgcagtgcgggacgagctgcggatctggnatcatctcctgaatgctggactgctaccagtcgatgggcgacctgcagcccgtgaagttgcccgtctgactcgtcaagtgaaacaactgctgcatgtgctgcggcaccgtatggcccgtcacggggaaagtatagatggcttggtattgttggcccatcgttatattgaaatctgtggtgccatgaataataaccccctaatttgtttattggatgaaaaaggagatgaaagaaaaacatgttgttttgtaccagctgcgccgaggcg

SEQ ID NO: 28847 - DNA, 661 bp, Zea mays
  misc_feature: Ceres CLONE 1403249-F
  misc_feature: Translation starting site: 268
  misc_feature (457)..(457): n is a, c, t, g, unknown, or other
  misc_feature (625)..(625): n is a, c, t, g, unknown, or other
tggcggccgctctagaactagtggatcccccgggctgcaggaattcgcacgagaccattacctagaacatcctaatcgaaaacatttatttcctccgcttcagctcccattctccgccaaataaacccccgaaaagcaggagaggcgagacccggaagtggaaggctagggttagggtcccagctccccgttgcctgggcgagccgagtgatggccgcccctgccccctccggcgcagctagtgccgccgcctcaccgtccccgctgatgcagctgccgtcgccgttcgcggagctcgtcaagggcccctccggcctcgagaaggtcgtgcttcgcggcgctcgcaactgctgtgccgagatttatctttatggaggtcaagtaacatcatggaagaatgacaatggggaagacttgcttttcctcagcagcaaggctattttcaaacctccaaaangctattcgtggtggtataccaatctgctttccccaatttggatcacatggaaatcttgaacaacatggatcgctagggaaaccggttttggactattgacaacaatccacctcctttaccattaaacctgctattaaaagcttttggtgatctgattctgaagcttcntgagagggattttaaagatctgcccccacagttttg

SEQ ID NO: 28848 - DNA, 656 bp, Zea mays
  misc_feature: Ceres CLONE 1403253-F
  misc_feature: Translation starting site: 203
  misc_feature (393)..(393): n is a, c, t, g, unknown, or other
gctctagaactagtggatcccccgggctgcaggaattcgcacgagaccattacctagaacatcctaatcaaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgacctccgggnagaagtacgggcccatcttcaccatgcggatggggcagcgcaccctcatcgtggtcacctcggcggagctcatccacgaggcgctgggtgaagcagggccccatgttcgcgagtccggcccgaggagagccccacccgcctcctcttcagcgtcggcaagtgcaccgtcaactcggcgcctacggtcccccctgtggcgtgctctgcgccgcaacttcgtcggccgagatcgtgtccccgcaccgcgtctaggctctctggga

SEQ ID NO: 28849 - DNA, 664 bp, Zea mays
  misc_feature: Ceres CLONE 1403254-F
  misc_feature: Translation starting site: 174
  misc_feature (414)..(414): n is a, c, t, g, unknown, or other
  misc_feature (420)..(420): n is a, c, t, g, unknown, or other
  misc_feature (559)..(559): n is a, c, t, g, unknown, or other
  misc_feature (664)..(664): n is a, c, t, g, unknown, or other
gagctccccgcggtggcggccgctctagaactagtggatcccccgggctgcaggaattcgcacgagaccattacctagaacatcctaatcgaaaagaagccacagcagctgcaagcttttgcttcgtccgtccgtccgcccgcccgtccccgcatcattcccgaagtcccagcatggatttggaggggccgtgggcgcgggtgctgcacctgcacgatgcgtgcgagtggggccgggcggtgcgggcgcgcgcggtggcgccggcgctggaggccgcggcgtgggcgtgcctcgccatgtcggtcatgctcgtgctcgaggtgtgctacatgagcgtctccagcttcgtcgccgtcaacctgctgcgccggaccccacagcggcggtacagctgggagcccatgccctccgggnaccgcncggggggacgaatgaggaggcagcggtgggcgatggaggcggcgaggcgtacccgatggtactcgtgcagatccccatgtacacgaagagggaggtctacaagaatctctattgggagcggcatgtgccctcacatggncgcccgaccgattataatccaaaggtattggatgattccaccgacccattcattaaggaactttgtgggagtttgaaatggcagggattgggccagcaagaaaan

SEQ ID NO: 28850 - DNA, 638 bp, Zea mays
  misc_feature: Ceres CLONE 1403256-F
  misc_feature: Encodes the peptide sequence at SEQ ID NO. 28851
  misc_feature (142)..(142): n is a, c, t, g, unknown, or other
  misc_feature (519)..(519): n is a, c, t, g, unknown, or other
  misc_feature (592)..(592): n is a, c, t, g, unknown, or other
cgcggtggcggccgctctataactagtggatcccccgggctgcaggaattcgcacgagaccattacctagaacatcctaataaaactgtcccgccgagttcggagcgcagcgcaaggcggggggaggagcaagaagccgccnggcctccctcctccggctcaccaccaggcttactccgcaccgcgctgccacgggtaggagcggcgtcaaattcgggattcccaagcggcttcagcccggaggttcagccaaagctattttctaagaaaaatggcggcaatgatggtggcgatgactgcgaggagcaagaacagcatattacccgtggagaagaagcagggctggtctattcagctaccagagctccggttcccttgggattcacatgaagacaagggtttctctctgagtctgcaaggatctggaccttctcatggcggcctgtttgctagcgtgggtcttaaagtgtcgacaggtgccccagcagtggcgcccggaccgggtgacaaggatataangatccattcactgatcattggatggagtacgtgcctgaggcagttgggtaccaggttattagcactgaagcgnagccaggggaagaagtgggtgaatgctaaggaaaagaagccggcaa

SEQ ID NO: 28851 - protein, 122 aa, Zea mays
  misc_feature: Ceres CLONE 1403256-F
  misc_feature (83)..(83): Xaa is any aa, unknown, or other
MAAMMVAMTARSKNSILPVEKKQGWSIQLPELRFPWDSHEDKGFSLSLQGSGPSHGGLFASVGLKVSTGAPAVAPGPGDKDIXIHSLIIGWSTCLRQLGTRLLALKRSQGKKWVNAKEKKPA

SEQ ID NO: 28852 - DNA, 635 bp, Zea mays
  misc_feature: Ceres CLONE 1403257-F
  misc_feature: Encodes the peptide sequence at SEQ ID NO. 28853
ggagctccccgcggtggcggccgctctagaactagtggatcccccgggctgcaggaattcgcacgagaccattacctagaacatcctaatcgaaaaatcttgctctgaacgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgcccaggacaacaagaagacgcgcatcgtcccgcgccacgtgctgctggcgatccgcaacgacgaggagctcgggaagctgctgaccggcgtgaccatcgcccacggggggggggttgcccaacatcaaccccggtcctgcttgcccagaagacggcggaagaaggcgtccagcggcggggagcagggaggccagtcggcccaagaagggccgccagtcccc

SEQ ID NO: 28853 - protein, 157 aa, Zea mays
  misc_feature: Ceres CLONE 1403257-F
  misc_feature (31)..(104): Pfam Name: Histone Pfam Description: Core histone H2A/H2B/H3/H4
MDATGTGAGGKAKKGAAGRKAGGPRKKSVTRSVKAGLQFPVGRIGRYLKKGRYAQRVGSGAPVYLAAVLEYLAAEVLELAGNAAQDNKKTRIVPRHVLLAIRNDEELGKLLTGVTIAHGGGVAQHQPRSCLPRRRRKKASSGGEQGGQSAQEGPPVP

SEQ ID NO: 28854 - DNA, 572 bp, Zea mays
  misc_feature: Ceres CLONE 1403258-F
gggagtccccgcggtggcggccgctctagaatagtggatcccccgggctgcaggaattcgcacgagaccattacctagaacatcctaatcgaaaagagccgagagagaaacaggaaaggagcaggaaaaaaaaagagagaagaagccgcaggggctggcctgacggtacggacagccgcctgcctccagcagtatcagccgcgaaagattgagaagatcagacgagctcgacgaggggaggcgcgacaaaaaaataatcgccggccccggaaaaaatggaggatctgaaaaaagttttattctttttttctgaaagaggctaacagttcagaaaaaatttggaatccaattgggagcaataactgagggttttgggttcaggggggaattaaaccccaaaaaatttccccccatttttaaaaaaaggaaaaaagttttccaaaatttgggggaaaggggttttcaagggggggggccttccttttggggaaaaaaccccggggtttttccccggggggttttttttttttgaaaaaaccccccctttttttttgggggagagaaaaaaaaaa

SEQ ID NO: 28855 - DNA, 677 bp, Zea mays
  misc_feature: Ceres CLONE 1403259-F
  misc_feature: Encodes the peptide sequence at SEQ ID NO. 28856
  misc_feature (328)..(328): n is a, c, t, g, unknown, or other
  misc_feature (387)..(387): n is a, c, t, g, unknown, or other
  misc_feature (578)..(578): n is a, c, t, g, unknown, or other
  misc_feature (649)..(649): n is a, c, t, g, unknown, or other
  misc_feature (661)..(661): n is a, c, t, g, unknown, or other
cgcggtggcggccgctctagaactagtggatcccccgggctgcaggaattcgcacgagaccattacctagaacatccgaatcgaaaaatcgcagaaattctccgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaaggccaaggcggagaagcggctacctgcgggcaagtccgccggcaaggaggcggncgacaagaaggggaggaagaaggcgaagaagagcgtggagacctacaagatctacatcnttcaaggtctccgttctcccccaattcgccttcacctcgccgcttcctccttgccgcccccggttggacgtcgtctttcccgggcggaggtagctcggccggaagacctcacctgggacttttccgacgcaccctccacacactctttaacccctccggaatggccgcctgcttctagctcgtcgacgccnaaatctccgcttggcttctcgacagccccatccgcctcttctcgctctcgctacggttcctctgctgttcngccatggcgatncgcatcacgtctctaa

SEQ ID NO: 28856 - protein, 167 aa, Zea mays
  misc_feature: Ceres CLONE 1403259-F
  misc_feature (52)..(52): Xaa is any aa, unknown, or other
  misc_feature (72)..(72): Xaa is any aa, unknown, or other
  misc_feature (159)..(159): Xaa is any aa, unknown, or other
  misc_feature (163)..(163): Xaa is any aa, unknown, or other
MAPKAEKKPAAKKVAEEEPSEKAAPAEKAPAGKKAKAEKRLPAGKSAGKEAXDKKGRKKAKKSVETYKIYIXQGLRSPPIRLHLAASSLPPPVGRRLSRAEVARPEDLTWDFSDAPSTHSLTPPEWPPASSSSTPKSPLGFSTAPSASSRSRYGSSAVXPWRXASRL

SEQ ID NO: 28857 - DNA, 678 bp, Zea mays
  misc_feature: Ceres CLONE 1403261-F
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (45)..(45): n is a, c, t, g, unknown, or other
  misc_feature (50)..(50): n is a, c, t, g, unknown, or other
  misc_feature (51)..(51): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (262)..(262): n is a, c, t, g, unknown, or other
  misc_feature (364)..(364): n is a, c, t, g, unknown, or other
  misc_feature (678)..(678): n is a, c, t, g, unknown, or other
ttttnnnnnnnnnnnnnttttnnnttcccttttttcttaacctcntctcnntctcctcctgtttnnnnttaaagctggagctccccgcggtggcggccgctctagaatagtggatcccccgggctgcaggaattcgcacgagaccattacctagaacatcctaatcgaaaaaaatagcaatttttccccctgggagcccgagacgcagcgcgaggtgcggccccgtcccctcgccaccggaggagcaggacgacgaggtggncgtcgcgcgaggtagtcgcgcgcctggaagagcgcgggcttcgaatcccaagcggaggcaagaagggaggggagaaccctatacccccgcccggggggggtntggttcttgaacgaactcccccctttttggcccaattcaaaattcaaaccccgggtggggggggggggcgaaccccccccccaagatccccaaggcccttattgggaaaaaaggggaatgggaaaaaaacggggaaaaaaaaaaatggccccggagacccaaaaaaaaacccccgaaaaccccccccccccttcccggggggaatagataattttctaaaaaccccccccctctcctcccaaaaaaaaaaacctcccggggagggcgggaccgcccccccctattaaagaggggggaaaaaaaaactccccccn

SEQ ID NO: 28858 - DNA, 821 bp, Zea mays
  misc_feature: Ceres CLONE 1403264-F
  misc_feature: Encodes the peptide sequence at SEQ ID NO. 28859
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (29)..(29): n is a, c, t, g, unknown, or other
  misc_feature (36)..(36): n is a, c, t, g, unknown, or other
  misc_feature (38)..(38): n is a, c, t, g, unknown, or other
  misc_feature (44)..(44): n is a, c, t, g, unknown, or other
  misc_feature (49)..(49): n is a, c, t, g, unknown, or other
gtgaacaaaaacacaaccnnncctccctnttttgtnangggggnttggnccaagctggaactccccgcggtggcggccgctctataactagtggatcccccgggctgcaggaattcgcacgagaccattacctagaacatcctaatcgaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctcccacggggtccggctgcacgctattgttccggcgggaccgtggctccgcccggcgcggacttccctgctgacgtgcggaccccggtggccgtcccggcactggcctggcgtcccaaacaccggcggttcacagaccaggccgccgagaacttttgcgcgagatggccccaccctcctgggccgtacgctgcccgctggcgccgtacacaccgccccaggtggcgggaacactactaaacaagaaccccgacccgacgcggcccgcgttgagcggcccgctcaagtggggcacttgcgcgctcgcgccggggccagaggcgtgaacagaccacgcccaagatatatatttagaaggatcgctgggggtgtgggggccagcgccaccgtgggtgcgagggacgtgcgtcgtcttgtcc

SEQ ID NO: 28859 - protein, 144 aa, Zea mays
  misc_feature: Ceres CLONE 1403264-F
MGALRSLAISYPEFLVAGLCFVSLSALRHAMRERRQRAPLSWPVVGMLPFVLANLGRLYDAITDALPRGPAARYCSGGTVAPPGADFPADVRTPVAVPALAWRPKHRRFTDQAAENFCARWPHPPGPYAARWRRTHRPRWREHY

SEQ ID NO: 28860 - DNA, 765 bp, Zea mays
  misc_feature: Ceres CLONE 1403265-F
  misc_feature: Encodes the peptide sequence at SEQ ID NO. 28861
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (32)..(32): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (765)..(765): n is a, c, t, g, unknown, or other
naaaannnnnnnnnnnnnnnnaaaaccccccncccccnnnnnnnnaaccccnnnnccaagactggagctccaccgcggtggcggccgctctagaactagtggatcccccgggctgcaggaattcgcacgagaccattacctagaacatcctaatcgaaaaaactcgccgtctcgccagtcgccaccatctaaagccgcggctccaatcccaccgcaggacaggcaggcagagcgcgccccgcgccatttcagccatgtcgacgacgtcgtcgtcgtcgtcgtcgtcgtcgtcgtcgtcgttccagtggcgcccatgggtggcactctcctccatccccgtcgtcgtcggcgccaacaacgagcgggcacggaggctcgcgcccggtgcctccgacctctttctcgacatccagctcccacagcacggcgcctcctacctgttcctgcccgagcgcatcataccggagcccaggaaattcgattcaggccgccaccccttcaccatcctgtccgcctgctccgaacgctttcttcttcattgcggttgggggtacccgaaccgaagggggtctcgaaacccccgcctgctttcctccggaaacgcccaggcccagaaccggcggtccggcctcccccgaagagccccccgcccaacctcgggggggtaaaaattttatactggggaaaaaagggattggggccctttatgccccggaacaccggggaaacacgggggggggccctatataagggtggacccccccn

SEQ ID NO: 28861 - protein, 137 aa, Zea mays
  misc_feature: Ceres CLONE 1403265-F
MSTTSSSSSSSSSSSFQWRPWVALSSIPVVVGANNERARRLAPGASDLFLDIQLPQHGASYLFLPERIIPEPRKFDSGRHPFTILSACSERFLLHCGWGYPNRRGSRNPRLLSSGNAQAQNRRSGLPRRAPRPTSGG

SEQ ID NO: 28862 - DNA, 548 bp, Zea mays
  misc_feature: Ceres CLONE 1403266-F
  misc_feature (358)..(358): n is a, c, t, g, unknown, or other
  misc_feature (386)..(386): n is a, c, t, g, unknown, or other
  misc_feature (448)..(448): n is a, c, t, g, unknown, or other
ccccgcggtggcggccgctctagaactagtggatcccccgggctgcaggaattcgcacgagaccattacctagaacatcctaatccaaaaacaccaacccgttctgcctccgcttcgatcatggggtggtcgcgctttcgtcgccgccatcaacggtgtcgctatctcctccctatccggcgtccgcgatgctcgccacccctcctcccccacgcgtcggacgctcgccatgctcgcctccctcccctccggtccgcctcgctccccttccgcccttccgtcgcgtgcgcttggaaaaaggtccagcagccccaaactccccagcggggccatctcgcccactctccctgcacgccgnatccccgccgtccccacatcgcctgtgntgggtccgacccagtccgctcatgcctcgacgcgcagttctcgcacaccgtccggcgggggngtcggcttcgggccgggtttcgaaaccgttcccgaaggggatcaaattaagcctcctaacctccggtggcccctcccatcccctctcccatgaaacccgg

SEQ ID NO: 28863 - DNA, 744 bp, Zea mays
  misc_feature: Ceres CLONE 1403268-F
  misc_feature: Encodes the peptide sequence at SEQ ID NO. 28864
  misc_feature (1)..(1): n is a, c, t, g, unknown, or other
  misc_feature (2)..(2): n is a, c, t, g, unknown, or other
  misc_feature (26)..(26): n is a, c, t, g, unknown, or other
  misc_feature (28)..(28): n is a, c, t, g, unknown, or other
  misc_feature (31)..(31): n is a, c, t, g, unknown, or other
  misc_feature (33)..(33): n is a, c, t, g, unknown, or other
  misc_feature (34)..(34): n is a, c, t, g, unknown, or other
nncccccccccccccccccccccccnanaanannaaacggccccccccacagttgggctccccgcggtggcggccgctctataactagtggatcccccgggctgcaggaattcgcacgagaccattacctagaacatcctaatcgaaaactcctccccgcccctccgcagccgcagtgccgcagcatcgtcgccatggctctcctcaagaactccctcatgctccaggggcggttgcgccatgcggcggcggcgctcactgcgcggcgccacgcggcgacgtcgacggaagagtacgcgcgccggaactacgccgataacaactccgagtacaacacggtcatcggatcgctcgtcgctcagcgcaggccctaccttctgcgtgatgcttacgacgacatgatgcttgatggcgtgaagcctgagcgggaaacattccacacactcatagtcggtaccatgaaaggcagccggctacaagatgcgctttacttccgtgatcagatgaaagaaatgggtttgaagcctgatgttaacctttacaacttcttgatctccacttgtggaaaatgcaagaactcagatgcagcaatcatgcttttagaagacatgaaggcacatggatgtttaagttggaaaggagaaacctacatttggtctactgaatgcacttgcatcaacagggcaaaactgatcaagtttatgcccatagttaaggggatattgagtggctgctgggactggt

SEQ ID NO: 28864 - protein, 183 aa, Zea mays
  misc_feature: Ceres CLONE 1403268-F
  misc_feature (79)..(113): Pfam Name: PPR Pfam Description: PPR repeat
MALLKNSLMLQGRLRHAAAALTARRHAATSTEEYARRNYADNNSEYNTVIGSLVAQRRPYLLRDAYDDMMLDGVKPERETFHTLIVGTMKGSRLQDALYFRDQMKEMGLKPDVNLYNFLISTCGKCKNSDAAIMLLEDMKAHGCLSWKGETYIWSTECTCINRAKLIKFMPIVKGILSGCWDW

SEQ ID NO: 28865 - DNA, 665 bp, Zea mays
  misc_feature: Ceres CLONE 1403270-F
  misc_feature: Encodes the peptide sequence at SEQ ID NO. 28866
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (537)..(537): n is a, c, t, g, unknown, or other
  misc_feature (586)..(586): n is a, c, t, g, unknown, or other
  misc_feature (633)..(633): n is a, c, t, g, unknown, or other
cgcggtggcggccgctctagaactagtggatcccccgggctgcaggaattcgcacgagaccattacctagaacatcctaatcgaaaacgaaaaattcgaaagatccctccaggaaagatttttcttccctcctccgacgccccagcccaccaacacactctataaagcagccctcagtcacacacagaacgcacaagcgcaagccgggcaagaaaactccgtaggccagtctgcgagttggatggccttcttcttggccctcgtgtgcatcctcatcttgctagccatcgcctcctacgtccagtacactcgctggaaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcagacgcacccttctgggttgcccgtgcgtgatgctggcgagccgannnnnnngccccgntccctgctggttgacgcaggcgcacctgttcaagccgacctacccgcgnagcaagagcgcatggacggggccgtcggttctcttcttcaccagggngactaacacctccgctccgcaagctcggccag

SEQ ID NO: 28866 - protein, 141 aa, Zea mays
  misc_feature: Ceres CLONE 1403270-F
  misc_feature: SWISSPROT Homolog: EC 1.14.13.93 (+)-abscisic acid 8'-hydroxylase
  misc_feature (95)..(95): Xaa is any aa, unknown, or other
  misc_feature (96)..(96): Xaa is any aa, unknown, or other
  misc_feature (97)..(97): Xaa is any aa, unknown, or other
  misc_feature (99)..(99): Xaa is any aa, unknown, or other
  misc_feature (131)..(131): Xaa is any aa, unknown, or other
MAFFLALVCILILLAIASYVQYTRWKKGKGRFGGHGRSAPLKLPPGSMGWPYLGETLQLYSQDPSFFFASKQKRYGEIFRRTLLGCPCVMLASRXXXPXPCWLTQAHLFKPTYPRSKSAWTGPSVLFFTRXTNTSAPQARP

SEQ ID NO: 28867 - DNA, 608 bp, Zea mays
  misc_feature: Ceres CLONE 1403272-F
  misc_feature: Encodes the peptide sequence at SEQ ID NO. 28868
  misc_feature (288)..(288): n is a, c, t, g, unknown, or other
  misc_feature (324)..(324): n is a, c, t, g, unknown, or other
  misc_feature (336)..(336): n is a, c, t, g, unknown, or other
  misc_feature (344)..(344): n is a, c, t, g, unknown, or other
  misc_feature (352)..(352): n is a, c, t, g, unknown, or other
  misc_feature (353)..(353): n is a, c, t, g, unknown, or other
  misc_feature (485)..(485): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (514)..(514): n is a, c, t, g, unknown, or other
tcttaactagtggatcccccgggctgcaggaattcgcacgagaccattacctagaacatcctaatcgaaaaatgaccgactagcccatggtctctctccgctccgacgcgcccgacccaccaccacatccctcatggctgccctcgccgacatcgactcctcggcacttccgccgtccgagtcatccaaaggcaagggcaagatggacaaggaggaggaggacgaggcgaagggcgcggagaagatgtgcggcatctgctatctcgacggccggcgggccatccgcgncgagctcgactgctgcgccccatttcttttgcttgnctgcatcatggnctgggggnccgggtcnnaagcccccgcggtgtccccttttggggggggggccgggttttttttcaaaaaaatagggcccccgcccccccccccttttgggggggggggggtttttccccccacaaagaaaaggagaaaaaaatcctctnttcacaannnnnnggagaggggggaaggnagcacaaaaccccccccctcctcttcaagaggaaaaaaaaaaaaagggggggggggcccctcttttttaaaaaaaacaaaaaaaagaggggggg

SEQ ID NO: 28868 - protein, 158 aa, Zea mays
  misc_feature: Ceres CLONE 1403272-F
  misc_feature (52)..(52): Xaa is any aa, unknown, or other
  misc_feature (64)..(64): Xaa is any aa, unknown, or other
  misc_feature (68)..(68): Xaa is any aa, unknown, or other
  misc_feature (71)..(71): Xaa is any aa, unknown, or other
  misc_feature (74)..(74): Xaa is any aa, unknown, or other
  misc_feature (118)..(118): Xaa is any aa, unknown, or other
  misc_feature (120)..(120): Xaa is any aa, unknown, or other
  misc_feature (121)..(121): Xaa is any aa, unknown, or other
  misc_feature (122)..(122): Xaa is any aa, unknown, or other
MAALADIDSSALPPSESSKGKGKMDKEEEDEAKGAEKMCGICYLDGRRAIRXELDCCAPFLLLXCIMXWGXGSXAPAVSPFGGGAGFFFKKIGPPPPPPFGGGGVFPPTKKRRKKSSXHXXXERGEGSTKPPPSSSRGKKKKGGGGPSFLKKTKKRGG

SEQ ID NO: 28869 - DNA, 672 bp, Zea mays
  misc_feature: Ceres CLONE 1403285-F
  misc_feature (305)..(305): n is a, c, t, g, unknown, or other
  misc_feature (306)..(306): n is a, c, t, g, unknown, or other
  misc_feature (385)..(385): n is a, c, t, g, unknown, or other
tccccgcggtggcggccgctctataactagtggatcccccgggctgcaggaattcgcacgagaccattacctagaacatcctaatcgaaaactcgtgttcttgttcgtctccgcctcaggcaactccacacggtcacacctcgctcgctctcgctcccgtatcgcggtttccttttcgaagccttgctaggtttagctggggcctctgtctatcctgtcaatggccccttaggcggctgtacttcagacttcagaggtgacgtgaggcgtggggacgcgcgtagctgattggttcgaggaggcgnngatggacccggacttctcgccggcgagtgggggcccgagcttttgagtcgccttttcactcgtcacttctctgaccggntggtgcagatcgagatcgtcgctggggatgacgccctcgggggcagggccgcaccggcgaggggtgctcatctccttgcgactggcgtgccaccgaagcgacgaaggaaggaactcccacccgccaagaatctaaaaaaaactggccaataccgaaatggaaaagttgaactgaaaaaggggagcccacaggaaggaagggccctcggacaataaaaaaaaacccccccctatattggggcgaggggggggtggaaaaaaccccccccctgggggaggggggggcct

SEQ ID NO: 28870 - DNA, 674 bp, Zea mays
  misc_feature: Ceres CLONE 1403288-F
  misc_feature: Encodes the peptide sequence at SEQ ID NO. 28871
  misc_feature (117)..(117): n is a, c, t, g, unknown, or other
  misc_feature (516)..(516): n is a, c, t, g, unknown, or other
gctctagaactagtggatcccccgggctgcaggaattcgcacgagaccattacctagaacatcctaatcgaaaactttcagcggagcgcggcggcgagatggcagtgcaaatatccnagaagaggaagtttgtcgctgatggcatcttcaaagctgaactgaatgagtttcttactcgggagctggctgaagatggctactctggagttgaggtgcgagttacaccaaccaggacagaaatcattatcttagccatcagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgcttgtgcggagggcctggctatggtggtgctgcggatcatcgatggagagtggggccacaggctgcgaggttgttggngccttagccccaccaagttaagcgaaacgaaattttcctagaagccggcctggcccctcgaatacaggtttgttgcctgagcccggctgggaagtcctatggaggtagtaaaagtttcttccccctccttcgggcgggggattactggtaagccgggc

SEQ ID NO: 28871 - protein, 152 aa, Zea mays
  misc_feature: Ceres CLONE 1403288-F
  misc_feature (45)..(102): Pfam Name: KH_2 Pfam Description: KH domain
  misc_feature (7)..(7): Xaa is any aa, unknown, or other
  misc_feature (140)..(140): Xaa is any aa, unknown, or other
MAVQISXKRKFVADGIFKAELNEFLTRELAEDGYSGVEVRVTPTRTEIIILAIRTQNVLGEKGRRIRELTAVVQKRFGFPEGSVELYAEKVATRGLCAIAQAESLRYKLLGGLACAEGLAMVVLRIIDGEWGHRLRGCWXLSPTKLSETKFS

SEQ ID NO: 28872 - DNA, 615 bp, Zea mays
  misc_feature: Ceres CLONE 1403289-F
  misc_feature: Translation starting site: 246
  misc_feature: SWISSPROT Homolog: EC 3.6.3.14 H(+)-transporting two-sector ATPase
  misc_feature: SWISSPROT Homolog: EC 3.6.3.15 Sodium-transporting two-sector ATPase
gctctagaactagtggatcccccgggctgcaggaattcgcacgagaccattacctagaacatcctaatcgaaaaaaacacgcaaaacgtgcttctgtccctctcctgttataatttcgtcttcttccctctcccaccggtgtcctcgcctcgcctatccgatctgccacctcgccgtctcgcacgttcctttccccaactccccagcgcctctccgcgccgcgatccagatccaggttgttcagcatgggtctggtgaaggaaggcgtcgacatggaggaggcaaccctagagatcggcatggagtacaggactgtatctggtgtggccgggcctctggttatcttggataaagtaaagggcccaaagtaccaagaaattgtaaacatccgacttgaagatggcaccactcgccgtggtcaagtccttgaagttgatggagaaaaagctgttggtgcaggtttttgaaggaacttctggaatagacaacaaatacacaaccgtgcagtttacaggcgaggttatgaaaactcctgtctcactcgatatgcttgggcgcatttctaatgcttctggaaaacctattgacaatgcccccccgatattacctgaagcc

SEQ ID NO: 28873 - DNA, 663 bp, Zea mays
  misc_feature: Ceres CLONE 1403293-F
  misc_feature: Translation starting site: 342
  misc_feature (291)..(291): n is a, c, t, g, unknown, or other
  misc_feature (412)..(412): n is a, c, t, g, unknown, or other
  misc_feature (413)..(413): n is a, c, t, g, unknown, or other
  misc_feature (663)..(663): n is a, c, t, g, unknown, or other
gctctagaactagtggatcccccgggctgcaggaattcgcacgagaccattacctagaacatcctaatcgaaaaatcaggcccacgctttgttaacaaagaattccctcatagccgccgccgccgccgccgccgccgccgccgctcatctcgccgagaggtgacgggaccgaggaactcgccgagttctaagatagagaatcgcttttcacagcctggggtctgctgcgtagggtggtgtagaaaggggagaagtttaagatctgttccacagatcacgcgtgccgctcgncgaatcgggggttccacacatagcttcgtcgttttgaatttgatgtactaatggagtctaagggtggcaagaagtctagcagtagtcgctccatgatgtatgaagctccccttggcacagnnattgaggacgttcgacctccggaggcgcgaagaagttccagtctgctgcttactccaactgcgcaaagaagccatcctgatatcccttttggcttcctcgttctagtagtttaggatttcttttctgacacttcgattcttaccaatccccctggcctgctgctttcctgacaatcgaccagttccccagtctggctccctgcagtcctccctctccttctcccggcgttgtgttctgactcactgcacn

SEQ ID NO: 28874 - DNA, 673 bp, Zea mays
  misc_feature: Ceres CLONE 1403294-F
  misc_feature: Encodes the peptide sequence at SEQ ID NO. 28875
  misc_feature (273)..(273): n is a, c, t, g, unknown, or other
  misc_feature (616)..(616): n is a, c, t, g, unknown, or other
gctctagaactagtggatcccccgggctgcaggaattcgcacgagaccattacctagaacatcctaatcgaaaaataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacntcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacacctccccgggctcgcccgcgcagcgcttcgtgtcgggaggacggcgtcatcaactcgcggcccgcgggtgctgggcggcggcagctgcatcaacgccggcttctacacgcgggccagcgacgactacgtgcggggggcgtcgggtgggaacctggggcgccgccggggcggcgtaacggtggggtgggaaagaaancgggttggcgttcaaaccggactgggggggcccccgtggggaagcccgcccttttaa

SEQ ID NO: 28875 - protein, 158 aa, Zea mays
  misc_feature: Ceres CLONE 1403294-F
  misc_feature: SWISSPROT Homolog: EC 4.1.2.10 Mandelonitrile lyase
  misc_feature (52)..(52): Xaa is any aa, unknown, or other
MSGRSRHFTMSTLLATSFFFVLLCSSLQVRGVNYTFVKDAALAPSVSYYDYXIVGGGTAGCPLAATLSERFRVLLLERGASPYDDDRIGDMARFADTLSDTSPGSPAQRFVSGGRRHQLAARGCWAAAAASTPASTRGPATTTCGGRRVGTWGAAGAA

SEQ ID NO: 28876 - DNA, 707 bp, Zea mays
  misc_feature: Ceres CLONE 1403297-F
  misc_feature: Encodes the peptide sequence at SEQ ID NO. 28877
  misc_feature (321)..(321): n is a, c, t, g, unknown, or other
acagctggagctccccgcggtggcggccgctctagaactagtggatcccccgggctgcaggaattcgcacgagaccattacctagaacatcctaatcgaaaacaccgcagccgcagcacaatcgcctcgccttcccttccccaccagcccccgtctctctctctctctttctctctctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggncgggctgtcgctggccgagtcgggcggcttcgtcaaggcccccggcggcgcgcccgccaacggcggctgcgccatcgccaagctcggcggctcctccgccttcgtcgggaagttcggcgacgacgagttcgggcacgtgctggagaacatcctgaagcaaaacaacgagaactcggaggggggggcctgttccgacaagaacgcgcgggacggcggctggaccttcgtggagggtcaaagcacgaagggagaaccgcggggtttctgggtcctaccaggaaaccctggccgggggaacggggcgggggggaagggagggggggaccctggctccttcgggcacccggggtgccggggaagcaaacgaggcggtcacggggccatgg

SEQ ID NO: 28877 - protein, 162 aa, Zea mays
  misc_feature: Ceres CLONE 1403297-F
  misc_feature: SWISSPROT Homolog: EC 2.7.1.4 Fructokinase
  misc_feature (34)..(34): Xaa is any aa, unknown, or other
MAPLGDGGAAAAAASNNLVVSFGEMLIDFVPDVXGLSLAESGGFVKAPGGAPANGGCAIAKLGGSSAFVGKFGDDEFGHVLENILKQNNENSEGGACSDKNARDGGWTFVEGQSTKGEPRGFWVLPGNPGRGNGAGGKGGGDPGSFGHPGCRGSKRGGHGAM

SEQ ID NO: 28878 - DNA, 666 bp, Zea mays
  misc_feature: Ceres CLONE 1403298-F
  misc_feature: Encodes the peptide sequence at SEQ ID NO. 28879
  misc_feature (419)..(419): n is a, c, t, g, unknown, or other
cgctcttaactagtggatcccccgggctgcaggaattcgcacgagaccattacctagaacatcctaatcgaaaaaacacaacaatctctctcccctcactccctctctgcagcgcgcagctttcaaagcgttgggagagatggcagaggagacgcaaccagaggccgcagccgccgccgcgcccgccgcggccgaggtagtcgtgaccgaagctgcgccggcggaggcggaggtgcctgcggcggcggaagctgaagccgaggccaaggatgagaagaaaggtgacgaggcggagctcaccgccgatgacgcgggggtggggaccggctcgttcaaggaggaaagcaacctggtggaagacctgcccgacccggagaagaaggcgctcgacgagttcaagcagctgatcgctgctgccntcgccgccggtgagttcaaactggctcccccggcgcgcgcggccgaaggccaaggaaacaaagtggagggagccaaagcccaggtggttgcgttgccccggtttggggaggtaaaaaagaaggtccccccggcccgagaggccaaaggtttaaacttggttggagaaaccaaccttttcgaccccagccgaagaaaaaaattgttgtgccccttgggagaaacttcccccaaaggggggaaatctgg

SEQ ID NO: 28879 - protein, 175 aa, Zea mays
  misc_feature: Ceres CLONE 1403298-F
  misc_feature (94)..(94): Xaa is any aa, unknown, or other
MAEETQPEAAAAAAPAAAEVVVTEAAPAEAEVPAAAEAEAEAKDEKKGDEAELTADDAGVGTGSFKEESNLVEDLPDPEKKALDEFKQLIAAAXAAGEFKLAPPARAAEGQGNKVEGAKAQVVALPRFGEVKKKVPPAREAKGLNLVGETNLFDPSRRKKLLCPLGETSPKGGKS

SEQ ID NO: 28880 - DNA, 661 bp, Zea mays
  misc_feature: Ceres CLONE 1403300-F
  misc_feature: Encodes the peptide sequence at SEQ ID NO. 28881
  misc_feature (426)..(426): n is a, c, t, g, unknown, or other
  misc_feature (443)..(443): n is a, c, t, g, unknown, or other
  misc_feature (593)..(593): n is a, c, t, g, unknown, or other
ggcggccgctctagaactagtggatcccccgggctgcaggaattcgcacgagaccattacctagaacatcctaatcgaaaagtgctctctcagaggtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtncccgtgggcggtggcgntgggcggcgttggctaacggcggcggtcgcggcggcggcggctatggtggcgggcgccgtgacggcggttatggcggcggtggcggctacggcggtcggcgcgaggttggtgacgacgactacggaggcggtgtcggctacggcgttcgncgcgaggggtgatggtggcgactacgacgccggcgacggcggatgcaggtactgatgtgtcgtccctt

SEQ ID NO: 28881 - protein, 96 aa, Zea mays
  misc_feature: Ceres CLONE 1403300-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (86)..(86): Xaa is any aa, unknown, or other
  misc_feature (92)..(92): Xaa is any aa, unknown, or other
MAAADVEYRCFVGGLAWATSNESLENAFASYGEILDSKVITDRETGRSRGFGFVTFSSENSMLDAIENMNGKELDGRNITVNQAQXPWAVAXGGVG

SEQ ID NO: 28882 - DNA, 665 bp, Zea mays
  misc_feature: Ceres CLONE 1403302-F
tccccgcggtggcggccgctctataactagtggatcccccgggctgcaggaattcgcacgagaccattacctagaacatcctaatcgaaaaacggttaaagttgtggcaggaggagtgggggcgcgggagagatgataaggatggcggcagcgtctcagccgccatcgtcagccttgcggatgcacgggtgcggcggcgcggcttctgcgtcgtccgcgcccgtgcgcctcttcacggagtcgcggggtagagtcgtggcgtcgattgggaggggcaggaggcggaggcgcgccatctcgtgctgctcgtctccagacgcagatggccctcgccccgccgcgccaccgacctccgcagcgccttccgacgggtcgatacagctctattcccagatcgagagggtaatcacggaggcggcaaagcagtcccgggaaggctggggttcgactggagattggaccgaagtcgagggatcatgtgtgatgagaccgaaggccctgaagccatcatttgctggccacttggatggaggaatttgtgatgtgcccgttccccccactgataccgcttcttcctctagttgtccgagacaaggacagattaggtgaaagctcctccacatgggagttgctcatgacgtttctttattgatcacgacgatcag

SEQ ID NO: 28883 - DNA, 655 bp, Zea mays
  misc_feature: Ceres CLONE 1403305-F
  misc_feature: Encodes the peptide sequence at SEQ ID NO. 28884
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (534)..(534): n is a, c, t, g, unknown, or other
  misc_feature (628)..(628): n is a, c, t, g, unknown, or other
tccccgcggtggcggccgctctagaactagtggatcccccgggctgcaggaattcgcacgagaccattacctagaacatcctaatcaaaaaagttagtagttcaccagagttcacacaaaaatcacaagcaagcagtcgcgtgtgtagctcgcaacaatggcgacgaaccccggcctcttcaccgagtggccgtggaagaagctcggcaacttcaagtacctgctgctggcgccgtgggtggcgcacggcggctaccaagcggcgaccaaggggtggagggcggccgacctggggtacgtggccatcctcccgtcgctgctcctccgggcgctgcacaaccaggcgtggatcaccgcgtcccgcctgcagagcgcgcgcggccggcggcaggtcgtggaccgcggcatcgagttcgagcaggtggaccgcgagcgcaactgggacgaccagatcctgctcagcggcatcctcctgtacctggctcaccaaccctggccgggggcagaaccctgcgctgtgnnnncgacgaacgncgccgcgctcatcgccctgctgcacgccggccccgtcgagctcgtctactactggctgcaccgcgcgctgcaccaccacttcctctactcccgntaccactcccaccaccacgcgctcatt

SEQ ID NO: 28884 - protein, 166 aa, Zea mays
  misc_feature: Ceres CLONE 1403305-F
  misc_feature (122)..(122): Xaa is any aa, unknown, or other
  misc_feature (123)..(123): Xaa is any aa, unknown, or other
  misc_feature (126)..(126): Xaa is any aa, unknown, or other
MATNPGLFTEWPWKKLGNFKYLLLAPWVAHGGYQAATKGWRAADLGYVAILPSLLLRALHNQAWITASRLQSARGRRQVVDRGIEFEQVDRERNWDDQILLSGILLYLAHQPWPGAEPCAVXXTNXAALIALLHAGPVELVYYWLHRALHHHFLYSRYHSHHHALI

SEQ ID NO: 28885 - DNA, 628 bp, Zea mays
  misc_feature: Ceres CLONE 1403306-F
  misc_feature: Encodes the peptide sequence at SEQ ID NO. 28886
  misc_feature (355)..(355): n is a, c, t, g, unknown, or other
  misc_feature (567)..(567): n is a, c, t, g, unknown, or other
ggagctccccgcggtggcggccgctctagaactagtggatcccccgggctgcaggaattcgcacgagaccattacctagaacatcctaatcgaaaaacgtccccgtggtcagcaccaccgaaagccccgagaaaccctaggcaccaggaccaggaaggcgcgccgcgcagccatggcgaagaaccggaacaagaagaacagggccaagagcggcggcctcgccgccatggacatctctgagggcggccccgccacatccactgccgcggacgtcccacaaccaatggatacgtcagagggaaagcagccatcgtcgaccacagcaacgctcggttcgatcaacaagtaagctaanaatactgcagcgcagcaattgctattacttttttatttatatatgggtgcacagaggctcgttccgtcaattattatgttgggccttcaataatctgccttgttattgtgacattgcttttcgtgaacactggaacccatccacagtaatatatatcaatggggtttgatgtgctcgaaccgccgttttgttgcctaggtgtttggaaaggnaggccgggaaccttttattgggacctgggggaacaaggaaaattttaggaggacccttgaa

SEQ ID NO: 28886 - protein, 58 aa, Zea mays
  misc_feature: Ceres CLONE 1403306-F
MAKNRNKKNRAKSGGLAAMDISEGGPATSTAADVPQPMDTSEGKQPSSTTATLGSINK

SEQ ID NO: 28887 - DNA, 687 bp, Zea mays
  misc_feature: Ceres CLONE 1403307-F
  misc_feature: Encodes the peptide sequence at SEQ ID NO. 28888
caccgcggtggcggccgctctataactagtggatcccccgggctgcaggaattcgcacgagaccattacctagaacatcctaatcgaaaagatcttcccttcctgcatttcctcctctgtctcatcggtcacccctgtccctcgtggcgacggccggtcgaccgccgctgccgaggatttcgccgcggacgaccacccccacgaccactacattatatgctgaagaatggcttgcagctaacattactgacacaaacttttgcttatcatcagaagcgactgaagtgcagaaatgaatctctaattgtttgcaatataagaaccagatacctcattctgatggattttccatgatacagattgatagccaagaacaaagagagcaactcgctgcagtagtgggtcacgaccatatgtctcgtataaagatgcatatggcacaaggttcttttggtgacaggattggatgtcagcatcctgcgtgtaatgaggttgtcaatataagtggtaccgtactgcaaaatcacagttgaacagctgtcatgcccaacatctcagttacctccagagcgtgactgaaacagctcaccgttaatgctgtgcgcccctgttcacgacagcaaattttaatggaatcctgtttcgccattgcaccagggccattgcacctgaagcaagaggcttcgg

SEQ ID NO: 28888 - protein, 60 aa, Zea mays
  misc_feature: Ceres CLONE 1403307-F
MIQIDSQEQREQLAAVVGHDHMSRIKMHMAQGSFGDRIGCQHPACNEVVNISGTVLQNHS

SEQ ID NO: 28889 - DNA, 647 bp, Zea mays
  misc_feature: Ceres CLONE 1403308-F
  misc_feature: Encodes the peptide sequence at SEQ ID NO. 28890
  misc_feature (440)..(440): n is a, c, t, g, unknown, or other
  misc_feature (452)..(452): n is a, c, t, g, unknown, or other
  misc_feature (647)..(647): n is a, c, t, g, unknown, or other
gctctagaactagtggatcccccgggctgcaggaattcgcacgagaccattacctagaacatcctaatcgaaaaacggtctggttcttgttcctgagcagttgagctgcgcacaccgacttcttttgcacaaggtacagcagcgcaggcgcggcggcagcccgccgctggatctctcccgaggctccggcgatggagcggtcctgctacttcccgctgcggtgggagagcacgggcgaccagtggtggtacgcgtcgccgatagactgggcggcggccgacggccactacgacatcgtccgccagctgctgcacctcgaccccaacctgctcatcaagctcacctccctccgccggatccgccgcttcgagggcgctgtgggacgacgacgcccgctttcgccgacgcggcccggaacccgcgcgtccgtcgcccgcagnctggctgctggnagtgcgagtgcagggaaccaccgccccggcgccggggagaacacgctgctccggggcgggaaccgggggcttggtgctctaacgcgggggggtcggccggggaccccgcgtttcttgcggtagttgtctggaaaggtaccccctgttgctcgaacacgccatgggcccccgagggctccaacgagttgccggaan

SEQ ID NO: 28890 - protein, 127 aa, Zea mays
  misc_feature: Ceres CLONE 1403308-F
  misc_feature (83)..(83): Xaa is any aa, unknown, or other
MERSCYFPLRWESTGDQWWYASPIDWAAADGHYDIVRQLLHLDPNLLIKLTSLRRIRRFEGAVGRRRPLSPTRPGTRASVARXLAAGSASAGNHRPGAGENTLLRGGNRGLGALTRGGRPGTPRFLR

SEQ ID NO: 28891 - DNA, 746 bp, Zea mays
  misc_feature: Ceres CLONE 1403309-F
  misc_feature: Encodes the peptide sequence at SEQ ID NO. 28892
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
  misc_feature (52)..(52): n is a, c, t, g, unknown, or other
  misc_feature (415)..(415): n is a, c, t, g, unknown, or other
  misc_feature (746)..(746): n is a, c, t, g, unknown, or other
tttttttcctcctccttcctctcccctcaacccnnanaagaaggtgggggtncaaaactggaactcaccgcggtggcggccgctctataatagtggatcccccgggctgcaggaattcgcacgagaccattacctagaacatcctaatcgaaaaatcaactcgtttctctccgattgctcctccgagtccgagactccgttctctcccgcatccaccgccgtctcatccccaatccgagcaacgcctcccctcgcctccaaaaccctacccctcctgtcaccggcgggggcatgaaccggtgatcgcttacctggtctcgtctgtctgcgcacgcgcgaggtcagtgagtgagcattgcggtggtccgatcgcccgcggggggccatggcgtctgtggcgggatcgggcggcggngcaagcgcgggggccggtgggttgaagacttacttcaagaccccgaggggcggcacaagctgcagtacgagaagacgcactcccccgccgtcgggcactacaaccaaacgggaagaccgtcgcccagatgacggggggaatatttgaaggaaaagccgcagggccagggttcccccgccttcaaacaccaagggctggaaaagggaaatggcggtcttggaacttggaaaaattgcttgtgccattgggaaaggggaacccccgaaacctttaattctgcgggggaggacaggggtaccacccgcggggcttgtgtccacagagaaaaaan

SEQ ID NO: 28892 - protein, 58 aa, Zea mays
  misc_feature: Ceres CLONE 1403309-F
MASVAGSGGGASAGAGGLKTYFKTPRGGTSCSTRRRTPPPSGTTTKREDRRPDDGGNI

SEQ ID NO: 28893 - DNA, 740 bp, Zea mays
  misc_feature: Ceres CLONE 1403310-F
  misc_feature (19)..(19): n is a, c, t, g, unknown, or other
  misc_feature (58)..(58): n is a, c, t, g, unknown, or other
  misc_feature (740)..(740): n is a, c, t, g, unknown, or other
ggggggggtggcctccccncccccccccaccctcctcctccggagaaaggaacccccnccacaaaactggagctccccgcggtggcggccgctttagaatagtggatcccccgggctgcaggaattcgcacgagaccattacctagaacatcctaattaaaaaataacctctctccttcctcgccccttcccctccacgactccactaccaccaccttcaccttgtctcccacaaccgccgcgcgcaagccctagcccgatctcgccggcgacagacaccagatctcgccgcccgttgcgcgccgatacgcgccccgccggattcaccgctcctcgcgctgcagcacgcccgggcctgggttactgcgtgacatgtagtattgtataattggaggttgtcaccatcaccacaaagcatatgttgtgatttgtcgatggcgaggagatgaaacaggtgtaggggcggagcagcaaggacatgacagccatgccgcatccgcgccaccgaggggctgctaagaagcccatgtggatcatagtgctattgtctttgggttggtgttgcacttatggggggcctatggtctacccaacacgggggctactcccgcatggctacttctttgggttccgagggggccggaacctccggtttcagggaatgggcctaacccgggttgttgggctcggggaggggaaaatggaaggaaaaaagaatagtttcccatccggggggggtn

SEQ ID NO: 28894 - DNA, 686 bp, Zea mays
  misc_feature: Ceres CLONE 1403311-F
  misc_feature: Encodes the peptide sequence at SEQ ID NO. 28895
gtggatcccccgggctgcaggaattcgcacgagaccattacctagaacatcctaatcgaaaaagcagagggccatcttctactcttctctcccagccaacccccttgtccaacggttcagcctgctcaattttagtgaccagttacggcaaatgcagccctcggcggacagcaggaagaagaagcggcggcggcggaggaggaggaggctggtggcatgctactcatcgagacctgctgccggcgccgctcaaggccagtgtcagtgcggctcctctagccccggtggcggcggcggaagcggaagcctcgtggcaagaacaccgcgcgcgttctcgagctgctccagctacgccgcctcgtctgcctgcgcgccgggcggcgtccgtccatcctcggcacccagcacaagctgacggcgctcctcgtggcgctcgcgctcctcctcgtgctccctcgccctcctctcggtggcagggggtaccgggcggagccccccccggaggcatggtgcggcatccgcagcccccgggggaggaggattccaggtaggaacccccgtggggctccatctggataggccacgcacgagcgacccacctacccgttatgggtgcgggccgccgtcaccgacgctcaccactggtgctaggaggtccacggtgggttcctaggagcgagaggacg

SEQ ID NO: 28895 - protein, 87 aa, Zea mays
  misc_feature: Ceres CLONE 1403311-F
MQPSADSRKKKRRRRRRRRLVACYSSRPAAGAAQGQCQCGSSSPGGGGGSGSLVARTPRAFSSCSSYAASSACAPGGVRPSSAPSTS

SEQ ID NO: 28896 - DNA, 633 bp, Zea mays
  misc_feature: Ceres CLONE 1403313-F
  misc_feature: Encodes the peptide sequence at SEQ ID NO. 28897
  misc_feature (388)..(388): n is a, c, t, g, unknown, or other
  misc_feature (391)..(391): n is a, c, t, g, unknown, or other
  misc_feature (420)..(420): n is a, c, t, g, unknown, or other
  misc_feature (443)..(443): n is a, c, t, g, unknown, or other
  misc_feature (474)..(474): n is a, c, t, g, unknown, or other
agtggatcccccgggctgcaggaattcgcacgagaccattacctagaacatcctaatcgaaaaactctgcaaagcgcgcgaccggacggcccggttcgttctcgacctctcgtctcgctcatccgcccgcccccgaggaagtaaccctagcctagccttgctccgaccggtcgccgcggcgactgcgacgatgatggactgcgctggaggccgagaccccgtggaggacttcctcctcggcggcgccggcgccggcgacgacggagatctcgtcgccgtcttctgcgacgacggaggacttgggattgagggtatccatggagatgcttgtggatttgagcaatctaatttggggaaaaggggtagagatgaaccatgttcatctggnccnacatccaaagcttggcgtgaaaaaatgangaggggacagctgaatgacaggntcctggaaataagttcattatgaatcctggnaggaagcaaagttagataagcaaatatattgagtgatgcagccccgtatggtggcacactttaaaggggaggcagaaaagcttagggatccaatggagaagttgcgggagaatatcccgggtttggaagggggggaaaaacgagcttcgggaaaaaaaa

SEQ ID NO: 28897 - protein, 91 aa, Zea mays
  misc_feature: Ceres CLONE 1403313-F
  misc_feature (77)..(77): Xaa is any aa, unknown, or other
  misc_feature (85)..(85): Xaa is any aa, unknown, or other
MMDCAGGRDPVEDFLLGGAGAGDDGDLVAVFCDDGGLGIEGIHGDACGFEQSNLGKRGRDEPCSSGPTSKAWREKMXRGQLNDRXLEISSL

SEQ ID NO: 28898 - DNA, 705 bp, Zea mays
  misc_feature: Ceres CLONE 1403315-F
  misc_feature: Encodes the peptide sequence at SEQ ID NO. 28899
  misc_feature (194)..(194): n is a, c, t, g, unknown, or other
  misc_feature (277)..(277): n is a, c, t, g, unknown, or other
  misc_feature (322)..(322): n is a, c, t, g, unknown, or other
  misc_feature (323)..(323): n is a, c, t, g, unknown, or other
  misc_feature (334)..(334): n is a, c, t, g, unknown, or other
  misc_feature (355)..(355): n is a, c, t, g, unknown, or other
  misc_feature (356)..(356): n is a, c, t, g, unknown, or other
tccccgcggtggcggccgctctataactagtggatcccccgggctgcaggaattcgcacgagaccattacctagaacatcctaatcgaaaaatccgccactacgccacaaaatcctctcctactccggcagttctgctcgccgccgcctccacgatgacggaagacgtgcagatgaacgactcggagccccagncctgcggcctcagctcccgccgtcggggcgccggcgctctccacactacaccatctgaaggagatcgcgtccgtgatcgaggncggttctcgggtccaggaggtccgccggatctcccgcgccttccnngctcacgtcgngctccgtcgcccgctcgccgnngggggacgtctccgccttcctcgccttcgcgctacccgcgtcctccgaagcctacggacgcctcactggccctgttgccccaagaaaatgatactgaaaaggaatgttaatgctgcaactcccagaaatttaaaattcaatccaaaacggctcccccctgaaaatgagaaattttggtaacttggcccgaaggggttttccttatggcctaaaaaaattttgtgggggtttagggttggggccaagggggaaattttcccccccctaaaaaatccacccgagaaatgtgggggggtgttttaaaacccgagggggttttttatattctttgggggggggggcccacccc

SEQ ID NO: 28899 - protein, 30 aa, Zea mays
  misc_feature: Ceres CLONE 1403315-F
MILKRNVNAATPRNLKFNPKRLPPENEKFW

SEQ ID NO: 28900 - DNA, 742 bp, Zea mays
  misc_feature: Ceres CLONE 1403320-F
  misc_feature: Encodes the peptide sequence at SEQ ID NO. 28901
  misc_feature (357)..(357): n is a, c, t, g, unknown, or other
  misc_feature (546)..(546): n is a, c, t, g, unknown, or other
  misc_feature (548)..(548): n is a, c, t, g, unknown, or other
  misc_feature (556)..(556): n is a, c, t, g, unknown, or other
aaagctggagctccccgcggtggcggccgctctagaactagtggatcccccgggctgcaggaattcgcacgagaccattacctagaacatcctaatcgaaaaatcccaagaagagccgccctacctattccttctccccgccgtcgagctgcccaacccagagcaccagcagccctcacctccttcctctcggccggtccttccaacgagcccgctggtcttggagccgccaccgttctcgttctggacgaacgttcaaggagattgcatttgtggatgctctaatggagtcgaaaggtggcaagaagtctagtagtagtagtagtaatttcatgtacgaagctccccttggctacnagatcgaggacgttcgcccagccggaggaatcaagaagttccagactgctgcttattccaactgcgtccgccagccatcctgatatcgcctcacatgcaattcgcggtagagtaggattttaattcagttttcctcttgtgtcggtagttttccgttggctctggctggcttcctctggctctgagatncnacttgtcntgcccatctctctttttctctctcatcctctctttcttgcacgtctccaggtggcgatggtctcagcagaatcttgggcctcttctcctgcctccctatttgcctttgaggctatgagaaacgcctcgagatccgttctctgacgcgccctgtttttgaggaccccttgggggtcggggcctgcgc

SEQ ID NO: 28901 - protein, 51 aa, Zea mays; identical to SEQ ID NO: 25716
  misc_feature: Ceres CLONE 1403320-F
  misc_feature (1)..(51): Pfam Name: AdoMetDC_leader Pfam Description: S-adenosyl-l-methionine decarboxylase leader peptide
  misc_feature (25)..(25): Xaa is any aa, unknown, or other

SEQ ID NO: 28902 - DNA, 687 bp, Zea mays
  misc_feature: Ceres CLONE 1403322-F
aagctggagctccccgcggtggcggccgctctagaactagtggatcccccgggctgcaggaattcgcacgagaccattacctagaacatcctaatcaaaaagatctacctgtctgttcttcgatcgagtctgagagatttgggaggaggagggaaacaaagcgaaagagcccatcttttttgtctttttggttcggtttcgtggttgcttcttttggaccccgcggaggagcccaccgtttctacaaaaacccaatctttgctgccttctcagcggtcgagatcgataggtttccagatctgaggctccgtgttctggctgtgagatcggaggcgcagcaatccgagcacgcagctagtagggaaagtatccgagaaaagttgcagattttgctgggggcaacggagcgagaacaagttactgcagaaggaaagggcaaaggtgggggaggcgccggagatgagggatgctatcagctctgatggattatttgaaatcttgctcgggtcccgcatcaccggctgggcgtccccgcaaaggatcggatgccaccggccgcccaggacgggctccctgtggtacaaggacggcggggcagggtcgccgatggtggagttcctccatgggcccgggggccaaggccaataaacctatttggaagaacccatagcgcagggttgaattccg

SEQ ID NO: 28903 - DNA, 659 bp, Zea mays
  misc_feature: Ceres CLONE 1403323-F
aaagctggagctccccgcggtggcggccgctctagaactagtggatcccccgggctgcaggaattcgcacgagaccattacctagaacatcctaatcgaaaataccgcctgatccaccgcggtttgcttgccgcgagcatgctaaattattattcattcgacaagtaagagagattttatttcctctcgtcgtctcgtggacgctgatgcccgcgcgtcagatttggcctgctccgctccgcctccgcagtgtgaatttctgagagataagtttctgtgctgcagacagcccggcggcaacttgatgctagtttgcggagaggtccggagtcacgccggagttcatgtcattcaggacggatgctacttgcgagtactctgattggctctcggtctcccgagctccggccggccgggagaagcctttccaaggtatcaaaaaaaaaaaagtccatgtgttttgagttaccagacaagggaggggtggcccaaaaaaattttaattgttctttggaagaattaaaattatcctttgggagggggttaaaaagggggctttccaaaggggggggtttaattgggggggggtttccaaataacttccgggggagagagaggggggagagaaaaaaaaaaaaaaagccccccccccccccccc

SEQ ID NO: 28904 - DNA, 592 bp, Zea mays
  misc_feature: Ceres CLONE 1403324-F
  misc_feature (327)..(327): n is a, c, t, g, unknown, or other
aaagctggagctccccgcggtggcggccgctctagaatagtggatcccccgggctgcaggaattcgcacgagaccattacctagaacatcctaatcgaaaaatcaagttttgtagtgttgttagtgtttctaccgtatgtctgatttgtactttattagtacttaagtctgtctttgagaatataagatactagtctgttcactgaagaatgtggccttaaacactagtttgatttcagggtggttatgttctttatcgcctcttctggaaacagaggagaaaactgtgcgctccagcccagaaaaatggatagaaagtgcaactcngctactactccccgttcttcacgtgacaaccaagaggcggatgaagaggctaatacccccattaaataaagaaatctctagaatctgctctgcatgatccgattggagctgcccaattctgtgaaccccctgttggccaaggaaaatggccctgggggacaaaaatgaaaattgtggggtaccggcccgggtgttttcccaaatccctttccagggaaattggtgggtggggaagactaaaattggatcccccccccccccccgc

SEQ ID NO: 28905 - DNA, 746 bp, Zea mays
  misc_feature: Ceres CLONE 1403325-F
  misc_feature: Encodes the peptide sequence at SEQ ID NO. 28906
  misc_feature (593)..(593): n is a, c, t, g, unknown, or other
catagctggagctccccgcggtggcggccgctctagaactagtggatcccccgggctgcaggaattcgcacgagaccattacctagaacatcctaatcgaaaaaaaccctaaccccatcccgcactccccccctcccccaacacgcgcgtgctttcttagccgctaagcatatccctccccgccacgatctcgatggtggagatgtctgtggtggagctcaggacgctgccgctcggcttccgcttccaccccaccgacgaggagctcgtcacccactacctcaagggcaagatcaccggcaggatcaactccgagtccgaggtcatccccgagatcgacgtctgcaagtgcgagccgtgggacctcccagataagtccctgatccgggccgacgatcctgagtgtttcttcttcgcccccaaggaccgcaagtaccccaacggtagcaggtcgaacagggccaccgaggcgggatactgggaaggctactgggaagggacaggattatcaaatccaaggccgacaagcgcaaggagcataccatgggtatgaagaagaccctcgccttccccggggtcggggccccaagggngagggacggggtggattattgcagagtccgaccacccagccgggtttcaatccggggaggaggggggttagttctttatccgctttcccgaagaagagggaaaaatgggcctcccccccagagaaggggaaaaaaagggtaacccccacccct

SEQ ID NO: 28906 - protein, 119 aa, Zea mays
  misc_feature: Ceres CLONE 1403325-F
  misc_feature (12)..(111): Pfam Name: NAM Pfam Description: No apical meristem (NAM) protein
MVEMSVVELRTLPLGFRFHPTDEELVTHYLKGKITGRINSESEVIPEIDVCKCEPWDLPDKSLIRADDPECFFFAPKDRKYPNGSRSNRATEAGYWEGYWEGTGLSNPRPTSARSIPWV

SEQ ID NO: 28907 - DNA, 709 bp, Zea mays
  misc_feature: Ceres CLONE 1403326-F
  misc_feature: Translation starting site: 252
  misc_feature: SWISSPROT Homolog: EC 2.7.7.27 Glucose-1-phosphate adenylyltransferase
  misc_feature (458)..(458): n is a, c, t, g, unknown, or other
  misc_feature (473)..(473): n is a, c, t, g, unknown, or other
gctggagctccccgcggtggcggccgctctagaactagtggatcccccgggctgcaggaattcgcacgagaccattacctagaacatcctaatcgaaaaaaaaaaacgcacgggggagcttgggagacttcacgacaaatcgacgatcgccgcttctcttggccattgtagagggagagagagagcgcgagcgacctaggtcagtcggtttcggttttgggcgtcagcttcagctatccgcgaccgcgacgatgggtctgcgcgtggccgccaccgcgccagctccggccggcgtgcgcgtgctcggcaggggcgccgcgcgcgtgacgccgcgaccgtgggcggctgtcggcggcaggagacgcttctccgtgcggatgtccgtcgcgaccaccgaggccaccaccaccatcgccgtgggcgcctcggaggacaggcgctggaggctagcaactccnagacggtggtggcgntcatcctcggcggtgggcgcgggaccaggctcttcccgctttacagacgcagggccaagcccgcggtgcaattggcgcgcgtacaggctcatcgacgtggcgatgagcactgcataacagcgggatcaacaagtctaatcctcacgcagtcactcgcaatcctcaatcgccactctcagagctacgattcagaatggcggcctcggaacggtttcgcaggtctacacaacggaggg

SEQ ID NO: 28908 - DNA, 736 bp, Zea mays
  misc_feature: Ceres CLONE 1403328-F
  misc_feature: Encodes the peptide sequence at SEQ ID NO. 28909
  misc_feature (425)..(425): n is a, c, t, g, unknown, or other
  misc_feature (433)..(433): n is a, c, t, g, unknown, or other
  misc_feature (511)..(511): n is a, c, t, g, unknown, or other
tggagctccccgcggtggcggccgctctagaactagtggatcccccgggctgcaggaattcgcacgagaccattacctagaacatcctaatcgaaaaagagcagccgacaactctctaccgtccgagaccccaagcaccagcgcggcggcggcggcggcggcgaccatggctgtcgggaagaacaagaggatctccaagggaaagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctggcggaggcgcgaagaagttccagtctgctgcttactccnactgcgcnaagagccatcctgatatccctttgggctcctcgttctagtagtttaggatttcttttctgacacttcgattcttaccnatccccctgggctgctgctttcctgacatcgaccagttccccagtcttgctccctgcagtcctcctcctcattctcccggggtgtggtctgactcactgccaccatggctgttctttctgctggctgggctccccggctcaaattatcgggttttgaggctatgagaggcggcttgaatcacatctctgaggcacctggcttgggcacccccatggagggggttt

SEQ ID NO: 28909 - protein, 58 aa, Zea mays
  misc_feature: Ceres CLONE 1403328-F
  misc_feature (1)..(51): Pfam Name: AdoMetDC_leader Pfam Description: S-adenosyl-l-methionine decarboxylase leader peptide
  misc_feature (44)..(44): Xaa is any aa, unknown, or other
MESKGGKKSSSSRSMMYEAPLGYSIEDVRPGGGAKKFQSAAYSXCAKSHPDIPLGSSF

SEQ ID NO: 28910 - DNA, 746 bp, Zea mays
  misc_feature: Ceres CLONE 1403331-F
aagctggagctccccgcggtggcggccgctctagaactagtggatcccccgggctgcaggaattcgcacgagaccattacctagaacatcctaatcgaaaataccgcctgatccaccgcggtttgcttgccgcgagcatggaaattattagtcattcgacaagtcagagagattttatttcctctcgtcgtctcgtggccgctggtgcccgcgcgtcagaatttggctgctccgctccgcctccgcagtgtgatttctgagagataggtttctgtgctgcagacagccccgcggcgacgcggtggcagtttgcggcgaggtcggcgtcgcgccgggcgtcatgtcgttcaggacggaggcgacgggcgacggctctgaggggtgcgtcgggctcgagctccgggcggccggagacgctttcgacggatcaagaggagagctccatgctttcgatctacagggagaggcagtttggcacaacagcagccaggccacggacagcagcagtacccctgcagggggcacaggcaggcctcgcaggtgggggatttacggggcggggcacccgatcgtctccctgggtgggggggggggggggattcaggcttagggcaccccggtgccggggccccccccttgggccgttccatcagggcccaccctgagggccggggccttcgggggtcgaaaaagtttccaaaaaccaggaggaggcccttttccccagaggaaaaacaaaggggttt

SEQ ID NO: 28911 - DNA, 673 bp, Zea mays
  misc_feature: Ceres CLONE 1403337-F
  misc_feature: Encodes the peptide sequence at SEQ ID NO. 28912
tccccgcggtggcggccgctctagaactagtggatcccccgggctgcaggaattcgcacgagaccattacctagaacatcctaatcaaaaaaaaacctagctagatttagaggaaaaaaaaaactgtccccaaccgtgagatggctgagtacggcgagcgctaccagggcaacggcgacccggccacgcccgagggtggctacgcgcagaccgagtacgccgccgccggtggctcgccgcccgccgaccgcaagccctccgtgttctccgaccacgctgacggtcgctcctcccagccccagcatgagactcaatcacatggcagtggttcctccaaatctcgagaaagggaccgagaacgtgataaggaaaaggacagggagcgaggcagagaccgtgtccgcgaaaaggagagggaccgagacagggacaaggatcgtgaaagagggacagagacagggatcgtgatcgccaccacatggatcgtcgcgagcgcagcgagataagggaccaccgtgatcgttctgatgatcgtgaccgtcaccgcgatgatcgtgaccgtcgcaggagtcatgattctgagaaggagaagagatcgtgacagagatggccatcgtaggcatcgctcccgttccccttctaagagtcgggaaccgggacggaagaattaaag

SEQ ID NO: 28912 - protein, 121 aa, Zea mays
  misc_feature: Ceres CLONE 1403337-F
MAEYGERYQGNGDPATPEGGYAQTEYAAAGGSPPADRKPSVFSDHADGRSSQPQHETQSHGSGSSKSRERDRERDKEKDRERGRDRVREKERDRDRDKDRERGTETGIVIATTWIVASAAR

SEQ ID NO: 28913 - DNA, 717 bp, Zea mays
  misc_feature: Ceres CLONE 1403338-F
  misc_feature: Encodes the peptide sequence at SEQ ID NO. 28914
  misc_feature (433)..(433): n is a, c, t, g, unknown, or other
  misc_feature (446)..(446): n is a, c, t, g, unknown, or other
  misc_feature (447)..(447): n is a, c, t, g, unknown, or other
  misc_feature (476)..(476): n is a, c, t, g, unknown, or other
  misc_feature (477)..(477): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (681)..(681): n is a, c, t, g, unknown, or other
  misc_feature (682)..(682): n is a, c, t, g, unknown, or other
  misc_feature (684)..(684): n is a, c, t, g, unknown, or other
tggagctccccgcggtggcggccgctctagaactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggcgtccacggagaggcaggcgcccgccgcggcgttgcaggggttcctgtgcctgnaggaggtggacgnnaggcggtggagctacgtggtggacggtgnngccgcgaaggggagaaccaggnnncggcgcccgtccccgctggggccgccggtcagggccgtggccgctgcagtcgccgcttccgcctggcgaggaaataatggcatcataagatcatatgtggtggcctgaggggttccagacagtgtactccttcatatgtacctacttggacctggaggctcgaagcattttcttgggganngnatgggagtgttacacagaaccctggcggaggtg

SEQ ID NO: 28914 - protein, 118 aa, Zea mays
  misc_feature: Ceres CLONE 1403338-F
  misc_feature (61)..(61): Xaa is any aa, unknown, or other
  misc_feature (65)..(65): Xaa is any aa, unknown, or other
  misc_feature (75)..(75): Xaa is any aa, unknown, or other
  misc_feature (83)..(83): Xaa is any aa, unknown, or other
MAPAVGLKRSATQTITLPPPDTRLAVRDVMRSTIPSQPAVAPASTERQAPAAALQGFLCLXEVDXRRWSYVVDGXAAKGRTRXRRPSPLGPPVRAVAAAVAASAWRGNNGIIRSYVVA

SEQ ID NO: 28915 - DNA, 639 bp, Zea mays
  misc_feature: Ceres CLONE 1403340-F
  misc_feature: Encodes the peptide sequence at SEQ ID NO. 28916
  misc_feature (277)..(277): n is a, c, t, g, unknown, or other
  misc_feature (278)..(278): n is a, c, t, g, unknown, or other
  misc_feature (301)..(301): n is a, c, t, g, unknown, or other
  misc_feature (310)..(310): n is a, c, t, g, unknown, or other
  misc_feature (311)..(311): n is a, c, t, g, unknown, or other
  misc_feature (384)..(384): n is a, c, t, g, unknown, or other
  misc_feature (385)..(385): n is a, c, t, g, unknown, or other
gctctagaactagtggatcccccgggctgcaggaattcgcacgagaccattacctagaacatcctaatcgaaaaaattcaaataatttttgcgctctcgcgtcgatctgcttgaaccaagccccgaccggagccatggcttccgccaaggagagctatcgcgccgagctccgcgcctcctcccggcagctcggcgagcgttgcctctactccgccgctaaatgggccgccgagctgctcgtcggcgtaaagctggatgggaccccggtcccttcggnncgcgacggactccccatcctccntcgtcgggnnctccgcggggcggctattgcactcaccggaaaagggggggttcaagtttccggcaccgacccggcccgggggnnggagtatatcgggaaggcgggacccgcttcggggggggtgtgataaagtaggacggcatccccgaggaagagcgttttaaatttggggggaaaaaaaccgggtgggcaaacctatttcgacggggggggggaaaccccgcgcccggaagtggtggaaaaaacgggtgggggaaagaaaagggtcccggggaggttacccccctcaaatggggtgggaggaaaacaaaaagggcggaaatggtaaaaatttttag

SEQ ID NO: 28916 - protein, 97 aa, Zea mays
  misc_feature: Ceres CLONE 1403340-F
  misc_feature (48)..(48): Xaa is any aa, unknown, or other
  misc_feature (56)..(56): Xaa is any aa, unknown, or other
  misc_feature (59)..(59): Xaa is any aa, unknown, or other
  misc_feature (84)..(84): Xaa is any aa, unknown, or other
MASAKESYRAELRASSRQLGERCLYSAAKWAAELLVGVKLDGTPVPSXRDGLPILXRRXLRGAAIALTGKGGVQVSGTDPARGXEYIGKAGPASGGV

SEQ ID NO: 28917 - DNA, 658 bp, Zea mays
  misc_feature: Ceres CLONE 1403341-F
  misc_feature: Translation starting site: 250
  misc_feature (521)..(521): n is a, c, t, g, unknown, or other
tccccgcggtggcggccgctctagaactagtggatcccccgggctgcaggaattcgcacgagaccattacctagaacatcctaatcgaaaacctttcgggcagaaagagccagagagagagagagagagaggtcggggctggggagcacacacccatcacccatggcctgactgacctccggactctccctgcttccgtcgccgccgcgggccgcccagctgactgctcctgccctccgcccgccctccatggcgtccgtcaagctcggctccaagcctgacgccttcaagcggcaaggccaggcatggttctgcacaacaggacttcctagcgatgtcaccgttgagggttggggatatgtctttccaccttcacaagttccctttactttcaaaaagtgccttttcttgaacggtcaattgaagaaaattctgaccaagaaaaatgcatcatcaaactaaatgacatttcctgggggtgccaagtcatttgagtaaaattgcaaggttccggctatggnagtgaaaaataaagcttttcacctgcaaatgttgtctaaccctacggggggggcctcaagagcatctaaaaaaggactgaaaaaagtagctggaggaaaaaccggattgcaccgggcagaaatggtcctccaacccg

SEQ ID NO: 28918 - DNA, 663 bp, Zea mays
  misc_feature: Ceres CLONE 1403343-F
  misc_feature: Encodes the peptide sequence at SEQ ID NO. 28919
tggagctccccgcggtggcggccgctctagaactagtggatcccccgggctgcaggaattcgcacgagaccattacctagaacatcctaatcgaaaaaagagcgtgcagagcgagacgcgtcgcctcctcccttcccccaccccgccgccgccctcgcgtccgtccgtccgtccgttattagggttcggtcgccgccatggcgatcctctcggcgctcgccaccgaggtgctcatccccgtcgccgccgtcatcggcatcgccttcgccgtcgtgcagtgggtggtcgtgtcgcgcgtgaagctctccccggccgcggccggcggtggcggcggcaaggccggctacgccgactccctcatcgaggaggaggaggggctcaacgaccacaacgtcgtcgtcaagtgcgccgagatccagaacgccatctccgaaggagcaacatcgtttcttttcaccgagtaccaatatgttggtatcttcatggctatcttcgctgttgtgatcttcctcttccttggttcgggtgagggattcagcacgaagagccagccctgcacatatagcaaggacaagtactgcaaggcctgcgctgttcactgcactctttagcacggtgtccttccttgcttggagcatcacctctctgggtctctggtttctt

SEQ ID NO: 28919 - protein, 137 aa, Zea mays
  misc_feature: Ceres CLONE 1403343-F
  misc_feature: SWISSPROT Homolog: EC 3.6.1.1 Inorganic diphosphatase
MAILSALATEVLIPVAAVIGIAFAVVQWVVVSRVKLSPAAAGGGGGKAGYADSLIEEEEGLNDHNVVVKCAEIQNAISEGATSFLFTEYQYVGIFMAIFAVVIFLFLGSGEGFSTKSQPCTYSKDKYCKACAVHCTL

SEQ ID NO: 28920 - DNA, 664 bp, Zea mays
  misc_feature: Ceres CLONE 1403344-F
  misc_feature: Translation starting site: 426
  misc_feature (341)..(341): n is a, c, t, g, unknown, or other
  misc_feature (444)..(444): n is a, c, t, g, unknown, or other
  misc_feature (459)..(459): n is a, c, t, g, unknown, or other
  misc_feature (465)..(465): n is a, c, t, g, unknown, or other
  misc_feature (510)..(510): n is a, c, t, g, unknown, or other
  misc_feature (613)..(613): n is a, c, t, g, unknown, or other
ctagaactagtggatcccccgggctgcaggaattcgcacgagaccattacctagaacatcctaatcgaaaaattgcgggaactgaaagcaaaccaaaaaagaaagagagggggagagacacagaggcctcactccacacactgtcttgtctctcagtcccagagctttcttggatcgcgaggaatccactggaaattttgcaattgtagtagagaactgtatcgtccgacgaaggtgcatggtgttggccatgggtcacggcagggaacagagacgagcagggcggcgctctccccccagctcattgatcctgtcctcgctgtaaggtattcctgcggtgncctccgaatttcactcgatcgaacacgacatgaagcggccacgcggcgccagcccccctctggctgcgatgaccaatccgaacgatgatggttacggcgtggntcgggatggaggcgnacgcgnacgcggacgcggacgaagaaaatgatggcggtgcggcggcgccgnaaaaaaaaagcggcgcctgaactccgagcaagtgcgcgccctggaggggaaccttccaagtgaaaaacaagctggagcccgaagcgaaagggggcggtttgcnccgcgacctcggcctgaagccgggcccagggtttccgctctgggttccaaa

SEQ ID NO: 28921 - DNA, 768 bp, Zea mays
  misc_feature: Ceres CLONE 1403345-F
  misc_feature: Encodes the peptide sequence at SEQ ID NO. 28922
  misc_feature (398)..(398): n is a, c, t, g, unknown, or other
  misc_feature (526)..(526): n is a, c, t, g, unknown, or other
  misc_feature (568)..(568): n is a, c, t, g, unknown, or other
  misc_feature (596)..(596): n is a, c, t, g, unknown, or other
  misc_feature (653)..(653): n is a, c, t, g, unknown, or other
  misc_feature (679)..(679): n is a, c, t, g, unknown, or other
  misc_feature (695)..(695): n is a, c, t, g, unknown, or other
  misc_feature (697)..(697): n is a, c, t, g, unknown, or other
caaagctggagctccccgcggtggcggccgctctagaactagtggatcccccgggctgcaggaattcgcacgagaccattacctaaaacatcctaatcaaaaagaagcttctaaaataatctcttcccgacgtctctggaaggtcagcatctgaacccaggtagcctccagcgcttggagacgtgccgtacttcaaaccctaagccaccaatggcagccggcggcggggcttccgtgggcggagcgcgcgcgggtggtggggacgcaaatccgcaacaggttccgcgtggcgcccgtggaccaccggtcgcttgtggctgcgggcggacggtcgtgtcgccactggagcggtccggcggtggtcggatcgcgttcgggccttgctgcagaggggccgnagcgcggatcggaactccacatcgacggagactcaccctgaggcggtggcaaaagcttcgtcccagcgttttgagattctacagaaaagagagtgggcaaagaaagttatggggattgaagactctgnttattttccgttcgcttcaagcattggctgttcctcttattnggcatgcatgctatgtttttatgatggnccttaactcagtttcaggttaatgggggtaaagaagctccatcaagcattacatggnagacctaagggcagcttcttctacgntcagcaatctgggggnancgatggatgaccccttcgtaattgctccctctcccacatctggtatgctgagccaaaaagtgaatggacct

SEQ ID NO: 28922 - protein, 135 aa, Zea mays
  misc_feature: Ceres CLONE 1403345-F
  misc_feature (63)..(63): Xaa is any aa, unknown, or other
  misc_feature (106)..(106): Xaa is any aa, unknown, or other
  misc_feature (120)..(120): Xaa is any aa, unknown, or other
  misc_feature (129)..(129): Xaa is any aa, unknown, or other
MAAGGGASVGGARAGGGDANPQQVPRGARGPPVACGCGRTVVSPLERSGGGRIAFGPCCRGAXARIGTPHRRRLTLRRWQKLRPSVLRFYRKESGQRKLWGLKTLXIFRSLQALAVPLIXHACYVFMMXLNSVSG

SEQ ID NO: 28923 - DNA, 685 bp, Zea mays
  misc_feature: Ceres CLONE 1403346-F
  misc_feature: Encodes the peptide sequence at SEQ ID NO. 28924
  misc_feature (461)..(461): n is a, c, t, g, unknown, or other
  misc_feature (638)..(638): n is a, c, t, g, unknown, or other
tccccgcggtggcggccgctctagaactagtggatcccccgggctgcaggaattcgcacgagaccattacctagaacatcctaatcgaaaagccatcgccatttgcgatttctttcgaggaaaaagggaagcaagcgcggaaatactccacagataccactcacctaccgctccgatccggccaccaagcgcaaccaatatctcgctccctttctctttctccgtctccctcctccgcacagcgcacgcgcaggaggccgctgccgggaggcccatctctatctctctccgctggatcctccggcctctcgcggtccggtggagcggagatccggccgctcgggcgtcggctgcttcctcgttctgccggagcaagaagctggcatcccgccatgtcgtcaccgatgccctcccctactctgaaggaccatctctccacgcctacaggcccctgcatctcnagggaatgggaggtcatatgcattgccttgggagctttcatggtgctccgtcttggttgccaccgtgtggctcacgctcaggagcagaaagagggtaaagggcggcgggcatccgcaaatatcccaatcacccaatccctgcaaattcaagaaatcaaggggggggggggggggaancaagtggcggccagcgactttggggcgccaaggaggcggccccccct

SEQ ID NO: 28924 - protein, 97 aa, Zea mays
  misc_feature: Ceres CLONE 1403346-F
  misc_feature (82)..(82): Xaa is any aa, unknown, or other
MSSPMPSPTLKDHLSTPTGPCISREWEVICIALGAFMVLRLGCHRVAHAQEQKEGKGRRASANIPITQSLQIQEIKGGGGGXQVAASDFGAPRRRPP

SEQ ID NO: 28925 - DNA, 691 bp, Zea mays
  misc_feature: Ceres CLONE 1403348-F
  misc_feature: Encodes the peptide sequence at SEQ ID NO. 28926
aaagctggagctccccgcggtggcggccgctctagtcctaaaggatcccccgggctgcaggaattcgcacgagaccattacctagaacatcctaatcgaaaaacctcatggctcacgcgaataccacacccacaccacaccacacctcacggcgtccattcattcccgtctcgtcttccgctgcttgcctccaactccccccgcgtcgtctcgtgcttccaatcaccatagagccggttgatccccaaaggcccatggttttctccgacgccgcgtcgcctctcgtagccaccgccgctgactctgcttcctcctgcgtcgcccacctcccctgctgctgtcccgttaattgttggccgttgttgttaacacccgtagctcgagggttctgatttcctcccgatcggttcggaaactggaaacgtatgaatttctcggggcccaattgtaaaaacctccctcggggtggacttcaatggccacgcccccctttcggggaagtgggaaccccgcccccttggccctttttaaaaaaacaaaaaccggaacccccccgggggcggggggcgccacccggaaagaagaaccccgggggaagggggaaaaaaaaaattttttcccccctccggggaacctccctccttaaaaaaagccccccccgccccgcccaaaaaaaggggggggggggggg

SEQ ID NO: 28926 - protein, 45 aa, Zea mays
  misc_feature: Ceres CLONE 1403348-F
MVFSDAASPLVATAADSASSCVAHLPCCCPVNCWPLLLTPVARGF

SEQ ID NO: 28927 - DNA, 784 bp, Zea mays
  misc_feature: Ceres CLONE 1403350-F
  misc_feature: Encodes the peptide sequence at SEQ ID NO. 28928
  misc_feature (379)..(379): n is a, c, t, g, unknown, or other
  misc_feature (383)..(383): n is a, c, t, g, unknown, or other
  misc_feature (385)..(385): n is a, c, t, g, unknown, or other
  misc_feature (394)..(394): n is a, c, t, g, unknown, or other
  misc_feature (419)..(419): n is a, c, t, g, unknown, or other
  misc_feature (441)..(441): n is a, c, t, g, unknown, or other
  misc_feature (543)..(543): n is a, c, t, g, unknown, or other
aaagctggagctccccgcggtggcggccgctctagaactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggncgcngncgtccacgnagaaggcagcgcccgcccgcgccgntgcagggggttctggtgcttgnaggaggtgaaccggaaggcgtggaaactactgggggaccggggggccccccaaagggaagaaaagggggggggcccttcccccttggggcccccctaagggnccgggccccttaaaccccccctttcccttggccgggaaaaagggggttttaaaaaaacattggggggccggaagggttcccaaaaagggtaccccctttatggaccctaaggggccggggggttcagaaatttttttggggggggggggggggggtgtaacaaaaaaccctgggggtttttggggggggcccccaaaaaaaaaaaaaccggtggtttttataaagggtctcccgggggggt

SEQ ID NO: 28928 - protein, 93 aa, Zea mays
  misc_feature: Ceres CLONE 1403350-F
  misc_feature (41)..(41): Xaa is any aa, unknown, or other
  misc_feature (43)..(43): Xaa is any aa, unknown, or other
  misc_feature (46)..(46): Xaa is any aa, unknown, or other
  misc_feature (62)..(62): Xaa is any aa, unknown, or other
MAPAVGLKRSATQTITLPPPDTRLAVRDVMRSTIPSQPAVXAXVHXEGSARPRRCRGFWCLXEVNRKAWKLLGDRGAPQREEKGGGPSPLGPP

SEQ ID NO: 28929 - DNA, 707 bp, Zea mays
  misc_feature: Ceres CLONE 1403351-F
  misc_feature: Encodes the peptide sequence at SEQ ID NO. 28930
  misc_feature (284)..(284): n is a, c, t, g, unknown, or other
  misc_feature (308)..(308): n is a, c, t, g, unknown, or other
  misc_feature (335)..(335): n is a, c, t, g, unknown, or other
aaagctggagctccccgcggtggcggccgctctagaactagtggatcccccgggctgcaggaattcgcacgagaccattacctaagaacattcctaatcgaaaagtcgccagatctcccccagggacgcgctcatccttttgcctcccaacttgtgctgtgcaggaacctgcggggaaggcggtcgctcgctcgctgagaggatgcctctggggctgacgctgggctcgctgggggcgtcgatgcgccggaagcggctgtcctcgctcgacatcctctcctccnagcgggcgccgcgggattactacnagggcaagaactggcagcccaccgggntccacacccgcaaaggtggatatggggattgttgatgaaaaagttgccagatttgtgggcccctgactttgactgattccagctgaaagcatacgtgtcacaatggggcagggaactcacagaggtcgacaggattctctactttagaaaaagtactgaaagcaagagctgatctgatcttttgcgtgcggggaggcagccaactcttgaagatttgggtcccctgacatggcatggtttccagggtttactttcagctttctactaccaacattcagaatttttttcttggagggggcaaactttatgctacctagattccttttcctggtttgaaagaggttttctccaatgtccctttttggagaataa

SEQ ID NO: 28930 - protein, 55 aa, Zea mays
  misc_feature: Ceres CLONE 1403351-F
  misc_feature (28)..(28): Xaa is any aa, unknown, or other
  misc_feature (36)..(36): Xaa is any aa, unknown, or other
  misc_feature (45)..(45): Xaa is any aa, unknown, or other
MPLGLTLGSLGASMRRKRLSSLDILSSXRAPRDYYXGKNWQPTGXHTRKGGYGDC

SEQ ID NO: 28931 - DNA, 675 bp, Zea mays
  misc_feature: Ceres CLONE 1403353-F
  misc_feature: Encodes the peptide sequence at SEQ ID NO. 28932
  misc_feature (395)..(395): n is a, c, t, g, unknown, or other
  misc_feature (454)..(454): n is a, c, t, g, unknown, or other
  misc_feature (675)..(675): n is a, c, t, g, unknown, or other
ggagctccccgcggtggcggccgctctagaactagtggatcccccgggctgcaggaattcgcacgagaccattacctagaacatcctaatcgaaaagggggtgttaaaccgcatcgcatcgtcttctagggtttcctcctcccgccgccacttgctgccccacgagcccattcccctcagcccttcaccatctccggcggtcgcagtggcatcagcagctccggctcacgcgcagcaaaggaacgacaatatggcgaccatcgtaaacacgacggaggaggagccgatgctggccgtggtccgcttcaccgctgagctcgcctgggccgacgcgggcccggaagtcgccgaccccgaggtcgcccgcctatgtctcgaggcgcaggacatatccntcgcggggcggtggctcgacatggcctcccttatgctcgcctccgccgacctcctcctncactccccgtcgcgcgtctcggacaaagacctgaagtgcgttctctccgtcatctgcagcctcgtcaccaaggccggatccgaggacccagcgctgcagatcaccgaactcatctgcgctaaagctcaccagcaacacggtgacaagccagcgctggcgctcaaagttcttttcagcttgtacatctggctccgagcccgtacggcaaggcatttgtttan

SEQ ID NO: 28932 - protein, 141 aa, Zea mays
  misc_feature: Ceres CLONE 1403353-F
  misc_feature (49)..(49): Xaa is any aa, unknown, or other
MATIVNTTEEEPMLAVVRFTAELAWADAGPEVADPEVARLCLEAQDISXAGRWLDMASLMLASADLLLHSPSRVSDKDLKCVLSVICSLVTKAGSEDPALQITELICAKAHQQHGDKPALALKVLFSLYIWLRARTARHLF

SEQ ID NO: 28933 - DNA, 718 bp, Zea mays
  misc_feature: Ceres CLONE 1403355-F
  misc_feature: Encodes the peptide sequence at SEQ ID NO. 28934
  misc_feature (24)..(24): n is a, c, t, g, unknown, or other
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
  misc_feature (34)..(34): n is a, c, t, g, unknown, or other
  misc_feature (54)..(54): n is a, c, t, g, unknown, or other
  misc_feature (718)..(718): n is a, c, t, g, unknown, or other
acagctggagctccccttggtggnggnngntcgnttcatgtcgatcccccgggntgcaggatcactacaacaccattacctagaacatcctaatcgaaaatcttcgtccccaccgttatgccgcaccacggcagccaccgcccgccggcgccgccgccggggggccccgtgttcccgcgcgcaacgtccacggtggtgcccgacccgtcccgcttcttcgcgccgccgctcctcgccgcgccgctccccaccaactccttcttccagaacttcgtgctcaagaacggggaccagccggagtacgtccacccgtactccgtccgctcccccggaggcgccgctctcgacatctgctacccttcgcgcaaccactcgccggggtggggcatccataccttcgtccccgacctcaccgtctccgacgccgccgggagcgcgcagcgccactgcgtctcggctttcgacgacctctccgtcacgctcgacgtctccccgtccctccgcgcgcacctcgtccgcggatgcccgtacgtcaccgtcaccaccacggccggcgccgtcgacatctccgtcgcgtccgtccatgccttcctcgacgtcgccttctgcgacgactccggcaccaagtggcgcctcgggatgaacagcgggcagatctttctcctctacacgtcggccccgatcccgctcgcgcagaccacaacacgcagttctccgn

SEQ ID NO: 28934 - protein, 200 aa, Zea mays
  misc_feature: Ceres CLONE 1403355-F
MPHHGSHRPPAPPPGGPVFPRATSTVVPDPSRFFAPPLLAAPLPTNSFFQNFVLKNGDQPEYVHPYSVRSPGGAALDICYPSRNHSPGWGIHTFVPDLTVSDAAGSAQRHCVSAFDDLSVTLDVSPSLRAHLVRGCPYVTVTTTAGAVDISVASVHAFLDVAFCDDSGTKWRLGMNSGQIFLLYTSAPIPLAQTTTRSSP

SEQ ID NO: 28935 - DNA, 643 bp, Zea mays
  misc_feature: Ceres CLONE 1403357-F
  misc_feature: Encodes the peptide sequence at SEQ ID NO. 28936
  misc_feature (332)..(332): n is a, c, t, g, unknown, or other
  misc_feature (443)..(443): n is a, c, t, g, unknown, or other
tccccgcggtggcggccgctctagaactagtggatcccccgggctgcaggaattcgcacgagaccattacctagaacatcctaatcgaaaagggtctccgtgtcgtctctgcgactccacttgctcttttcgctggccctggctacttgcggcaactcccatctccacgcgctctcccatccgagatctcaaccgcctcgccggcgagcgactgacgggcggacggtcccgccggctatggggaactgctgctccgatgaggtgagccacgccggtgctcatcccgtcggctccgccaccgccaaagccgcctccgcagcctccgccgcggncgatcgctttctccgctcccgtggtgccggcgcgtccacgcagatcgagttatctctctctgcatcaaatttgggtgatcaagaatattttcccaagagtatccccatggntggttgtgtattccaaaaaggagagatggtacactagaaagaattgggccgcagtgaagaaatttttaaatcatggaacccattttggacgaccaaaatcagtgtgcagtaccaggttggaggtcttcaggcattgggggtttcaggcctttgaaatccacccacaggtcccgggatgtcggggaaaagagggtaaagct

SEQ ID NO: 28936 - protein, 80 aa, Zea mays
  misc_feature: Ceres CLONE 1403357-F
  misc_feature (32)..(32): Xaa is any aa, unknown, or other
  misc_feature (69)..(69): Xaa is any aa, unknown, or other
MGNCCSDEVSHAGAHPVGSATAKAASAASAAXDRFLRSRGAGASTQIELSLSASNLGDQEYFPKSIPMXGCVFQKGEMVH

SEQ ID NO: 28937 - DNA, 750 bp, Zea mays
  misc_feature: Ceres CLONE 1403360-F
  misc_feature: Encodes the peptide sequence at SEQ ID NO. 28938
aaagctggagctccccgcggtggcggccgctctagaactagtggatcccccgggctgcaggaattcgcacgagaccattacctagaacatcctaatcgaaaaatcccacgctgccctcggcgctgcgcctggccccggcacctacctcccccctccccacctcgccgccggcgggtggagtcgggctggagcagccgctctcctctgttaccccctaaccccctataaagaaaaagaaaaaaacagagagagagcgagcgaccggcggctcggcagccatggggcacggcgtcagctgcgcccgcaccggtgacgagcacgactacttcggccgcggcggcatgggtcggggacctcgagggccctggaagcgctcctgcgacgctgacccctcccttgcccgccgcgccacgctctacgaccgcctctccgcgctccacatcgctcgccgcgatgggccggctccgaggtgctgtcaatggtcttggaaatcacggaggtggcgtccgcattgtggtgaaattgtcttgtacggacgtcttcaatatccgtcatgttcggactccgaagacgggagcacctggcctgggaccacgcgttctacttcggccatctgcgggtgactgcatggcaccctcttgggggggggggacccccccgaggggcaaaattcatcggggttcccgtcgtttgcggaaacgggaaaaaaggaccagggggccatgccttttcaccccggccgccgggtag

SEQ ID NO: 28938 - protein, 114 aa, Zea mays
  misc_feature: Ceres CLONE 1403360-F
MGHGVSCARTGDEHDYFGRGGMGRGPRGPWKRSCDADPSLARRATLYDRLSALHIARRDGPAPRCCQWSWKSRRWRPHCGEIVLYGRLQYPSCSDSEDGSTWPGTTRSTSAICG

SEQ ID NO: 28939 - DNA, 702 bp, Zea mays
  misc_feature: Ceres CLONE 1403362-F
  misc_feature: Encodes the peptide sequence at SEQ ID NO. 28940
cgcggtggcggccgctctagaactagtggatcccccgggctgcaggaattcgcacgagaccattacctagaacatcctaatcgaaaagaatcgttattatcagtgggctagaacatactaatgcgagtgctgtgctgctaaatctaatctgcgtgcgattggtcgatgggcaggttcggtggagatcgccgccgttggcgtttcgatcgccatatttaaccaagtctccaaggtctgcatctaccctctcgttagcgtcacaacgtcgttcgtcgcggaggaagacgcgatcatcagtaaggccgtccgaggaaacagcagccaggaggaggacgtggagaaagcctcccacgtgggctttgatccggagaccagcaatctgcatgcatctggccctgcaggtatggcagaatgcgtgaactcgtgtatccctacggagtgcgcagcagatccctctggcaggcaagggcggtgcgagaaacaggacgttgccgtccgctccgccggagctaaatagacggtatcctttctcgggctggtcttaggcccgaccttcccgggcccctctcgcacttgcttcagcggttactcccctacgttggcgctgacctgcctgagtcgtcatgtccccaagcgcgccgggtgcgtatacccgatacgattcgttgcccctcttctttctcgctgcgctggacccttgat

SEQ ID NO: 28940 - protein, 37 aa, Zea mays
  misc_feature: Ceres CLONE 1403362-F
MAECVNSCIPTECAADPSGRQGRCEKQDVAVRSAGAK

SEQ ID NO: 28941 - DNA, 670 bp, Zea mays
  misc_feature: Ceres CLONE 1403363-F
  misc_feature: Encodes the peptide sequence at SEQ ID NO. 28942
  misc_feature (193)..(193): n is a, c, t, g, unknown, or other
  misc_feature (404)..(404): n is a, c, t, g, unknown, or other
aagctggagctccccgcggtggcggccgctctagaactagtggatcccccgggctgcaggaattcgcacgagaccattacctagaacatcctaatcgaaaaaattcaatccggtctcagtggttggcccgccgctgccagtgccagatcgaatcggactctcggctcgtgtgcagcccaccggcgagacgccnaagctatatttttatgcccatctgatccgatgcgtggtgtggcgtcgtctccgcttttactagatcatcagtagccagctcaggagccgagcctggtcagggtagccaagcccatcccggtcctctcccggcgtcttctccctccgcaccgcggctcccgagatggcgggcgtcggctccgcgctgcgtcggctctacctctccgtctacnactgggtcgtcttcttcggatgggcgcaggtgctgtactacgcggtcctgacgctgcgttggagcgagcacagggcgtctacgccgccctcgagaggccgctgcagttcgcgcagacggccgccatcatggagaatcgtcatgggctcggaggggtggtgaggtctccggtctctggcactcttccacagattggatccaggttgttccttacgtggggggtctttgtggagttttcctgagaccagtcacactttcttgttacta

SEQ ID NO: 28942 - protein, 73 aa, Zea mays
  misc_feature: Ceres CLONE 1403363-F
MGAGAVLRGPDAALERAQGVYAALERPLQFAQTAAIMENRHGLGGVVRSPVSGTLPQIGSRLFLTWGVFVEFS

SEQ ID NO: 28943 - DNA, 680 bp, Zea mays
  misc_feature: Ceres CLONE 1403366-F
  misc_feature: Translation starting site: 199
  misc_feature: SWISSPROT Homolog: EC 1.3.3.6 Acyl-CoA oxidase
  misc_feature (394)..(394): n is a, c, t, g, unknown, or other
  misc_feature (483)..(483): n is a, c, t, g, unknown, or other
  misc_feature (515)..(515): n is a, c, t, g, unknown, or other
tggagctccccgcggtggcggccgctctagaactagtggatcccccgggctgcaggaattcgcacgagaccattacctagaacatcctaaaaaaaatctctcgtctctatcgccgcatcgcttctctgccggagctccaacaacctcgcctcgcgcagcactccgctgaccctccctgactccctccctgccgctgggatggccgggaaacgagttacgggccgcgatgggcaagacgagggcggcgccaaggtcgggctcccggcgatggacctctccctcgcgttcccgcaggccacacctgcctccattttcccgccgtccgcttcggattattaccagtctgatgatttgctgaccagtgaagagcgctctatcaggatgaaggtcaggngtattatggaaaaagaaatgctccatttatgtcagcgtactgggaaaaaggcagagtttccatttaatgccattcctaactgcaaaagnccttggtggttgctgtggaaccataaaggggntttatgggtgcccaggactttcattacaggccagtgcttgttactatgtcagaaattgcacgggtagaatgcaagctggtccacattttatactggtgcactcctctctttgcgatggtgacaaaggctctttgcggattccgagctcaaaagcagaagtacttg

SEQ ID NO: 28944 - DNA, 662 bp, Zea mays
  misc_feature: Ceres CLONE 1403367-F
  misc_feature: Translation starting site: 374
  misc_feature (587)..(587): n is a, c, t, g, unknown, or other
  misc_feature (588)..(588): n is a, c, t, g, unknown, or other
aaagctggagctccccgcggtggcggccgctctagaactagtggatcccccgggctgcaggaattcgcacgagaccattacctagaacatcctaatcgaaaaagtagccagagtgtgagctgacggcggacgtgctcgcctctcctctcctcacatttccggctcccctctccgcattccatggcaccgcattaccggtatttttagccgccggaggagacgggttgcgtagagagaggggaaaccagagctcctgactgttcctctctccctcctcacgggcgggctccgtctgttccgtccatccaccgccccggtcgtctcccggccagatccctctcctgcaaggtttctttgcgagtggccggagaagatgatgggcgggttcctctccagggtcctcctgctggcttttggctatgcctatcctgcctatgaatgctacaagaccgttgaactgaacaaccacagattgagcagctcatattttggtgtcagtattggattttagttgccctgttgacagttttggagagatttggagattttacaatatcatggctaccgttttactcagaagcaaaagnngtgctctttggatatttgcggtaccctaagacaagggaactacgtatggttatgggaactttcttaagccatat

SEQ ID NO: 28945 - DNA, 763 bp, Zea mays
  misc_feature: Ceres CLONE 1403369-F
  misc_feature: Encodes the peptide sequence at SEQ ID NO. 28946
  misc_feature (282)..(282): n is a, c, t, g, unknown, or other
  misc_feature (285)..(285): n is a, c, t, g, unknown, or other
  misc_feature (286)..(286): n is a, c, t, g, unknown, or other
tggagctccccgcggtggcggccgctctagaactagtggatcccccgggctgcaggaattcgcacgagaccattacctagaacatcaatcgaaaatcaaaattactatgtgtatcatggtggcacaaattttggtcgcactactggggggccattcattacaactagctacgactatgatgcaccaattgatgaatatggacttcggagatttccgaagtgggcacatctgagggaacttcacaaatctataagattgtgtgagcacaccctgctttatggnaanntacacgttctttctctgggtcctaaacaagaggctgatatttacagtgatcagtctggaggctgtgttgcattcctggcaaatatggattcagccaatgacaaagtgccactttccgaacaagcaaatgaacttcctgcttggcaagtagtattcttccgacgggaggagggggggtttcaccctggaaaggggcaatccaaacttcaggggggacctgggccccaaaatgttgaaaattaaaaccgggggggggactttttcgggaaaaaacggggttttgggaaaaaaaactttttcccagggggtttggggccaaataaaaaaaaaagggcccccccccactccctggggcacaaaggtgttgtggggggggggaggccctcccccagggggggcggggggtttttaaaacccccgcgggggcggggggcgcttttttttaaaagagggccccccgggggggggggggtggcct

SEQ ID NO: 28946 - protein, 52 aa, Zea mays
  misc_feature: Ceres CLONE 1403369-F
MDSANDKVPLSEQANELPAWQVVFFRREEGGFHPGKGQSKLQGGPGPQNVEN

SEQ ID NO: 28947 - DNA, 767 bp, Zea mays
  misc_feature: Ceres CLONE 1403370-F
  misc_feature (217)..(217): n is a, c, t, g, unknown, or other
  misc_feature (219)..(219): n is a, c, t, g, unknown, or other
  misc_feature (220)..(220): n is a, c, t, g, unknown, or other
  misc_feature (222)..(222): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (249)..(249): n is a, c, t, g, unknown, or other
  misc_feature (250)..(250): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (257)..(257): n is a, c, t, g, unknown, or other
  misc_feature (258)..(258): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (271)..(271): n is a, c, t, g, unknown, or other
  misc_feature (275)..(275): n is a, c, t, g, unknown, or other
  misc_feature (284)..(284): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (300)..(300): n is a, c, t, g, unknown, or other
  misc_feature (310)..(310): n is a, c, t, g, unknown, or other
  misc_feature (313)..(313): n is a, c, t, g, unknown, or other
  misc_feature (314)..(314): n is a, c, t, g, unknown, or other
  misc_feature (316)..(316): n is a, c, t, g, unknown, or other
  misc_feature (317)..(317): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (342)..(342): n is a, c, t, g, unknown, or other
  misc_feature (343)..(343): n is a, c, t, g, unknown, or other
  misc_feature (349)..(349): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (363)..(363): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (389)..(389): n is a, c, t, g, unknown, or other
  misc_feature (390)..(390): n is a, c, t, g, unknown, or other
  misc_feature (397)..(397): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (423)..(423): n is a, c, t, g, unknown, or other
  misc_feature (424)..(424): n is a, c, t, g, unknown, or other
  misc_feature (426)..(426): n is a, c, t, g, unknown, or other
  misc_feature (427)..(427): n is a, c, t, g, unknown, or other
  misc_feature (433)..(433): n is a, c, t, g, unknown, or other
  misc_feature (434)..(434): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (473)..(473): n is a, c, t, g, unknown, or other
  misc_feature (474)..(474): n is a, c, t, g, unknown, or other
  misc_feature (478)..(478): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (502)..(502): n is a, c, t, g, unknown, or other
  misc_feature (503)..(503): n is a, c, t, g, unknown, or other
  misc_feature (511)..(511): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (537)..(537): n is a, c, t, g, unknown, or other
  misc_feature (538)..(538): n is a, c, t, g, unknown, or other
  misc_feature (540)..(540): n is a, c, t, g, unknown, or other
  misc_feature (541)..(541): n is a, c, t, g, unknown, or other
  misc_feature (546)..(546): n is a, c, t, g, unknown, or other
  misc_feature (552)..(552): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (594)..(594): n is a, c, t, g, unknown, or other
  misc_feature (596)..(596): n is a, c, t, g, unknown, or other
  misc_feature (597)..(597): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (652)..(652): n is a, c, t, g, unknown, or other
  misc_feature (666)..(666): n is a, c, t, g, unknown, or other
  misc_feature (667)..(667): n is a, c, t, g, unknown, or other
  misc_feature (670)..(670): n is a, c, t, g, unknown, or other
  misc_feature (679)..(679): n is a, c, t, g, unknown, or other
  misc_feature (692)..(692): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (714)..(714): n is a, c, t, g, unknown, or other
  misc_feature (717)..(717): n is a, c, t, g, unknown, or other
  misc_feature (718)..(718): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (759)..(759): n is a, c, t, g, unknown, or other
  misc_feature (760)..(760): n is a, c, t, g, unknown, or other
tggagctccccgcggtggcggccgctctagaactagtggatcccccgggctgcaggaattcgcacgagaccattacctagaacatcctaatcgaaaaaacgacgcagctagcgcgcatctcccgatcagctgcactgcaccttcgtcgaacgtcgatcgtactcgtacaccatgaaggcagtcgtcgcggcgacgatgctcctggctgggtgctggngnncncnnnnnncnnnnnnnnnnnncnnnccnncnnnncnncnnnnnnnnnccncccnccccccccncnnnccnnnccnnncncccccccccnccnncnnccccccnnnnnnnccccccnnnncnncccccnccnnncnnnccccnccnnnnnnnnnnnncccccccccccnnccccccnccccccccccnnnnnnnnnnnnnccnncnncccccnncccnnnnnnncccccccccccccnnnnnnccnnnnnccnncccnccnnnnnncccccccccccccccnncccccccnccnnnnnnnnnnnncnnnnncccccnncnnccccncccccncccnnnnccccccccccccccccccccccnnncccccccccncnncccccccccnnnccccccccccnnnnnnnccccccccccccccccnnnccccccncccccccccccccnnccnccccccccnccccccccccccnccnnnccccccccccccccccnccnnccnnnnnnnnnnnnnnnccccnnnnnncccccnnncccccnnccccccc

SEQ ID NO: 28948 - DNA, 734 bp, Zea mays
  misc_feature: Ceres CLONE 1403371-F
  misc_feature: Encodes the peptide sequence at SEQ ID NO. 28949
  misc_feature (486)..(486): n is a, c, t, g, unknown, or other
  misc_feature (615)..(615): n is a, c, t, g, unknown, or other
  misc_feature (616)..(616): n is a, c, t, g, unknown, or other
  misc_feature (626)..(626): n is a, c, t, g, unknown, or other
  misc_feature (629)..(629): n is a, c, t, g, unknown, or other
  misc_feature (630)..(630): n is a, c, t, g, unknown, or other
  misc_feature (644)..(644): n is a, c, t, g, unknown, or other
  misc_feature (647)..(647): n is a, c, t, g, unknown, or other
  misc_feature (648)..(648): n is a, c, t, g, unknown, or other
  misc_feature (671)..(671): n is a, c, t, g, unknown, or other
  misc_feature (684)..(684): n is a, c, t, g, unknown, or other
aagctggagctccccgcggtggcggccgctctagaactagtggatcccccgggctgcaggaattcgcacgagaccattacctagaacatcctaatcaaaaaaagcaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatcgagatggtgccgcgctccgtgctccccanggttctacgcgggcgacgtgcacccggagaggcttggagggtgttcagctccttcggcaggcgctacgtcgtcacggcagcccccagggtcatggtcgagccctttcgcaggccttcctcgggcccgannaaggtcgcgnacnncaaaattggaaggnccnnaagggaacggcaaggccacgggnctcatgcccaggncaaggggtggctcgtcggaaacaaaaaaaaaaagagccgtcctcagggga

SEQ ID NO: 28949 - protein, 185 aa, Zea mays
  misc_feature: Ceres CLONE 1403371-F
  misc_feature: SWISSPROT Homolog: EC 2.3.1.15 Glycerol-3-phosphate O-acyltransferase
  misc_feature (103)..(103): Xaa is any aa, unknown, or other
  misc_feature (146)..(146): Xaa is any aa, unknown, or other
  misc_feature (150)..(150): Xaa is any aa, unknown, or other
  misc_feature (151)..(151): Xaa is any aa, unknown, or other
  misc_feature (156)..(156): Xaa is any aa, unknown, or other
  misc_feature (157)..(157): Xaa is any aa, unknown, or other
  misc_feature (165)..(165): Xaa is any aa, unknown, or other
  misc_feature (169)..(169): Xaa is any aa, unknown, or other
MVASPRFKPIEECCSEGRSEQTVAADLDGTLLISRSAFPYYLLVALEAGSVLRAALLLLSVPFVYVTYAFFSESLAISTLVYISVAGLKVRSIEMVPRSVLPXVLRGRRAPGEAWRVFSSFGRRYVVTAAPRVMVEPFRRPSSGPXKVAXXKIGRXXRERQGHGXHAQXKGWLVGNKKKKSRPQG

SEQ ID NO: 28950 - DNA, 651 bp, Zea mays
  misc_feature: Ceres CLONE 1403373-F
  misc_feature: Encodes the peptide sequence at SEQ ID NO. 28951
  misc_feature (509)..(509): n is a, c, t, g, unknown, or other
  misc_feature (575)..(575): n is a, c, t, g, unknown, or other
tccccgcggtggcggccgctctagaactagtggatcccccgggctgcaggaattcgcacgagaccattacctagaacatcctaatcgaaaaagctaggttcctatgcccaaagtcacacagcttcttctccttctacttctccttcctcctctcctcaccggcaccttgatctaatctcttccatcctagcttgctcgccgctgccagtctctcctccgcctgcaacgactcccatgtctcagtcttctcctctcttctccgtcgcccgagcgcacgccggagcaggagggcgagccgtggcagccgctctcctgctccgtcgtcgccccattgcacagctgccgcacagcatccatggcctacggtgtctctctccagccagagcgacaccttccaagacgctcctcagcctcccccgcgccacgctgtcctccttcgccgaccccgacggcgacggcggctccagcgcgaaagccagcgacggcggcgccaaggccggcgccggcgnggaggagcaggtcgggaaatgcgagatgtcggagatggcccaggcgttccacatctcgccacgggntggcgacgtccatctcccgtgacgatcgcgttcgccgccctcaccgtgccgctggcgatgcgctcgctggtctgca

SEQ ID NO: 28951 - protein, 120 aa, Zea mays
  misc_feature: Ceres CLONE 1403373-F
  misc_feature (92)..(92): Xaa is any aa, unknown, or other
  misc_feature (114)..(114): Xaa is any aa, unknown, or other
MSQSSPLFSVARAHAGAGGRAVAAALLLRRRPIAQLPHSIHGLRCLSPARATPSKTLLSLPRATLSSFADPDGDGGSSAKASDGGAKAGAGXEEQVGKCEMSEMAQAFHISPRXGDVHLP

SEQ ID NO: 28952 - DNA, 653 bp, Zea mays
  misc_feature: Ceres CLONE 1403375-F
tcaccgcggtggcggccgctctagaactagtggatcccccgggctgcaggaattcgcacgagaccattacctagaacatcctaatcgaaaaaatcgactaatgatcgccagacctactcggcgatggttggaatttgtcgagtggtcattgtccttgcgagagccgacgagcgcctgcacccagcttcacgcctctatggaagcgtcattgtcgctctcgtcactgatcggcatcatcactccgtccgccgacctgtgcaccattacgcgtcgcaatgaccgcaacaagtacaaaccggagatacatgggactgaggttgacatccagtcgcgaccggttgaacagtcctcgaaaacctgttcgaagggtcgtctatcaggaaagctctacatccactacatccgcaagctcgcagaggagtacacctcctcgtatgactactacctgtgcggcagcgaccacttctgatcatgaaaaggggccatctcgttcacgaaacgctgcagcatacaggccgcgaggtccatggtcgggccacgaaaagaaaaaaatgcgaaaaatcttttacgcaaggccagtctccccgagaactcctgcggggacacgaacaccgagggtccttccagatgccccagaaacctggcggtacgcg

SEQ ID NO: 28953 - DNA, 709 bp, Zea mays
  misc_feature: Ceres CLONE 1403378-F
  misc_feature (327)..(327): n is a, c, t, g, unknown, or other
  misc_feature (328)..(328): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (363)..(363): n is a, c, t, g, unknown, or other
  misc_feature (366)..(366): n is a, c, t, g, unknown, or other
  misc_feature (380)..(380): n is a, c, t, g, unknown, or other
  misc_feature (387)..(387): n is a, c, t, g, unknown, or other
  misc_feature (407)..(407): n is a, c, t, g, unknown, or other
  misc_feature (466)..(466): n is a, c, t, g, unknown, or other
  misc_feature (467)..(467): n is a, c, t, g, unknown, or other
  misc_feature (470)..(470): n is a, c, t, g, unknown, or other
  misc_feature (487)..(487): n is a, c, t, g, unknown, or other
  misc_feature (488)..(488): n is a, c, t, g, unknown, or other
  misc_feature (575)..(575): n is a, c, t, g, unknown, or other
aaagctggagctccccgcggtggcggccgctctagaactagtggatcccccgggctgcaggaattcgcacgagaccattacctagaacatcctaatcgaaaaagcctccgccatttcttcatctccaatctccatccttccatcttccgctccctcccctgcttgcgctcgtcgcgcaggcgacctcggcggcgctcgggctcggcctctcagcgacggcgtcagcggcttcccctcctgcctctcgccagtcccctcggctctgttcctctgcgcaccggccggtgaccctgcgtgcgtgcctctttctctctctctctctctctnnctctctctctcnnnnnnnnnnnnnnnnnnnnnncnccnccccccttctgttnatcctcncccccccccccccccccccntcttcccccccgcccctccctctttcctcccttccccccccctccccttcccccccccnnccnctcccccccccttcctnncccttttcttttttccccccccttccttcctttttccccccccctttccccccctccctttttccccccttcttttccccccccccnctttcctccccctctcccccccccccttcctccccctcccccccccccctccctcttccccccctctctccccctccccccccccccccccccccccccctctcccccctttcctccttctcctttctctcccc

SEQ ID NO: 28954 - DNA, 678 bp, Zea mays
  misc_feature: Ceres CLONE 1403385-F
  misc_feature: Encodes the peptide sequence at SEQ ID NO. 28955
  misc_feature (269)..(269): n is a, c, t, g, unknown, or other
aaagctggagctccccgcggtggcggccgctctagaactagtggatcccccgggctgcaggaattcgcacgagaccattacctagaacatcctaatcgaaaagcccacactccaccacccgcgccccgccgcccgccccgccgcctcctcctacttcgcctcggccgcctcggatccggaccgagcgccggccatggcactcgccttcgacgagttcgggcgccccttcatcatcctgcgggagcaggagaagaagacgcgcctgcggnggctcgacgcgcagaaggccaacatcggcgcgggcaaggccgtcgcgcggatcctccgcacctcgctcggccccaagggcgcggacaagatgctccagtcccccggacggcgacgtcatcatcacaaatgatggggcgaccatcctggaggaagatggatggtgacaaccagatcgcaaagctggaggggggaggttgccccgaagtcaagactacgaaaatgcgggaggggaccaccggggggggtagccagtgggcgggccgcctccttgagacaccccgacacccttttagaaacgggggagatcccccccctataggggaggggggaagggttatcgacctaccccttcaggggcaccccttgcctccactcaaacactattctcctctccaggctccgactccc

SEQ ID NO: 28955 - protein, 68 aa, Zea mays
  misc_feature: Ceres CLONE 1403385-F
  misc_feature (26)..(26): Xaa is any aa, unknown, or other
MALAFDEFGRPFIILREQEKKTRLRXLDAQKANIGAGKAVARILRTSLGPKGADKMLQSPGRRRHHHK

SEQ ID NO: 28956 - DNA, 733 bp, Zea mays
  misc_feature: Ceres CLONE 1403387-F
  misc_feature: Encodes the peptide sequence at SEQ ID NO. 28957
  misc_feature (502)..(502): n is a, c, t, g, unknown, or other
  misc_feature (516)..(516): n is a, c, t, g, unknown, or other
  misc_feature (635)..(635): n is a, c, t, g, unknown, or other
catagctggagctccccgcggtggcggccgctctagaactagtggatcccccgggctgcaggaattcgcacgagaccattacctagaacactcccccgatctccgccactccaaaatgtggcgccgccaccacctcctccggctacttccacctccggccaccgccgccaccgccgcggccccttctcatttcctgcgccacctctctacctcaagcaccccgaccccggccgcctccctggcctcgtccctcgcgtcggcgctcaccgcgctctccacgaccccgccccccgccaccaccccggacgcttacttctccctccacttctccgacgtgcggcctaccaacgcgctcctcgctgaggcgctcgcgctctccccgcccgccacctcccgcgccgctgccgatctcttccgcttcctcgtccgccgccgctcgctccacccctccgacggcgcgctcgcgcccatcgttcgccacctcgcccgccgccgcgacttnccccgccgtgcgcngcgctcatccaggagtttccaaccgctctcgggcccgccacgctcgacgcctatctccagcagctcaccagagccgggcgccaaacgacgcttggtcagggtggtcgacgatttgccgnagcagctccgtaaacgcgagctcctcactttgctgggcctctcgcttttcctccggaggatttccctcgcacgcagaggagccttgccagaagttccc

SEQ ID NO: 28957 - protein, 206 aa, Zea mays
  misc_feature: Ceres CLONE 1403387-F
  misc_feature (129)..(129): Xaa is any aa, unknown, or other
  misc_feature (134)..(134): Xaa is any aa, unknown, or other
  misc_feature (174)..(174): Xaa is any aa, unknown, or other
MWRRHHLLRLLPPPATAATAAAPSHFLRHLSTSSTPTPAASLASSLASALTALSTTPPPATTPDAYFSLHFSDVRPTNALLAEALALSPPATSRAAADLFRFLVRRRSLHPSDGALAPIVRHLARRRDXPRRAXRSSRSFQPLSGPPRSTPISSSSPEPGAKRRLVRVVDDLPXQLRKRELLTLLGLSLFLRRISLARRGALPEVP

SEQ ID NO: 28958 - DNA, 741 bp, Zea mays
  misc_feature: Ceres CLONE 1403388-F
  misc_feature: Translation starting site: 248
  misc_feature (725)..(725): n is a, c, t, g, unknown, or other
caaagctggagctccccgcggtggcggccgctcttaaactagtggatcccccgggctgcaggaattcgcacgagaccattacctaaaacatcctaatcgaaaaatcgatctgtacgccctccccaccggtgggtcgcgcacctccaccaacctaccttcccgccccgcccgtcgccgtcgatgactcgccgtccgtttccgccctccaaaaccctactacctcttaccttccagccccgcgtcctccatggccaccaacggcagctctccgagggttcgggacacggagagcagtctggagaaggtgaagcggcagctgtcatcggggtctgggaggtacctgctgcaagggcccctgctcaagcgatctgagacgttacggaaatggaatggagcgttgggtcatattggacccgacatcaggaaagatggaatacaaactccggagaaatgaaactgccattaaggggaccattctgtttgacgcctcgagcaccattactttatctcctgtgaaactttcaagggatgccaaaatataatggctgctgcttctacatcggactcctcaaaagaagattacctttctttgtgtgaaaactcctggtgctgcgaaaagcttgggtatctacttacattggcaactcagttagtcttacgagctcattaagaagcagtaaattctttgggctggagatggctctcagctacataaagccagttgntctactgcagttgcta

SEQ ID NO: 28959 - DNA, 673 bp, Zea mays
  misc_feature: Ceres CLONE 1403391-F
  misc_feature: Encodes the peptide sequence at SEQ ID NO. 28960
  misc_feature (408)..(408): n is a, c, t, g, unknown, or other
tggagctccccgcggtggcggccgctctagaactagtggatcccccgggctgcaggaattcgcacgagaccattacctagaacatcctaatcgaaaaataaagattactcatagattaaagtagggtttggacgtctgcctgtccatttcggcgtctgttcttagcggccgacaagcggaatctggatcaagtcccctgcttcaacccatcccctctcatcgattcattgccacaaggcagctgattgctcacagcgttggatgtgagaattggattcggacccaccgatcgatatgccgttcggccacacgcggctcgatgtccggcgtccgccgcagtcgtcctacctctgctgctccacaaccaccgtcgccgtattcgtcgcgctctgcctggtggctgtgtgnatgccgtcgtccatgctcgtcacccctgccgagttccctccatttcagtccaaagtgcgtccactgagggctcatgactctcctcctgccaccgcaagcttacccagcgctgacaagcgcgatgacattccccacccatgagaacccaccccctggtaatctacattcgcctcctgccaaaaacaccagcaatgggcgaaaatcaccaccccaccacccttccaacacagagccccgccccctgtccaccaaatagccctaccag

SEQ ID NO: 28960 - protein, 84 aa, Zea mays
  misc_feature: Ceres CLONE 1403391-F
  misc_feature (38)..(38): Xaa is any aa, unknown, or other
MPFGHTRLDVRRPPQSSYLCCSTTTVAVFVALCLVAVXMPSSMLVTPAEFPPFQSKVRPLRAHDSPPATASLPSADKRDDIPHP

SEQ ID NO: 28961 - DNA, 724 bp, Zea mays
  misc_feature: Ceres CLONE 1403392-F
  misc_feature: Encodes the peptide sequence at SEQ ID NO. 28962
tggagctccccgcggtggcggccgctctagaactagtggatcccccgggctgcaggaattcgcacgagaccattacctagaacatcctaatcgaaaaaacgatggacgccagcccatgggccaacgatcctccgtggaccgacttcctaaccgcacgaacctccgagacggagcgtggcgcccgcctcggcgcctccgccctccgtcggcggcgcacggggagcatagaaggtgtcgtactcgtacctctcgcacacgcccccatcgccacgcgtgcaacgaagctggctccgtcgccatggccctgctgccgttgcccccctgctccccgtgccaccgccgggccgcgcccttgccggcgcccacggccgcctcggcgcgccaccgcagggggagcctgcgcctcgctgcagccggtgcctgctccggacctaccgccgcgcggaagccccgtcccaccgccgccgacaggaggaggtgcgaatgctttgacctccatcggcggttagttccttacgcggaggcttactgctggcagaagtccattgtcgagagggaggaaagttgatagacagcggcgaagacactccgacaccttgattgctttgcacatccaccggtctacacattgggcaccgaccacaagagggatacctccatttcaacagggaagatgctctttcgagttcatcgtattatcgcggcgttgaatgacgtacatgcc

SEQ ID NO: 28962 - protein, 89 aa, Zea mays
  misc_feature: Ceres CLONE 1403392-F
MALLPLPPCSPCHRRAAPLPAPTAASARHRRGSLRLAAAGACSGPTAARKPRPTAADRRRCECFDLHRRLVPYAEAYCWQKSIVEREES

SEQ ID NO: 28963 - DNA, 767 bp, Zea mays
  misc_feature: Ceres CLONE 1403393-F
  misc_feature: Encodes the peptide sequence at SEQ ID NO. 28964
  misc_feature (356)..(356): n is a, c, t, g, unknown, or other
  misc_feature (395)..(395): n is a, c, t, g, unknown, or other
  misc_feature (400)..(400): n is a, c, t, g, unknown, or other
  misc_feature (401)..(401): n is a, c, t, g, unknown, or other
  misc_feature (543)..(543): n is a, c, t, g, unknown, or other
  misc_feature (582)..(582): n is a, c, t, g, unknown, or other
aagctggagctccccgcggtggcggccgctctagaactagtggatcccccgggctgcaggaattcgcacgagaccattacctagaacatcctaatcgaaaaaggtcgccgtcgcgactcgcgccgcctctcggctcgctagccgctacgctatctacgccgccccggcacctcccatgagatgagagccgcagccgcagccacatccacagccgccgcgctcctcgcccccggtctaaagctctgcgcgggcggcgcccgcgcgcgcgtctcctgtccctcccgctcccgcctcccactccaccgcatcgccgccatggcctccgcccccaacccctccttcccgccggaggaggnacgctcccctcccgccctcgagctcccgacccccgcgcntctcnnagtcagggtggcgctgtgccagctctcggtgacgggcggacagaatcgcaacatcgcgcacgcgcgcgcggccatcggagaaggcggcctcccgaggcgctaagctcgtccttctccagagaaatgggaatgggcccggatncaatggaggctttccagaagtaccgcgagaaaattgaanctgggcggaaatgcggccccttcattttcaaggattgcccggaggttggtcccaaattaaaagccctccttgggggggggggcccaataggtgggagggtgcggaaaaaacttaacaaaaacggggcgcacttttggggggcaagggggaactttgggagaaacaaaaagagaactctttttttt

SEQ ID NO: 28964 - protein, 107 aa, Zea mays
  misc_feature: Ceres CLONE 1403393-F
  misc_feature (59)..(59): Xaa is any aa, unknown, or other
  misc_feature (72)..(72): Xaa is any aa, unknown, or other
  misc_feature (74)..(74): Xaa is any aa, unknown, or other
MRAAAAATSTAAALLAPGLKLCAGGARARVSCPSRSRLPLHRIAAMASAPNPSFPPEEXRSPPALELPTPAXLXVRVALCQLSVTGGQNRNIAHARAAIGEGGLPRR

SEQ ID NO: 28965 - DNA, 672 bp, Zea mays
  misc_feature: Ceres CLONE 1403400-F
  misc_feature (201)..(201): n is a, c, t, g, unknown, or other
  misc_feature (213)..(213): n is a, c, t, g, unknown, or other
  misc_feature (243)..(243): n is a, c, t, g, unknown, or other
  misc_feature (284)..(284): n is a, c, t, g, unknown, or other
  misc_feature (308)..(308): n is a, c, t, g, unknown, or other
  misc_feature (387)..(387): n is a, c, t, g, unknown, or other
ctggagctccccgcggtggcggccgctctagaactagtggatcccccgggctgcaggaattcgcacgagaccattacctagaacatcctaatcgaaaagcgaccgcgactcggatcggatctctctcctgtgtagagccatgctgtgctgtgctggtagtagcagcagcagtagcaatgagtagtccagtccacagctccnagaacacgtggncgtcctttcctttgctctccctatcggtanccggtaacgcagggggagggcgcccacggctttaccatggnctgtcgcttttgcctcgtctgggncggtggtccctctgctctatcccatccccttgagcaggctgttgagcaagctgaactcatagaaactcgatttctccgnccgggggtttttttttcctcaggttcggaggtatttctccccctttctttctcccttcctcccaggaaatcttcctggtccggggttttgacaaaagggcgtggtccaaaaagggggggggcccctcaattggggggaaaaaaaggcaggttttttggaaaaaaaagaaaggtaaagggggggtggccccccccccccacgaggaatcccaattttctgaaggccctagagtccccaaaaaaaatttgctgaaaaactttgggggtgagacaataaaagtgtatg

SEQ ID NO: 28966 - DNA, 634 bp, Zea mays
  misc_feature: Ceres CLONE 1403404-F
  misc_feature: Encodes the peptide sequence at SEQ ID NO. 28967
  misc_feature (377)..(377): n is a, c, t, g, unknown, or other
  misc_feature (391)..(391): n is a, c, t, g, unknown, or other
  misc_feature (434)..(434): n is a, c, t, g, unknown, or other
  misc_feature (440)..(440): n is a, c, t, g, unknown, or other
  misc_feature (461)..(461): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (477)..(477): n is a, c, t, g, unknown, or other
  misc_feature (483)..(483): n is a, c, t, g, unknown, or other
  misc_feature (484)..(484): n is a, c, t, g, unknown, or other
  misc_feature (523)..(523): n is a, c, t, g, unknown, or other
  misc_feature (547)..(547): n is a, c, t, g, unknown, or other
  misc_feature (567)..(567): n is a, c, t, g, unknown, or other
ggagctccccgcggtggcggccgctctagaactagtggatcccccgggctgcaggaattcgcacgagaccattacctagaacatcctaatctaaaactcttcgtcgtcctatcttataatcgcatttcgaaatccccaaacggaggcctcgccactcttccgaacctgaacaatcaccaccgttattaagaagatgatgcgctgcgctgcaacgggcggcgggtgcgtcgcttcgtggagcggcgattggagattgccggcggtcaacccctgcagcgtgcggatgccgacgggcaacgatgggtggtgcgccggcctgaggtcgcgggcggcggatctcgccggcctcgagatggccaacctgcgcggcggcgtcnggggggctcttccngcgcgagccccggcgctacggggggcttgggaaagcccccggncggggnggaatttttcccccccccccncnnnnnannnnnnnanaaaaannaaaaagaaagaaacaaaaaagaaaaaaaagaagaatcancctgccctcctcccccggcccccnccctccccccgcccctgctnctccccccgcaattgcggcgcgcgcgggggcggcggagcggcggagggagacggggagagaaaggcg

SEQ ID NO: 28967 - protein, 147 aa, Zea mays
  misc_feature: Ceres CLONE 1403404-F
  misc_feature (62)..(62): Xaa is any aa, unknown, or other
  misc_feature (81)..(81): Xaa is any aa, unknown, or other
  misc_feature (83)..(83): Xaa is any aa, unknown, or other
  misc_feature (90)..(90): Xaa is any aa, unknown, or other
  misc_feature (91)..(91): Xaa is any aa, unknown, or other
  misc_feature (92)..(92): Xaa is any aa, unknown, or other
  misc_feature (93)..(93): Xaa is any aa, unknown, or other
  misc_feature (94)..(94): Xaa is any aa, unknown, or other
  misc_feature (95)..(95): Xaa is any aa, unknown, or other
  misc_feature (97)..(97): Xaa is any aa, unknown, or other
  misc_feature (110)..(110): Xaa is any aa, unknown, or other
  misc_feature (125)..(125): Xaa is any aa, unknown, or other
MMRCAATGGGCVASWSGDWRLPAVNPCSVRMPTGNDGWCAGLRSRAADLAGLEMANLRGGVXGALPARAPALRGAWESPRXGXNFSPPPXXXXXXKXKKKETKKKKKKNXPALLPRPPPSPRPCXSPRNCGARGGGGAAEGDGERKA

SEQ ID NO: 28968 - DNA, 752 bp, Zea mays
  misc_feature: Ceres CLONE 1403407-F
  misc_feature: Encodes the peptide sequence at SEQ ID NO. 28969
  misc_feature (230)..(230): n is a, c, t, g, unknown, or other
aaagctggagctccccgcggtggcggccgctctagaatagtggatcccccgggctgcaggaattcgcacgagaccattacctagaacatcctaatcaaaaactttaaatgggacgcgcacctccgcctgggtctgtctgcgcagggacgcggacgcggcggcaccggctagcaattgtctcatctgctccactccatctccatttaacgcactctccactccttcgcggnggtggtttaggcgcacggcgacaggccaattaacgccactgcgactagcgccggatgggaaatgggcggcgaacgcacgaggtcgctggaccagatcgcgacgtgtgccgtggccgtcgtctgcgctgtcatcgtcgcggcgtccatactcctcgaggggcttcctccaccacctcggtcagttgctcaacaagaaccgaagaagcgctggtttgacgttctgaaaaaggtaaatcggagctgatgatcttggggttcattcccttgctgttgaccgtgacgaaaagtacatccgcgggattttgtttccggaggggacccgaaaaaccttggtgccctgcccccgtgcggaactctggggggaaaaaacccagggccttgtgccggggccccttttgaaaaacccaccccttttttttcggcaaaaagggagggggttttttttttccccaggagggaaaaacggcaattttttggggtttcttccgcccctcgggggggacccattttttttaagagggt

SEQ ID NO: 28969 - protein, 60 aa, Zea mays
  misc_feature: Ceres CLONE 1403407-F
MGGERTRSLDQIATCAVAVVCAVIVAASILLEGLPPPPRSVAQQEPKKRWFDVLKKVNRS

SEQ ID NO: 28970 - DNA, 676 bp, Zea mays
  misc_feature: Ceres CLONE 1403408-F
  misc_feature: Encodes the peptide sequence at SEQ ID NO. 28971
tccccgcggtggcggccgctctagaactagtggatcccccgggctgcaggaattcgcacgagaccattacctagaacatcctaatcgaaaaaaaatccattggagtattcgacgtctcgtaacccctgcctcccacgcaccccaatgtctgacaagaaggacgacgaggccggcacctcaacgccgagtgttgcggcggcggcggccccggccccggccccgaggccatccacctacgcgcccatgggcgcgctgcgggacgaggagtgcgctaatctcctggccctggtatccaccgtctcgcgcccgctcgaggacgccgtcgcggatttcctcgcacgcgtgccccccgatcgccgcctccggttcggcacctccatcagcttcggtcctcgaggacaagatgatgcttcaacctgctgaagcgtttagttgcatttgcaattctacatcaaggttattcctcacagttggcaaatccatttcttcctcttttataaaatgctgcatgtgatgaaacttctgaggaagcagaacaagattctcaacttttctgttaggtcgactaatgggaccaaactttgaggtcctaaagcagcttggtgtcgtttacttggaacggatctgattttgcttcctcggtcttttttccaaaaaaaaccttggaaaaaaaggg

SEQ ID NO: 28971 - protein, 92 aa, Zea mays
  misc_feature: Ceres CLONE 1403408-F
MSDKKDDEAGTSTPSVAAAAAPAPAPRPSTYAPMGALRDEECANLLALVSTVSRPLEDAVADFLARVPPDRRLRFGTSISFGPRGQDDASTC

SEQ ID NO: 28972 - DNA, 691 bp, Zea mays
  misc_feature: Ceres CLONE 1403410-F
  misc_feature: Encodes the peptide sequence at SEQ ID NO. 28973
  misc_feature (482)..(482): n is a, c, t, g, unknown, or other
  misc_feature (547)..(547): n is a, c, t, g, unknown, or other
  misc_feature (548)..(548): n is a, c, t, g, unknown, or other
  misc_feature (598)..(598): n is a, c, t, g, unknown, or other
  misc_feature (606)..(606): n is a, c, t, g, unknown, or other
  misc_feature (607)..(607): n is a, c, t, g, unknown, or other
  misc_feature (617)..(617): n is a, c, t, g, unknown, or other
  misc_feature (618)..(618): n is a, c, t, g, unknown, or other
  misc_feature (637)..(637): n is a, c, t, g, unknown, or other
  misc_feature (658)..(658): n is a, c, t, g, unknown, or other
tggagctccccgcggtggcggccgctctagaactagtggatcccccgggctgcaggaattcgcacgagaccattacctagaacatcctaatcgaaaaaacacaacaatctctctcccctcactccctctctgcagcgcgcagctttcaaagcgttgggagagatggcagaggagacgcaaccagaggccgcagccgccgccgcgcccgccgcggccgaggtagtcgtgaccgaagctgcgccggcggaggcggaggtgcctgcggcggcggaagctgaagccgaggccaaggatgagaagaaaggtgacgaggcggagctcaccgccgatgacgcgggggtggggaccggctcgttcaaggaggaaagcaacctggtggaagacctgcccgacccggagaagaaggcgctcgacgagttcaagcagctgatcgctgctgccctcgcccgccggtgagttcaacctgcctcccccgccgccgnccgccgaaggccagggaaacaaagggtggaggaagcaaggcccaggtggctgggaatgcccgggnntgaggaggccaaagacggaggtgccgcgggcccgagaggcccaagctganacactggnntggagaagcnnagccttcgagccgagccgnaagaaaaaaactgggcgtggncccctgaaggaggagactgcccaccaaggaggg

SEQ ID NO: 28973 - protein, 97 aa, Zea mays
  misc_feature: Ceres CLONE 1403410-F
MAEETQPEAAAAAAPAAAEVVVTEAAPAEAEVPAAAEAEAEAKDEKKGDEAELTADDAGVGTGSFKEESNLVEDLPDPEKKALDEFKQLIAAALARR

SEQ ID NO: 28974 - DNA, 651 bp, Zea mays
  misc_feature: Ceres CLONE 1403411-F
  misc_feature: Translation starting site: 182
  misc_feature (635)..(635): n is a, c, t, g, unknown, or other
tccccgcggtggcggccgctctagaactagtggatcccccgggctgcaggaattcgcacgagaccattacctagaacatcctaatcgaaaaatcatcagtcatcacataccgccaagaccacatcggcacatcgacgtgagctcgtgcgtgagtgccctggtcgacgaccgctcgcgcgccatggactcaacgacgacggcgccgctgctgcagccgtccgccgcctcgagcaaggaggggccggggccggcgccggctcagcacggtgagggcagccgggagctggaggcgatcctggccgacgcgtccaagccgtgggcttggcggggcctgggaaggcgcccgcctggagctgccgctgcttgctgcgggtggcgctgcccggcggtggccgtctacatgatcaacttcgtcatgtccatgtccacgcagatcttctgcggccagctcggcaacctcgagctcgccgcctcctcgctcgggaacaccggcatccagcccttgggctacggcctcatgctgggatgggggcagcgccggtggagacgctgtgcaggcaggcgtacggcgcgcacaacaccgcagggctgggggtgtacctgcagccgctcgacggtgctgctcatggccacgnccgtgcggctgaccgt

SEQ ID NO: 28975 - DNA, 607 bp, Zea mays
  misc_feature: Ceres CLONE 1403414-F
  misc_feature (257)..(257): n is a, c, t, g, unknown, or other
  misc_feature (258)..(258): n is a, c, t, g, unknown, or other
  misc_feature (309)..(309): n is a, c, t, g, unknown, or other
  misc_feature (310)..(310): n is a, c, t, g, unknown, or other
aaagctggagctccccgcggtggcggccgctctagaactagtggatcccccgggctgcaggaattcgcacgagaccattcctagaacatcctaatcgaaaaccacctccaaagtccaaaagcgaagcctacgcccgccccaacggtgaaaacgtcggaaccctagatccctctcacggtcgcgcctgtgctccaaaaccttagatccgacatgcatcagcccagagcccgctacccacccgggtatggctccagcgnnggaggcggtgggcggggaggcggtagtggagtaagaagaggaggcagcggnncgcgaggaaccacaactactacggccggacacacatccacagcatcaacaccactaccagcagcagcagcagcactcgcataggaactcttcccaccagcagcagtggcttgcgggaagaccagggccccgcccttgcgggggccaggggtttggaaaacgttgggcctaagaacgggccccccactttggacgctgtttggactcgagttccccaaaatttgggaaggggtcaattaaatattaccagttctcaaaacccccgttacgggaaaaaaggggtgtgcccgtggcacaa

SEQ ID NO: 28976 - DNA, 751 bp, Zea mays
  misc_feature: Ceres CLONE 1403417-F
  misc_feature: Encodes the peptide sequence at SEQ ID NO. 28977
  misc_feature (449)..(449): n is a, c, t, g, unknown, or other
tggagctccccgcggtggcggccgctctagaactagtggatcccccgggctgcaggaattcgcacgagaccattacctagaacatcctaatcgaaaaacccctgttcctctgcgatttgggctcgtcctgtgtccttcctgttgctcaaaagctcgctcattcgatgtccctgtctgaaaggcgactaatcccactggaattcggagcacagagctttgaatccagggtccaaaactttttgctcatctcccttgcggaaaagcgcctcctctgcgtctgagagtcgcatcttttttcacagattcgatttgaatgtcccgagcagctcgaggaccgcgatgtcggtaagacttgctttgaagatcttgatcaccacaagagatttgctgaatttccgtcactgtactttttacactggacatgtcctttcgcagcatagtccgtgatngtagggaaagctttggtagcttatcaagacggagccttggagtacagatttctgggtttgcctggactgtctaaatctgttggatctgtgagtgacctgcgcgaaagatctgtagtatttgatcaaagcaggggggctggtcttcctcctgaattgcttccagatggaatgaaaacgcttgagggaagtaaaaagcattgggccttccccgaaaaattgttggtgcctgggcaaccgtctgtggaacttggaaagacaatggcaagatttaatgctgaccccggagttctgcggaaattccc

SEQ ID NO: 28977 - protein, 33 aa, Zea mays
  misc_feature: Ceres CLONE 1403417-F
  misc_feature (10)..(10): Xaa is any aa, unknown, or other
MSFRSIVRDXRESFGSLSRRSLGVQISGFAWTV

SEQ ID NO: 28978 - DNA, 673 bp, Zea mays
  misc_feature: Ceres CLONE 1403418-F
  misc_feature: Encodes the peptide sequence at SEQ ID NO. 28979
  misc_feature (475)..(475): n is a, c, t, g, unknown, or other
  misc_feature (476)..(476): n is a, c, t, g, unknown, or other
  misc_feature (516)..(516): n is a, c, t, g, unknown, or other
  misc_feature (557)..(557): n is a, c, t, g, unknown, or other
aaagtggagctccccgcggtggcggccgctctagaactagtggatcccccgggctgcaggaattcgcacgagaccattacctagaacatcctaatcgaaaaagggtggcgaaggcggagctgacctgaccggctgacccgcccaacccaacaacctctccgctggccatcttcctcccgggatccctctccctccttcgatccagctcagctctcttcctcccgccccgtacggccgtactcttcttgatccgttcactcatacttctcgagagaaaaggaagaggattcgatctgttgctaccgctagctgcggtactagcagcagcagcagcagcaggaggaggtaccgtagaagaagggaagggaatccatgaagagatggggcagcagcggacaggccgccgattccttctaccaggtccgccccgattgcagccaaaacgtccccaaaccaagttcaggatcaggggcgnngaagacactgagcgttaggaaatggcatgctgcgttcacngcgtgatggatgcctggataatcgccctctggtctgagcgnacaaaaaaaaaaaggggggtgtgcacccacgacaaggggggaaaggggtttggaaaattctttggtccggtggctttgaccccgggaaacacctttccaagaaaagggaacaaaaa

SEQ ID NO: 28979 - protein, 49 aa, Zea mays
  misc_feature: Ceres CLONE 1403418-F
  misc_feature (35)..(35): Xaa is any aa, unknown, or other
MKRWGSSGQAADSFYQVRPDCSQNVPKPSSGSGAXKTLSVRKWHAAFTA

SEQ ID NO: 28980 - DNA, 673 bp, Zea mays
  misc_feature: Ceres CLONE 1403424-F
  misc_feature: Encodes the peptide sequence at SEQ ID NO. 28981
  misc_feature (617)..(617): n is a, c, t, g, unknown, or other
  misc_feature (618)..(618): n is a, c, t, g, unknown, or other
  misc_feature (670)..(670): n is a, c, t, g, unknown, or other
gctggagctccccgcggtggcggccgctctagaactagtggatcccccgggctgcaggaattcgcacgagaccattacctagaacatcctaatctaaaaatccaacgacccacactgagacgtcccctccccgctccgtcctctctcctctgccgccgagacgacgcgatggcggggtccgccgccttgccgccgctcgccgccttcgcgtcgctccttaccgcgcggcgcttcgccgccgccaggtccaagctccggtccctgctcacgccgcgcctactggcggtgccgttcgcgtacctcgccgcctcgtcgctcccgcgcggcgcgccaccgcacgtcggtgtccgccctcttcacgacatgctcttcagctcggataccacacctgcactgccgagatacaaagctcccaaaccctcctgtttcgctcatatcccgcagccccattaacatgatacttgaaccacacaacagcacttctccacaccgatgaggttccctggcccaaaaatacgaatattcgaccctgccagggacccactttagccatgagaattgccccaatttccccccctcccccccacccacccctccctaactatggcggcggctgnnattaagactcgcgcccgcccccgtcgccaaaaacttccgccctgggaggatngag

SEQ ID NO: 28981 - protein, 94 aa, Zea mays
  misc_feature: Ceres CLONE 1403424-F
MAGSAALPPLAAFASLLTARRFAAARSKLRSLLTPRLLAVPFAYLAASSLPRGAPPHVGVRPLHDMLFSSDTTPALPRYKAPKPSCFAHIPQPH

SEQ ID NO: 28982 - DNA, 674 bp, Zea mays
  misc_feature: Ceres CLONE 1403426-F
  misc_feature (494)..(494): n is a, c, t, g, unknown, or other
tggagctccccgcggtggcggccgctctagaactagtggatcccccgggctgcaggaattcgcacgagaccattacctagaacatcctaatcgaaaaacacggtcgacgaaatgccgccgcgagagctcttcatcgtcaactgagattcgcctcgcatcttctcggattccttccccaactttcgtccccatcagcggacctactcgagatcgacgagacacgtcggagcccggcttcctaggcgtcccagcgcccgactggatctcctggatcgggccgccttgatggccgctggggccggcccaggatggagttcgaggcgatgagcaggcttgcgtcgggactccagcgctagcagaggccgacatcgcagtgtgaggtgctttggacggagctcgcgtcatgcgggctagtgctttgctcgcagctcgccgtgaagatgattcccaggctcttctctttccgctccctccatcgcagtgtccccagcgtngcggggtggtgatcatcacgctgatggcgatcgaccagctagtgcatcgagttcatcaggacgggcgatatcggccccgcatctagtgctcatcaacactcatcgtattgtgcacgggtttacgaaattcgtaatctgcacagcaactgtcttctctgctgcactcgctataggaaggaa

SEQ ID NO: 28983 - DNA, 728 bp, Zea mays
  misc_feature: Ceres CLONE 1403427-F
gagctccccgcggtggcggccgctctagcactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaatcaatttcttcgtccgcctttcgccctgcttacgtccccgctactaaccctaggatcattctggcctttccccgttcctaaaccgaatctttctccgcacattggccaataggtaatgaggttggaacgccttaaaaaaacttctctacaagaataaggggaaacacacaacctctgtcagcagttgaccccacgctcgcaaaaaatggcgaatcggcccccccatcccatccatccaaacaatcattgggtcaactcgccaacccgtattaatcccacaacaatgttcgcatcggggtttccgcgtgtccagcatatctcccaccaccccacctccacgcaccgccccaccacaaccacactcttgaataaactggctaaaaatacgaatccctcttcccccccccccttgtcccg

SEQ ID NO: 28984 - DNA, 687 bp, Zea mays
  misc_feature: Ceres CLONE 1403429-F
  misc_feature: Encodes the peptide sequence at SEQ ID NO. 28985
  misc_feature (517)..(517): n is a, c, t, g, unknown, or other
  misc_feature (539)..(539): n is a, c, t, g, unknown, or other
ccccgcggtggcggccgctctagaactagtggatcccccgggctgcaggaattcgcacgagaccattacctagaacatcctaatcgaaaagattgatcttttttacatggtcaagttaagatgacattcatgattcatcagcgaattttcccaccgctcagcagttacctcgttcccgttctcctcctcgcatccctctcgtccgccgccgccgcctggctcgcgccgccgacagtttctcggcccagatcgagacacgcccgccgtcctacaccaggtgccgaggccttcgccgatcaaagagatcccagacagcagattcgtccgtgccctgctcctcgaaccatggggacctctgcccaggaatcgcctctctggaagcgtatcgacgatgccgagtactatctagtcagtggatcatttgaccaggcgggtgttgactgctttatccgtcgccaatgaaatacacatgggcttctttggagagcgctagcaccaggatgagctcctggagatngcttgaatcggctggggatggntgcttgtgcaggcactaaaagaactcaggaggccctcctgagatgtttgtcagtttaaaaaaggagggtttggttcaagggccatcagtggcctggctaaagttttcctttacagggaactaacattcaaaaggccaaaaaggtttta

SEQ ID NO: 28985 - protein, 38 aa, Zea mays
  misc_feature: Ceres CLONE 1403429-F
MGTSAQESPLWKRIDDAEYYLVSGSFDQAGVDCFIRRQ

SEQ ID NO: 28986 - DNA, 758 bp, Zea mays
  misc_feature: Ceres CLONE 1403430-F
  misc_feature: Encodes the peptide sequence at SEQ ID NO. 28987
  misc_feature (381)..(381): n is a, c, t, g, unknown, or other
  misc_feature (399)..(399): n is a, c, t, g, unknown, or other
  misc_feature (503)..(503): n is a, c, t, g, unknown, or other
  misc_feature (573)..(573): n is a, c, t, g, unknown, or other
  misc_feature (606)..(606): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (736)..(736): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
aagctggagctccccgcggtggcggccgctctagaactagtggatcccccgggctgcaggaattcgcacgagaccattacctagaacatcctaaaaaaaaaccccaaacccacagcagtaacaggggcacactagctaagctaaacctcgccacggcacagcaatggcgccgctccccgcttccctcctgccctgcctctggctcttcctctgcctcctcgccgcgccgtgccccacagcgcgggcggcgcggttcgcgtgcaacgccacggcgccgcgagcgtccacgtgccaggcgctcgtctcctacgcgccgcccaacgggacggccacgcccacgctggccggcgagcgcgggatcttccagctccgctcgcacgngcgctggtggccgcaaangggctcacgctttacaagctgacaagggggcccgcgcccgtgccggttgcataaccaaatgcactgattcttttcggatcccccctatcccattaccaagggcntaaaaaaggagttccacccccggacacccctaaatcgccctcccaaggaaaggtactaccgaaactcccnacaacaaaatggcatacgccaccccccaccatngccgcgcaacctggaaaggaaccgcggccacacagagagaaattgttccccgacgctctttggccgcaaaccagtgggggacaaacctctttggnnnctctcaaaaacttcgagacagggggggtaaggnatgacnnnagctttgagagaaa

SEQ ID NO: 28987 - protein, 85 aa, Zea mays
  misc_feature: Ceres CLONE 1403430-F
  misc_feature (73)..(73): Xaa is any aa, unknown, or other
  misc_feature (79)..(79): Xaa is any aa, unknown, or other
MAPLPASLLPCLWLFLCLLAAPCPTARAARFACNATAPRASTCQALVSYAPPNGTATPTLAGERGIFQLRSHXRWWPQXGSRFTS

SEQ ID NO: 28988 - DNA, 704 bp, Zea mays
  misc_feature: Ceres CLONE 1403431-F
  misc_feature (704)..(704): n is a, c, t, g, unknown, or other
aagctggagctccccgcggtggcggccgctctagaactagtggatcccccgggctgcaggaattcgcacgagacccttccctagaacatcctaatcaaaagcttcacttcaattctcctcctcgccgagcgggagcgccgagagagatgcgaccgcgatgcccccactcgtcccctcccagctcctaccaccaagcccaaccctgatcctacccgcgccacctcgcctctcctgccgccgccgccgcttcccgcccgcactgcttgccgcgtcgtcgtcctcctccgcgtccccgcactccaggcaaccataccgccgccgccgccgccttgaagcccagcgccagacaccgacgcctgcgccgcgcccgccctcccagccaaagccgcctccgcgccacgcaaatgccaccgcgtcccgcgctcggggccaggaggagctggaggcggcgatttacgacttcatgtgccgctccgccaagccaggagccttccccacccgcgaggagctcggtcgcggcgggccgtccggacctcgcggacgccgtcgcggtccaagggggggggctggctcttccctcggctggtctccaccggggccgcggaggcccccccgggaagatggcttgcgccgcgctcaattcgggggggggggccccccctgactaccccgccggaagaggggcggtgtaattacccgggggn

SEQ ID NO: 28989 - DNA, 759 bp, Zea mays
  misc_feature: Ceres CLONE 1403432-F
  misc_feature: Encodes the peptide sequence at SEQ ID NO. 28990
  misc_feature (662)..(662): n is a, c, t, g, unknown, or other
ctggagctccccgcggtggcggccgctctagaactagtggatcccccgggctgcaggaattcgcacgagaccattacctagaacatcctaatcgaaaaaaaccctaaccccatcccgcactccccccctcccccaacacgcgcgtgctttcttagccgctaagcatatccctccccgccacgatctcgatggtggagatgtctgtggtggagctcaggacgctgccgctcggcttccgctttccaccccacgacgaggagctcgtcacccactacctcaaggggcagatcaccggcaggatcaactccgagtccgaggtcatcccccgagatcgacgtctggcagtgcgaagccgtgggacctcccaaaatagtccctgatccgggtcgaagatcctggaatggtcctctttcgccccccaggaccggaagaacccaaacggtagcaagtcaaaaagggccaccgagggggaaactggaaaggctactggggaagccagggtaaacccattcccggggggaaaagggaaagaaaataacattggggaaaaaaaaaacccttgtttttccacgggggggggcccccaaggggggggccccgggggggttttttggcaagacccccaccccaccccttatttcagccccggaaaaaaagggggnattttttttttttaccccctcttccaaaaaaaaaagagaaaaaaaggggcccccccccagaggagggggggaaaaagggggccccccacaccccctt

SEQ ID NO: 28990 - protein, 63 aa, Zea mays
  misc_feature: Ceres CLONE 1403432-F
MVEMSVVELRTLPLGFRFPPHDEELVTHYLKGQITGRINSESEVIPRDRRLAVRSRGTSQNSP

SEQ ID NO: 28991 - DNA, 670 bp, Zea mays
  misc_feature: Ceres CLONE 1403433-F
  misc_feature (419)..(419): n is a, c, t, g, unknown, or other
  misc_feature (420)..(420): n is a, c, t, g, unknown, or other
  misc_feature (426)..(426): n is a, c, t, g, unknown, or other
  misc_feature (457)..(457): n is a, c, t, g, unknown, or other
  misc_feature (490)..(490): n is a, c, t, g, unknown, or other
  misc_feature (503)..(503): n is a, c, t, g, unknown, or other
  misc_feature (504)..(504): n is a, c, t, g, unknown, or other
  misc_feature (534)..(534): n is a, c, t, g, unknown, or other
  misc_feature (559)..(559): n is a, c, t, g, unknown, or other
  misc_feature (563)..(563): n is a, c, t, g, unknown, or other
tggagctccccgcggtggcggccgctctagaactagtgatcccccgggctgcaggaattcgcacgagaccattacctagaacatcctaatcgaaaaatattctcccaaaaaacccaacactccagtggcggcaaagacctaacatttcaaaatcaatggccaagaaccccaaggcgcccgacacccgcagtggccgttctcccaccagaaggccccgaccacgccgcgccaaggcggtgccagaagcctcctccgcagctgatatcgaagacctggctccctcagtgcctggggccgctgcccctggcgctgccgcacccacggccctgcgcgcacagctgctccggtggtatgacgcgcaccgtagggacctgccgtggcgatgcgtaagcggcagcgaggaagagaggcgtacgggnntgtggntggtccgaggtgatgctgcagcagacgcggntgccccgtggtcgtcgcttactacgagcggtgnatgggcgcggtgnncgaccgtacgaagcctcgccgccgctacgnaggaggaggtgaacgagatgtgggncggntcttggctactaccgtagggctcgatttctgctggagggagaaaagagatatccgaaaagggttgtttccttgaaggcgttacccctttctgaaggtcggggattgg

SEQ ID NO: 28992 - DNA, 724 bp, Zea mays
  misc_feature: Ceres CLONE 1403436-F
  misc_feature: Encodes the peptide sequence at SEQ ID NO. 28993
aaagctggagctccccgcggtggcggccgctctagaactagtggatcccccgggctgcaggaattcgcacgagaccattacctagaacatcctaatcgaaaaaaacagcgaagaaggaagccggttagggtttccacctcctttcccctcctctccttcagcgtcgaccgcggaccacaccctcgatatccttcccctcggacccggaggcgagcagtagcctccagcgcctgccacgcctgcccgtctctttattgggaggattcgccatgtctgacatggagtccgtcgcagctcttatgaactcgacaagctccaagatacagcagcttcaggaggcatttgctgagcttgagagccagagcacgtttccatggaactcgagtgggagcagctcgaagaccacttacgtggccttgaacagcccctcagaaaaagttggacgacctaaaaagagcggaaaagagttcaagaaacttggccaaatcctaacaaattctggaacaagggaggcccttgttgggaaaagaaactgcctccttggaaaatttgcggaaaaaagggacccggttaaatttaattttaaaaagcccgggtttttttaaggggtcaaaacaaaaccaaaggaaaggggcgtaaaaattgggggggggggggggaaaaaacgggttttaggaagggggggcctttaaaaaatttatttgttgaaggacccctctctttt

SEQ ID NO: 28993 - protein, 111 aa, Zea mays
  misc_feature: Ceres CLONE 1403436-F
MSDMESVAALMNSTSSKIQQLQEAFAELESQSTFPWNSSGSSSKTTYVALNSPSEKVGRPKKSGKEFKKLGQILTNSGTREALVGKRNCLLGKFAEKRDPVKFNFKKPGFF

SEQ ID NO: 28994 - DNA, 832 bp, Zea mays
  misc_feature: Ceres CLONE 1403440-F
  misc_feature: SWISSPROT Homolog: EC 5.4.2.1 Phosphoglycerate mutase
  misc_feature (1)..(1): n is a, c, t, g, unknown, or other
  misc_feature (2)..(2): n is a, c, t, g, unknown, or other
  misc_feature (25)..(25): n is a, c, t, g, unknown, or other
nncccccccccccccccccccccanaaccactccccattaattagaaaaaaatatattgaagaagctccacgggggtggtggccgactctagaactagtggatcccccgggctgcaggaattcgcacgagaccattacctagaacatcctaatcgaaaactgttctatatcgccccattgctcgctcgccaagagttcttcttgttaggcaaggcaaaagcagaagcaaaaaaagaaaggtcttgttgccgatggtgagctcaggattctcgtggacgcttccggaccaccccaagctccccaaggggaaaccggtgggctgtcgccgcgctggacgtatgggacgaggccaaccccgatcaagtacaactggatccatgtcgctcacaactcctgtcatggcacctcgctaaaaaatggggcctcctgagaaactgtagaactaagtggaaagggtcattgaaaacaggctgcggggtcctccccatctggatgattgacaagggccacacctttcaaccttggtccaccaccggcaccttgggggcgttgggccacgagattctgccccccccaaggggggctacgtgcctcaggctgcacttagaacaactctggccattagaagaaaagcccttcagtatgtggtccccccgcgcatctatcaccccctctcatatataccctccactccaatggctgccagaaccgactgctctcccttctccccaccaacatccacacccccccgcccaccgcacccccggccgcagtgagttgacaccaaagatagcaaagaataaagatatgggatatggaaccatggggagag

SEQ ID NO: 28995 - DNA, 693 bp, Zea mays
  misc_feature: Ceres CLONE 1403442-F
  misc_feature: Encodes the peptide sequence at SEQ ID NO. 28996
aaagctggagctccccgcggtggcggccgctctataactagtggatcccccgggctgcaggaattcgcacgagaccattacctagaacatcctaatcaaaaaacgttgacggccaccccgcccacagccgcgacaaactcttcctcagacccacgccacgtacgatgcctctctccccttcccctccgcccaacgccgccgccgccgccgccctacccctcctcctgctgctcgtctgcgccagcagcattgccgcgcagccgctggcgtcgtcgcaggccaaggcgctcctcccggtgcgccgcctgctagtctacccgccggtgctcgagtcactgcgaagggacactggacccctgcgaagtgacgcccggggccggccctctcaaaccctagaattgtccggaaaatttactcagggtccccggaggggccaaaaaaaaccctgaagtaagggcgagagggcttaacttgggaaaaaatttcctctttggaacttttttaacatttgtgtccaaaccccgaaaaagggccagcctttttttggaccaagggggcaaagttttccccaggaaagagagtgttcccgccatggggcccttttttttgcatatataaaagtggaccccccgcctcgtgctctttgggacgggggaataaaatttggggggaaacatgttacttgaaaaaaag

SEQ ID NO: 28996 - protein, 94 aa, Zea mays
  misc_feature: Ceres CLONE 1403442-F
MPLSPSPPPNAAAAAALPLLLLLVCASSIAAQPLASSQAKALLPVRRLLVYPPVLESLRRDTGPLRSDARGRPSQTLELSGKFTQGPRRGQKKP

SEQ ID NO: 28997 - DNA, 722 bp, Zea mays
  misc_feature: Ceres CLONE 1403444-F
  misc_feature: Encodes the peptide sequence at SEQ ID NO. 28998
  misc_feature (350)..(350): n is a, c, t, g, unknown, or other
  misc_feature (389)..(389): n is a, c, t, g, unknown, or other
  misc_feature (413)..(413): n is a, c, t, g, unknown, or other
  misc_feature (515)..(515): n is a, c, t, g, unknown, or other
  misc_feature (584)..(584): n is a, c, t, g, unknown, or other
  misc_feature (692)..(692): n is a, c, t, g, unknown, or other
ctggagctccccgcggtggcggccgctctagaactagtggatcccccgggctgcaggaattcgcacgagaccattacctagaacatcctaatcgaaaaattccaagctctcttcattggttcatagctagctagttcgcctcccaaaaacacctgccctcgtgcgtggcaggagcacgggcacgatgatcagcacagcgcacagccggcagcagcaccatgccttcgagaagagccctggcaacagccacatgaagagcatcgacgggaagctgcagcaggccatgagccaggcggccagcaagtacatgcagaggatctaccctctaggcatgcagaggagcagctccngcctcacattgtcgtcgctctcgctgtcgcagaactccnacgactcctccatcagcagctccnactccagctgggagcccaaggtgccgctgctctacggcggcaccttcagcccatggggcgacgtcatggtgtctcgggagatgaggcgggaggacgatgacnaggtcagtgaccatgacgtcaaagggagcgaggaggacttggactgcagtgagccggggagcctgcgtnagtgcagctggatcaccaagacagtgaccaggcgtacgtccagttcacgacgaggggctggggcgtccctgtgacagcgacaaccggtgttcgagcttctgtcgctgncagggatgctgatcgacacaactggacgga

SEQ ID NO: 28998 - protein, 157 aa, Zea mays
  misc_feature: Ceres CLONE 1403444-F
  misc_feature (56)..(56): Xaa is any aa, unknown, or other
  misc_feature (69)..(69): Xaa is any aa, unknown, or other
  misc_feature (77)..(77): Xaa is any aa, unknown, or other
  misc_feature (111)..(111): Xaa is any aa, unknown, or other
  misc_feature (134)..(134): Xaa is any aa, unknown, or other
MISTAHSRQQHHAFEKSPGNSHMKSIDGKLQQAMSQAASKYMQRIYPLGMQRSSSXLTLSSLSLSQNSXDSSISSSXSSWEPKVPLLYGGTFSPWGDVMVSREMRREDDDXVSDHDVKGSEEDLDCSEPGSLRXCSWITKTVTRRTSSSRRGAGASL

SEQ ID NO: 28999 - DNA, 661 bp, Zea mays
  misc_feature: Ceres CLONE 1403447-F
  misc_feature: Encodes the peptide sequence at SEQ ID NO. 29000
  misc_feature (269)..(269): n is a, c, t, g, unknown, or other
  misc_feature (271)..(271): n is a, c, t, g, unknown, or other
  misc_feature (463)..(463): n is a, c, t, g, unknown, or other
tccccgcggtggcggccgctctagaactagtggatcccccgggctgcaggaattcgcacgagaccattacctagaacatcttaatcgaaaaaaaaacctcctcctcagtcctctctcctgctgccacgaggtacggcccagctcttcctcaaagcgggcgaaatccacgccgcgcgggcggcggcggcagaggaggaggggggatgatggggtgcctcttcgcctgcttccgcgcgtccggcggcgatggcgaggtgaagggcaccggngnccagctcgcgcatccgtcccagccccccgcgacgacgacgacgaccagccaccaggtccaggatggcgcgggcaggagggccaggccgccgtcgaggaagcgctctccgccgtgttccagcgagaagatgagggatcaaggacggcgcaagtggcgagctcgtgggcggacgagagtggcgagaggaagganatggatcaggagcttgtgcatcaggccattatccaaagaagctgtggggcgttgctgcaaactacaataaccattcaaggagcgctcatcaaagatggctgattcaggtcatcagaaggaaacacttccaggatggcttcccgggtgtggccggagaacaacatttcaggaaagcgcccaagggttgaaaaatgtgaa

SEQ ID NO: 29000 - protein, 187 aa, Zea mays
  misc_feature: Ceres CLONE 1403447-F
  misc_feature (90)..(90): Xaa is any aa, unknown, or other
  misc_feature (154)..(154): Xaa is any aa, unknown, or other
PRGGGRSRTSGSPGLQEFARDHYLEHLNRKKNLLLSPLSCCHEVRPSSSSKRAKSTPRGRRRQRRRGDDGVPLRLLPRVRRRWRGEGHRXPARASVPAPRDDDDDQPPGPGWRGQEGQAAVEEALSAVFQREDEGSRTAQVASSWADESGERKXMDQELVHQAIIQRSCGALLQTTITIQGALIKDG

SEQ ID NO: 29001 - DNA, 674 bp, Zea mays
  misc_feature: Ceres CLONE 1403449-F
  misc_feature: Encodes the peptide sequence at SEQ ID NO. 29002
  misc_feature (253)..(253): n is a, c, t, g, unknown, or other
  misc_feature (358)..(358): n is a, c, t, g, unknown, or other
  misc_feature (372)..(372): n is a, c, t, g, unknown, or other
  misc_feature (467)..(467): n is a, c, t, g, unknown, or other
  misc_feature (542)..(542): n is a, c, t, g, unknown, or other
tggagctccccgcggtggcggccgctctagaactagtggatcccccgggctgcaggaattcgcacgagaccattacctagaacatcctaatcgaaaaactcgcaccacgccaccgctgctgcctgctcctcacagtcctccccgcgctcgcattgcgatttgcgacctagcgcgagggtaccgggggggtggtgcgcgcgcgtgctcggtgatccgggaagcgccgcgagatggccgggggtggaggcggcgntgccgcgccgaagcacgacgacttcacgccgcaccccgtcaaggaccagctcccctggggtctcctactgcatcaccagccctcccccgtggcctggagccgttncttcttgggttcancattatctggtcatgcttggtaccactgtgatcataccaactgcacttggtccacaaatgggaggaaacaatgaggacaaagcagtggttatcangacattgctgttcgttgcaggtatcaacaccctcctgcagagtttctttgttaccatgttgcctgcagtgatcgncgggtcatacaccttttgtctgcttaacattcgatcatccttgttggaacgtatggtaatgaacctaatccacatattaaatttctccggatcatgcgtggacccaaggggcgttgattgggggttccacct

SEQ ID NO: 29002 - protein, 96 aa, Zea mays
  misc_feature: Ceres CLONE 1403449-F
  misc_feature (28)..(28): Xaa is any aa, unknown, or other
  misc_feature (53)..(53): Xaa is any aa, unknown, or other
MLGTTVIIPTALGPQMGGNNEDKAVVIXTLLFVAGINTLLQSFFVTMLPAVIXGSYTFCLLNIRSSLLERMVMNLIHILNFSGSCVDPRGVDWGFH

SEQ ID NO: 29003 - DNA, 645 bp, Zea mays
  misc_feature: Ceres CLONE 1403450-F
  misc_feature: Encodes the peptide sequence at SEQ ID NO. 29004
  misc_feature (400)..(400): n is a, c, t, g, unknown, or other
  misc_feature (495)..(495): n is a, c, t, g, unknown, or other
  misc_feature (496)..(496): n is a, c, t, g, unknown, or other
  misc_feature (544)..(544): n is a, c, t, g, unknown, or other
  misc_feature (551)..(551): n is a, c, t, g, unknown, or other
  misc_feature (567)..(567): n is a, c, t, g, unknown, or other
tccccgcggtggcggccgctctagaactagtggatcccccgggctgcaggaattcgcacgagaccattacctagaacatcctaatcgaaaactctcgattcggaaaaccctccaaccctagccgggatccgacaacgcctccatccctagccgcctcctgcaagtttcagagctcaagagtcggggcgccatggcgacagagacggagactttcgcctttcaggctgagatcaaccagctgctctcactcatcatcaataccttctattccaacaaggagatcttcctccgggagctcatttccaactcttccgatgcgttggacaaaatcaggttcgagagcctcactgacaagagcaagctcgatgcgcagccggagctgttcatccacattgtaccnagacaggcttcgaacacgctctccatcatcgacagcggcatcggcatgaccaagtccgacctttgtcaacacctcggtaccatcgccaggtccgnnaacccaggagttcatggaagcccttgctgctggcgctgatgtgcattnaatgggnaaaattccggggggcngttttctactctgcctactcgggggccgaaaggggttctccctggacccccaggcttaacgttgacgagcggggtcgg

SEQ ID NO: 29004 - protein, 114 aa, Zea mays
  misc_feature: Ceres CLONE 1403450-F
  misc_feature (102)..(102): Xaa is any aa, unknown, or other
MATETETFAFQAEINQLLSLIINTFYSNKEIFLRELISNSSDALDKIRFESLTDKSKLDAQPELFIHIVPRQASNTLSIIDSGIGMTKSDLCQHLGTIARSXNPGVHGSPCCWR

SEQ ID NO: 29005 - DNA, 726 bp, Zea mays
  misc_feature: Ceres CLONE 1403454-F
  misc_feature: Encodes the peptide sequence at SEQ ID NO. 29006
  misc_feature (284)..(284): n is a, c, t, g, unknown, or other
  misc_feature (296)..(296): n is a, c, t, g, unknown, or other
  misc_feature (304)..(304): n is a, c, t, g, unknown, or other
  misc_feature (357)..(357): n is a, c, t, g, unknown, or other
  misc_feature (358)..(358): n is a, c, t, g, unknown, or other
  misc_feature (566)..(566): n is a, c, t, g, unknown, or other
  misc_feature (589)..(589): n is a, c, t, g, unknown, or other
  misc_feature (595)..(595): n is a, c, t, g, unknown, or other
aaagctggagctccccgcggtggcggccgctctagaactagtggatcccccgggctgcaggaattcgcacgagaccattacctagaacatcctaatcgaaaataccgcctgatccaccgcggtttgcttgccgcgagcatggaaattattagtcattcgacaagtcagagagattttatttcctctcgtcgtctcgtggccgctggtgcccgcgcgtcagatttgggctgctccgctccgcctccgcagtgtgaatttctgagagataggtttctgtgctgcanacagcccggcgncgacgcgntggcagttttgcgcgaggtccggcgtcgcgccggcgttcatgtcgttcagganncgagcgacgggcgagggctctgaggcggttctcggtctccgagctccgggcgggcggagaacgctttcgacgggatcagaagcagagctccatgctttcgatctaccaggaaaggcggttgggcacaacagcaggcagggcacggcacagcagcagtaccctgcagcggcgcacaggcagcgctcgcaggtggggattacggggcgcngcaacgcatcttctcctggtggngggggngggtgattcaagttagtgcaccccggtgtcgtgccccaccctgtgccgttcatcaggccaacctgagggccagttatcagtgtcgaaagcttccacaacagaagagccttttccatgacaaacaagggttt

SEQ ID NO: 29006 - protein, 85 aa, Zea mays
  misc_feature: Ceres CLONE 1403454-F
  misc_feature (5)..(5): Xaa is any aa, unknown, or other
  misc_feature (75)..(75): Xaa is any aa, unknown, or other
MSFRXRATGEGSEAVLGLRAPGGRRTLSTGSEAELHAFDLPGKAVGHNSRQGTAQQQYPAAAHRQRSQVGITGRXNASSPGGGGG

SEQ ID NO: 29007 - DNA, 662 bp, Zea mays
  misc_feature: Ceres CLONE 1403457-F
  misc_feature: Encodes the peptide sequence at SEQ ID NO. 29008
  misc_feature (407)..(407): n is a, c, t, g, unknown, or other
  misc_feature (524)..(524): n is a, c, t, g, unknown, or other
  misc_feature (604)..(604): n is a, c, t, g, unknown, or other
  misc_feature (636)..(636): n is a, c, t, g, unknown, or other
  misc_feature (652)..(652): n is a, c, t, g, unknown, or other
  misc_feature (653)..(653): n is a, c, t, g, unknown, or other
gctctagaactagtggatcccccgggctgcaggaattcgcacgagaccattacctagaacatcctaatcgaaaaagactagagagagaaacccttgtacccgtgttccttttcatcccccattttctccgagtttccggcccatcgccgagcatcgagtccaaggaagcggagccggcggagaaggggagatttgactttcccgtcgggtgcctagggagcaggagggatgcagcggcggcggggccacacgtgggcaggggtggggaagacggcccaggcggcggcggcgcacgccgcgctcttctgcttcactctcctcctcgcgctcagggtcgacggacgcaccgcatactcctggtggataatattcagtccactatggctctttcatggtattgttgcacngcggaaggttttcaatgcctgccccttctttgcctcatggccgtcattgggcacatggtcattcgattgttggcgcgccattactaattgcgttcgagctgcttcttgggatatatnctgaaagcataagagttagaatcatccatctggtgatctggaaggattgtgtcccttccccctgttggccttttgagcantaatccttattgacaattttaagatggtgtanagctttattgcctggnngatgaaaaa

SEQ ID NO: 29008 - protein, 70 aa, Zea mays
  misc_feature: Ceres CLONE 1403457-F
  misc_feature (6)..(6): Xaa is any aa, unknown, or other
  misc_feature (45)..(45): Xaa is any aa, unknown, or other
MVLLHXGRFSMPAPSLPHGRHWAHGHSIVGAPLLIAFELLLGIYXESIRVRIIHLVIWKDCVPSPCWPFE

SEQ ID NO: 29009 - DNA, 802 bp, Zea mays
  misc_feature: Ceres CLONE 1403458-F
  misc_feature: Translation starting site: 216
  misc_feature: SWISSPROT Homolog: EC 4.1.1.19 Arginine decarboxylase
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (31)..(31): n is a, c, t, g, unknown, or other
tggcccacccccctnnntnnntccgtgaggngtaagtggccagggcccccaaaggtggtgctccccgcggtggcggccgctctagaactagtggatcccccgggctgcaggaattcgcacgagaccattacctagaacatcctaatcgaaaaacagcactaaagtctattcatctctggctccccaaattcagctggagagcactttttcccatcatggataagaactacggtgaactctacaacatcctcggatggggtgaggagtacttcgcggtgaacacggaggggcacctcagcgtgaagcctttcggccgctggacggagcccgggcaggagatcgacgtgcactcggtcatcgtggaagctctagcgacccaacccaacgacagcaccagcaaatctcagttccccatgatcccttcgcttccccgacgtgctcaagaaccgtatcgagacgctccataacgcattcaacagcgccatggagtcccccgggtacacgtcccagtaaccaaaggcgtgttcccccgatcaaggtgaaccagaacaaagcacgtcgtgcaggaaaaagggggttaaaggttccggcccagcaaaggaaactatggggggcccggatggctggcttccaaggccagaaattggctccatcgcccatgagtctggcctcccccggtccaccgaagccggaagccccaagcccggtaacttggattcctgcaaacggctaaaaacaggggacggcgggaacttacattccggggctcgggattccccctcggggcgggggagaaccaatg

SEQ ID NO: 29010 - DNA, 652 bp, Zea mays
  misc_feature: Ceres CLONE 1403461-F
  misc_feature: Encodes the peptide sequence at SEQ ID NO. 29011
  misc_feature (303)..(303): n is a, c, t, g, unknown, or other
  misc_feature (366)..(366): n is a, c, t, g, unknown, or other
gctctagaactagtggatcccccgggctgcaggaattcgcacgagaccattacctagaacatcctaatcgaaaagacacgcactctactctcgcacacagccgccgggcgggcacagtgacgcggccacgcgggcgccggagctagggtttccctgatccggcagggccggggagccgccggaaaccgttgctcgatttcggcgccggaggcgcggcatcggtgtctccgaggacggcggacgcgagggcggttggggagctgaggcgcggcgccgggggctcagatctggtatgaccgacgncggcgaagacgggaatgcggcggcgcccagggcccctcggcgccgaaggggaccctgtgcggncagcctcgatggcgacgagttcatggcgctgatgcccggctcggatccccggaagggcccaagttcacccgctgggagaacgggttcagggaaaaggagggggaagtttggggaggcacaaaaaggaaataccgcccctgggccttggtcaaaagggcgcgcgaaaaacccccccggaggactttcaaaagaattgggaaaaaggggtttgaaaaacccggggggggagaactcctccgtgggaagcaaggccccccccttatcctgtgggtttggcggggggccc

SEQ ID NO: 29011 - protein, 120 aa, Zea mays
  misc_feature: Ceres CLONE 1403461-F
  misc_feature (4)..(4): Xaa is any aa, unknown, or other
  misc_feature (25)..(25): Xaa is any aa, unknown, or other
MTDXGEDGNAAAPRAPRRRRGPCAXSLDGDEFMALMPGSDPRKGPSSPAGRTGSGKRRGKFGEAQKGNTAPGPWSKGRAKNPPGGLSKELGKRGLKNPGGENSSVGSKAPPLSCGFGGGP

SEQ ID NO: 29012 - DNA, 744 bp, Zea mays
  misc_feature: Ceres CLONE 1403462-F
  misc_feature (72)..(72): n is a, c, t, g, unknown, or other
  misc_feature (73)..(73): n is a, c, t, g, unknown, or other
  misc_feature (259)..(259): n is a, c, t, g, unknown, or other
  misc_feature (375)..(375): n is a, c, t, g, unknown, or other
gtttggggtgttggttggtgcgcgcggccttttcttccccccccatatttatatccaatccctcattggggnnctctttttttttcaaagctggcgctccccgcggtggcggccgctctagaatagtggatcccccgggctgcaggattcgcacgagaccattacctagaacatcctaatcgaaaaaacaaatcgacctagctaggcacaagagcgctagacgccgcagcgcagcacgcaccacccaccgagcggccgncggagggagggcaatccgcaggaagcagaagccgcccgcgcaggaatgggcggggccggggcaccgcgccctcccctttggtccccccggctcctgggggggggagggggggggantccccaagaatcactatcccccattaaaccctcttttttgtcgagcttcgcggctccgggtctatacgggggtccgcgtcgcgacgctgctgccccctcctcgtccacccgcgtgggggggggtgtctttcttttcgcatttaccttccgcccccccccccaccccgctctgccccccccccacagtttcttttgttgttttcctccacctcccatcttttaagaatacaagaataatcacaaaacgggcagaaaaggttttttcaccacatctttatttcctctactctcttctttcccaaccgccccccctacccccggagcgtcccccttgcccccccccgactctcttatcagcgcgcaggagaa

SEQ ID NO: 29013 - DNA, 687 bp, Zea mays
  misc_feature: Ceres CLONE 1403463-F
  misc_feature: Encodes the peptide sequence at SEQ ID NO. 29014
  misc_feature (301)..(301): n is a, c, t, g, unknown, or other
  misc_feature (350)..(350): n is a, c, t, g, unknown, or other
  misc_feature (458)..(458): n is a, c, t, g, unknown, or other
  misc_feature (473)..(473): n is a, c, t, g, unknown, or other
  misc_feature (509)..(509): n is a, c, t, g, unknown, or other
  misc_feature (510)..(510): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (547)..(547): n is a, c, t, g, unknown, or other
  misc_feature (594)..(594): n is a, c, t, g, unknown, or other
tggagctccccgcggtggcggccgctctagaactagtggatcccccgggctgcaggaattcgcacgagaccattacctagaacatcctaatcaaaaatctgttcccctttccctcctgcgcacccgtcttctcctccccgcgtcaaaccccagcacaaaaagcaaccgcccgccgcctcctcgttcctctcccgaatcagccgtcgcggtgcctaatccggccgatcccccctccgatccgcgggtgcccgccgcagaggcggcgcctccgggcctcccccgatgtatagcaacttcaggnagcaggcgatcgagtacgtcaagcaggcggtccaggaaggacaatgccngcaactacgtcaaggcgttccctctctacatgaacgcgctcgagtacttcaaaacccacctcaagtacgagaaagacccccaagatcagggagccatcaccgcccagntcaccgagtactccngccgcgcgagagaaatcgggcggtcctcgatgaggnngcgcgcagggctggnnnccaaccgggggnnnacccanctgcccccacgcgccccaagacaggggaagggacgggggaacgagcnacggggaggggatgactcccagaagcccaagcttgagggggggggtcaacttcgccatcattaccgagaacccaaaatttagggggaaacgcc

SEQ ID NO: 29014 - protein, 98 aa, Zea mays
  misc_feature: Ceres CLONE 1403463-F
  misc_feature (27)..(27): Xaa is any aa, unknown, or other
  misc_feature (32)..(32): Xaa is any aa, unknown, or other
  misc_feature (44)..(44): Xaa is any aa, unknown, or other
  misc_feature (49)..(49): Xaa is any aa, unknown, or other
  misc_feature (50)..(50): Xaa is any aa, unknown, or other
  misc_feature (54)..(54): Xaa is any aa, unknown, or other
  misc_feature (56)..(56): Xaa is any aa, unknown, or other
  misc_feature (72)..(72): Xaa is any aa, unknown, or other
MNALEYFKTHLKYEKDPQDQGAITAQXTEYSXRAREIGRSSMRXRAGLXXNRGXTXLPPRAPRQGKGRGNEXRGGDDSQKPKLEGGGQLRHHYREPKI

SEQ ID NO: 29015 - DNA, 631 bp, Zea mays
  misc_feature: Ceres CLONE 1403467-F
  misc_feature: Encodes the peptide sequence at SEQ ID NO. 29016
  misc_feature (261)..(261): n is a, c, t, g, unknown, or other
  misc_feature (384)..(384): n is a, c, t, g, unknown, or other
  misc_feature (393)..(393): n is a, c, t, g, unknown, or other
  misc_feature (553)..(553): n is a, c, t, g, unknown, or other
tcagaactagtggatcccccgggctgcaggaattcgcacgagaccattacctagaacatcctaatcgaaaacttcttcttttttccctacccctccgccgttgctctgcaaggcacgcgtcctgcacgcgccaaagctaggcgataaactggaaaggagcgcgcagcgcaggcttcgggctcctgtctccgccgcggcgtcctctcgctttttcaggactttcaggacttgcaggctctgcgcagcgcgatctgacatctngaccgggtcagacgatacagcccatatactacgtttacgtcgaggtcctcaaagttcaattctacctggaccattgcacccatcttggcccaaagtacttgcgcgccgcgctacgaacgaggncatccgcgncaacacgccgtcggcatgtggcgcagaaggtcagaggggcctggcctggggggagggccaacgaggagcagcggctgcggcctgctctgcgcactgcaggggaaaagggggggggtgctgaaacgccctggtgaacaagcaccggaaccagcacccgggnggccgcctatttcaatacctcctcaagggggggggggggacctggaagttccggctcggggccggcactccgtgaagc

SEQ ID NO: 29016 - protein, 74 aa, Zea mays
  misc_feature: Ceres CLONE 1403467-F
  misc_feature (49)..(49): Xaa is any aa, unknown, or other
MWRRRSEGPGLGGGPTRSSGCGLLCALQGKRGGVLKRPGEQAPEPAPGXPPISIPPQGGGGDLEVPARGRHSVK

SEQ ID NO: 29017 - DNA, 825 bp, Zea mays
  misc_feature: Ceres CLONE 1403477-F
  misc_feature: Encodes the peptide sequence at SEQ ID NO. 29018
  misc_feature (825)..(825): n is a, c, t, g, unknown, or other
aaagctggagctccccgcggtggcggccgctctagaactagtggatcccccgggctgcaggaattcgcacgagaccattacctagaacatcctaatcgaaaaagcagagggccatcttctactcttctctcccagccaacccccttgtccaacggttcagcctgctcaattttagtgaccagttacggcaaatgcagccctcggcggacagcaggaagaagaagcggcggcggcggaggaggaggaagctggcggcatgctactcatcgagacctgctgccggcgccgctcaagcccagggtcagtgcggctccctctacccccggtggcggggggtggaagcggcaacccctcgtggaaagaaacacccgcgcggcgttcctcgaggctgcccccaggttacgcccgccctcctcttggcctggcgcccccgaacgggcggccggttacattctcgggaaacccaagacaataaggctggacgggttcgattccttccgctccggagtctgggcgccttccctctcatggtactttcccctttgagccattccttctccccacaggggggccccccggggggggggactcgccccccctcaaggagatgaggcgaacgcaccccccgccccccccctcctgcataaaaggaatttacccctaggaacccccccgtgggggccgtttcctttgtgacgaacgccccgggagaggggagcacaccccctgtctaccttggcgggcaggggcgcgccccgaccacaaacataacccctgcgtctctgcgacacaccccccctctcctccttcgcgggagcacgatan

SEQ ID NO: 29018 - protein, 139 aa, Zea mays
  misc_feature: Ceres CLONE 1403477-F
MQPSADSRKKKRRRRRRRKLAACYSSRPAAGAAQAQGQCGSLYPRWRGVEAATPRGKKHPRGVPRGCPQVTPALLLAWRPRTGGRLHSRETQDNKAGRVRFLPLRSLGAFPLMVLSPLSHSFSPQGGPPGGGTRPPSRR

SEQ ID NO: 29019 - DNA, 689 bp, Zea mays
  misc_feature: Ceres CLONE 1403479-F
  misc_feature: Encodes the peptide sequence at SEQ ID NO. 29020
  misc_feature (316)..(316): n is a, c, t, g, unknown, or other
  misc_feature (408)..(408): n is a, c, t, g, unknown, or other
aagctggagctccccgcggtggcggccgctctagaactagtggatcccccgggctgcaggaattcgcacgagaccattacctagaacatcctaatcgaaaaattccgcgccgcatctgggaaggtctcgtcttgctcgcctccgtccgtcgccgcaccctgcgtcgtcgccatggccacgacgcagggtgcggcggcggccggagtgttcgtctcttgctccgccgggaactccggcccatccggatccaccgtctcaaactccgctccgtgggtcgccaccgtcggcgccgggacactggaccgcgacttcccgncatacgtgatgctcccccacgggtgcgcgcctggccggcgtgtcccctctacgcggggccttctcccttcccaggcccggcatgggtccggntctctacgggagggggggggacacgccagaaactctgcctctccgggacgctcgaccgggccgcgtggggggaaaaaaattttggtggaacggggggtcaaaccgcgggtgaaaaagggccccctcctagaagcgggccggcgggccccggatatgaaattgggaaaaccggaacccaggggaaaaggatttcggggggggaaacccccctgttctccccccgggggggcgtgtgggcccccccccgtgggggccaaaaaaataaacggggaaagccgggg

SEQ ID NO: 29020 - protein, 172 aa, Zea mays
  misc_feature: Ceres CLONE 1403479-F
  misc_feature: SWISSPROT Homolog: EC 3.4.21.25 Cucumisin
  misc_feature (49)..(49): Xaa is any aa, unknown, or other
MATTQGAAAAGVFVSCSAGNSGPSGSTVSNSAPWVATVGAGTLDRDFPXYVMLPHGCAPGRRVPSTRGLLPSQARHGSGSLREGGGHARNSASPGRSTGPRGGKKILVERGVKPRVKKGPLLEAGRRAPDMKLGKPEPRGKGFRGGKPPCSPPGGACGPPPVGAKKINGESR

SEQ ID NO: 29021 - DNA, 875 bp, Zea mays
  misc_feature: Ceres CLONE 1403480-F
  misc_feature: Encodes the peptide sequence at SEQ ID NO. 29022
  misc_feature (5)..(5): n is a, c, t, g, unknown, or other
  misc_feature (6)..(6): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
gtgtnnccccccccccccnnnnnnnnnncnnnacnnnnccccctcnnnnacaaagctggagctccaccgcggtggcggccgctctagaactagtggatcccccgggctgcaggaattcgcacgagaccattacctagaacatcctaatcgaaaactccttcattcctctccctctctctctcgtcggtgggaccgtgggatacgctgacggacggacgggctgaggcaaggccgcctgcgggcgggaggaagaaaagcgaagctgctgcgccctcccctcccccatctgcggcccccgcctcacccacaagatgagagagcgagcgcagttcggccgccggtcgcgtccgacttcagaaaagccgagggcccaccccctcaccctattaccttcctctcgggtccaattccggcgcccgggctggctcccggacggttttccgccctttttcccctccactcgaaccgacggaccggttcggtcccaccaacggggaatccagggaggcggacccctcccctcggggcctgggtcgaccgatcggaaccgggcccgcccgatccggccccacggaaaggaatggtcccagggcctccggggggaagcccggccgtgggtccttcggggagaaccctggccccaagggggggaggaaataacaccggaacccgcggggcggggttccggggggcccgttgggggcggctcccggggagcggcccccgggggccgcgacgggagcgaagcaaacgcagggggggtggggggaaaaacccccgatagccgccccctctgggtataaaatggtggcacgcccctcacaagagggggagattccctcgcgcgggggccaaacaacctccctccctttatc

SEQ ID NO: 29022 - protein, 67 aa, Zea mays
  misc_feature: Ceres CLONE 1403480-F
MVPGPPGGSPAVGPSGRTLAPRGGGNNTGTRGAGFRGARWGRLPGSGPRGPRRERSKRRGGGGKNPR

SEQ ID NO: 29023 - DNA, 678 bp, Zea mays
  misc_feature: Ceres CLONE 1403483-F
  misc_feature: Encodes the peptide sequence at SEQ ID NO. 29024
  misc_feature (439)..(439): n is a, c, t, g, unknown, or other
  misc_feature (450)..(450): n is a, c, t, g, unknown, or other
tggagctcaccgcggtggcggccgctctagaactagtggatcccccgggctgcaggaattcgcacgagaccattacctagaacatcctaatcgaaaagtttccaagaggagaatgtttctctcccttgcccagtcgcctgcctgcgccgtcgtctccttcccatggaggtcctcgtcccaactcatcccacgggtcccctcccgctgcaccctcgcatgccacgcagcggtgcccaaagtgcccctccccatcgcctcgccggcctccctcggggacgaccctagcaagtgggaccccgccgagtgcgacgctctcctccgcggcggggagcaggtcgcctccgtgctgcaggagatggtcacgctgatggaggacatggagatggatggtgcatttgagcaggttgctgtggagctggtggcacaaggagttattgtngagaagggtgnatgagaatgaaatcaggttttccttatgcgacttgcatacatgatacaacttgcacagaaggacacagatgatgagcgtaagtctattcttgacggaacttaaccagacggcgctagaccatctgaacgaaaaattgacctcaacatgtccagactgctgacacgactcagacaaattggaaagaaaataaaactaatctggtttggttggcccccattattcttgaa

SEQ ID NO: 29024 - protein, 112 aa, Zea mays
  misc_feature: Ceres CLONE 1403483-F
MFLSLAQSPACAVVSFPWRSSSQLIPRVPSRCTLACHAAVPKVPLPIASPASLGDDPSKWDPAECDALLRGGEQVASVLQEMVTLMEDMEMDGAFEQVAVELVAQGVIVEKG

SEQ ID NO: 29025 - DNA, 669 bp, Zea mays
  misc_feature: Ceres CLONE 1403485-F
  misc_feature: Encodes the peptide sequence at SEQ ID NO. 29026
  misc_feature (581)..(581): n is a, c, t, g, unknown, or other
ggagctccccgcggtggcggccgctctagaactagtggatcccccgggctgcaggaattcgcacgagaccattacctagaacatcctaattgaaaaacatcgatcagtcgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaagtgatgcgcgtcggcatgatcgaccagatcaagcgcgagatctccgtcatgcgcctcgtccgccaccccaacgtcgtgcagctgcacgaggtgatgggcagcaagagcagatatacttcgccatggagtacgtccggggcggngagctctttcgccgcgtcgcccgcggcggctcaaggagacgccgcgagaaggacttccacagctcgtcggcgcgtcgattctggcaca

SEQ ID NO: 29026 - protein, 124 aa, Zea mays
  misc_feature: Ceres CLONE 1403485-F
  misc_feature: SWISSPROT Homolog: EC 2.7.11.1 Non-specific serine/threonine protein kinase
  misc_feature (95)..(95): Xaa is any aa, unknown, or other
MEKKPTILMNRYELGRTLGQGTFAKVYHGRNLASGESVAIKVIDKEKVMRVGMIDQIKREISVMRLVRHPNVVQLHEVMGSKSRYTSPWSTSGAXSSFAASPAAAQGDAARRTSTARRRVDSGT

SEQ ID NO: 29027 - DNA, 659 bp, Zea mays
  misc_feature: Ceres CLONE 1403490-F
  misc_feature: Encodes the peptide sequence at SEQ ID NO. 29028
  misc_feature (355)..(355): n is a, c, t, g, unknown, or other
  misc_feature (425)..(425): n is a, c, t, g, unknown, or other
  misc_feature (426)..(426): n is a, c, t, g, unknown, or other
  misc_feature (439)..(439): n is a, c, t, g, unknown, or other
  misc_feature (440)..(440): n is a, c, t, g, unknown, or other
  misc_feature (452)..(452): n is a, c, t, g, unknown, or other
cgctctcgaacacgaggatcccccgggctgcaggaattcgcacgagaccattacctagaacatcctaatcgaaaaagttcgccaccatcgtgctccgtacacgctccgctccggccatgggcgccgccgcggcctccttttcggccctgccgttccttctacttttgctgctggtgccgtcgctcgacggcgcctccaatgtgacgtacgaccaccgctccctcatcatctccggccgccgccgcctcgtcatctccacctccatccactacccccgcagcgtcccccgagatgggccccaagctggtggctgaagccaaggacggcgggcgccgactgcatcgagacctacgtncttctggaacggccatgagatcgccccaggccagacctacttcgagggaccggtttgaccctggtgcggnntccgtgaaggtcnnttagagacgctngggctgctcttgatccctgcgcaccgggccctatggtcgccgccgagtggaattaatggagccgtgccccgttgtgtttgcactacgtggcaaggaacgggttttcaggacaaacaacgagcccattcagaaccatatgaagagtttcacaacatacattcggggatatgatgaaaaaaagagcagcttcttcgctttctcagggag

SEQ ID NO: 29028 - protein, 65 aa, Zea mays
  misc_feature: Ceres CLONE 1403490-F
  misc_feature: SWISSPROT Homolog: EC 3.2.1.23 Beta-galactosidase
MGAAAASFSALPFLLLLLLVPSLDGASNVTYDHRSLIISGRRRLVISTSIHYPRSVPRDGPQAGG

SEQ ID NO: 29029 - DNA, 571 bp, Zea mays
  misc_feature: Ceres CLONE 1403492-F
  misc_feature (11)..(11): n is a, c, t, g, unknown, or other
  misc_feature (253)..(253): n is a, c, t, g, unknown, or other
  misc_feature (287)..(287): n is a, c, t, g, unknown, or other
  misc_feature (288)..(288): n is a, c, t, g, unknown, or other
  misc_feature (301)..(301): n is a, c, t, g, unknown, or other
  misc_feature (345)..(345): n is a, c, t, g, unknown, or other
tccaccgcggntgggcggccgcttctagaactagtggatcccccgggctgcaggaattcgcacgagacattacctagaacatcctaatcgaaaaacacacggaagaagccactagctctccgctctcgcctctcggccttctccttgtgccgccgaacaccctcacaagagtcggcctctcgatttctcagtccagccgcagcagcccccttccctccctcctcatcagggtgtgcctcccgcagatcaagtncgaattcgtccttcgtccccaaccaccaatccgnntgcattcttgggnttgctcacgcgcaaacaaagcattttactgctgggaatggtggntgccactaacggttccggttcttgagggacccccaagcctttggatggtaccgggaaattaatttgtgggggaaagcaagaacccaaaggatacacgggttgaaaaaacttttcccaaacctttggcccaattttccaaaactgggcggtggagaggggcccccccccccccccgcggggggaacacccctcgggggccctgttttcccccccccccctggtgggg

SEQ ID NO: 29030 - DNA, 761 bp, Zea mays
  misc_feature: Ceres CLONE 1403494-F
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (41)..(41): n is a, c, t, g, unknown, or other
  misc_feature (43)..(43): n is a, c, t, g, unknown, or other
  misc_feature (44)..(44): n is a, c, t, g, unknown, or other
ncccccccccnnnnnnnnnnncacaccggcggnnnttggantnntcaaagctggagctccccgcggtggcggccgctctagaactagtggatcccccgggctgcaggaattcgcacgagaccattacctagaacatcctaatcgaaaactttcccttccgcgcctccctcgtcttcttctcgtctccactccccctctcccaagtcccacccgccgctcccgccccccgtgcgctcgccgacacggtcagtagttccactcggagaaaggaacgcttccccctgcctgtctcgccggatccgttgccccgcttcagtttcgcccgccgctttcactttcgctttcactcgatttagattccatttccgttcgttcgttcctgtttcccttgctcgttcgttcgattggagctagcctccgcctggatctggcctagccgagccccgccggctctgaatcccgattcggttcggctcccttgctctgcggtcgcttccgaggcgtgctcggatctcgtcggagtagagggcctcgcggctcgcttcgggggcgagatggatcatgtggtcgggggcaagttcaagctcggcaagaagatcgggagggggatcgttcggggagctctttcctccccgggaatgtgcagaccgggggagggaggtccgccggccaggcttgaaaaatggcaaagacaaagcaccccgcaagtttccattaacgaggtcccaggttaaaccatggctttcccccaggggaggaaa

SEQ ID NO: 29031 - DNA, 661 bp, Zea mays
  misc_feature: Ceres CLONE 1403495-F
  misc_feature: Encodes the peptide sequence at SEQ ID NO. 29032
  misc_feature (661)..(661): n is a, c, t, g, unknown, or other
tggagctccccgcggtggcggccgctctataactagtggatcccccgggctgcaggaattcgcacgagaccattacctagaacatcctaatcgaaaacttcccctctctcgcccctcctccctccgtctcgtctcccaggtcatggcaaaagctggagcaccgggaaaaataacaagtgggagataaacaggaagagctaggtgaatacttgagagaaaaaggtcccccacaccccccacgcaggtgaatactacaagtagcagtacaaggaagagagccaatctgcccgtgactgtcagtgagttgctcgggtgtggtggttagttgaggtcacgatgatgggaggcgggctgatgatggatcagagcgctgttccctggcgtccacaacttcgtggatctcctgcagcagaacggcgacaagaacctgggcttcgcctcctcatggccgcagacgtcctccggcgaccagtgcgtgattggccgcagggttgatctctcgtactcaccgtcagacagcttcccgtgacgtcgtggaggacggacagggatgactaacgatgaggatatccgagggaattggaagtcgccccattgtgctgcgaaccgcatgaaatctgaaacgggttccaggatacctgcacccaaagcccccggaaan

SEQ ID NO: 29032 - protein, 52 aa, Zea mays
  misc_feature: Ceres CLONE 1403495-F
MMGGGLMMDQSAVPWRPQLRGSPAAERRQEPGLRLLMAADVLRRPVRDWPQG

SEQ ID NO: 29033 - DNA, 696 bp, Zea mays
  misc_feature: Ceres CLONE 1403501-F
  misc_feature: Encodes the peptide sequence at SEQ ID NO. 29034
aaagctggagctccccgcggtggcggccgctctagaactagtggatcccccgggctgcaggaattcgcacgagaccattacctagaacatcctaatcaaaaaaattcatcttcttcgtcttcatcgcagcatcggcgctccatcttctgctccctcccccacttcgtgctcgggttccatcttccgctccttcccccactcgcggtcggcacgcaggctcggccggcgtcagcggctccccatcccgccagtacaggaagagggccgccgcttggagctcgcgggaggtagcgtcgccgccgccgcatgaaggtcccgaatggctgaatcctgaccgctgcctggagagtctcgcgcctaaatcacatcatattgagctttctcgcctttggatccgtcttattattggctcacactggaagaatagtttgcactttggaggaaaatgagtggtgctcccaaagaggtgctccgagaaagtagtcactccacaccaacaaaacgccctttggatgacagcagcttgtattcgagtcctgggaaaattattcagtccgggggcagggatttccatgggtcctctggacatgatgggtagatttgcgaaatttcaacgtgggggagtctcgggatgataaaaggcatctggacatcggatgcctggtgggtccactaaactttgctggttcacccatt

SEQ ID NO: 29034 - protein, 50 aa, Zea mays
  misc_feature: Ceres CLONE 1403501-F
MSGAPKEVLRESSHSTPTKRPLDDSSLYSSPGKIIQSGGRDFHGSSGHDG

SEQ ID NO: 29035 - DNA, 668 bp, Zea mays
  misc_feature: Ceres CLONE 1403502-F
  misc_feature: Encodes the peptide sequence at SEQ ID NO. 29036
  misc_feature (386)..(386): n is a, c, t, g, unknown, or other
aagctggagctccccgcggtggcggccgctctagaactagtggatcccccgggctgcaggaattcgcacgagaccattacctagaacatcctaatcgaaaaccaaaaagcccaatcttttactcgagctcttttcttcctttctttgtcccggtgcggcatgtgctcgcgtgccgtcaagagcggcggaagctcggcggagttcacgaacgagtgctcccacgccttccacttcccctgcatcgcagcccacgcgcgctcctcctccgccaaaggcgttctgtcctgccccgtctgcgcctcgccgaggcgccaggagcccttcctcgcctccctccgcctccactgctccttccacgacgagagcaccgagcgaggacgcgacgnccgtcaagacgccacctcccgcaaagctacaccaagacgacgacccgctgctaggcccaaaggccgcggccaaggctgtacgattgcacacgatccgggaggccgaaaagggacgacagtaccgagaggcggccgccgttatcacggttttcgtccactgccccaggactaaaacacactcggaccgggaaattcccggcgcaacccaaaggctaactcctagcgtccggtcccctgctcttataacgcgctggggctccgccaaaatctaaatgctctctg

SEQ ID NO: 29036 - protein, 132 aa, Zea mays
  misc_feature: Ceres CLONE 1403502-F
  misc_feature (7)..(46): Pfam Name: zf-C3HC4 Pfam Description: Zinc finger, C3HC4 type (RING finger)
  misc_feature (76)..(76): Xaa is any aa, unknown, or other
MCSRAVKSGGSSAEFTNECSHAFHFPCIAAHARSSSAKGVLSCPVCASPRRQEPFLASLRLHCSFHDESTERGRDXRQDATSRKATPRRRPAARPKGRGQGCTIAHDPGGRKGTTVPRGGRRYHGFRPLPQD

SEQ ID NO: 29037 - DNA, 634 bp, Zea mays
  misc_feature: Ceres CLONE 1403503-F
  misc_feature (133)..(133): n is a, c, t, g, unknown, or other
  misc_feature (248)..(248): n is a, c, t, g, unknown, or other
tggagctcaccgcggtggcggccgctctagaactagtggatcccccgggctgcaggaattcgcacgagaccattacctagaacatcctaatcgaaaaacgccgcgctcgcggtgctgcctcccgggctcccgnttcagcattccaggctcgcatcgcacagcctggccccgcccgctccgacccttctcggcgacactcctcgtaggctcgtactggcacgtccccgctctgtcttctgcccacaagnaacagggggtcacgctttccaagggttcaaactctcgcggggcaagcatggggggggcggggccccgaaactttggaaatttccataaccgggggggtttggtgccccctccccccccaaaataatggggataaaccgccaagaaggggaaaaaaaccctctccgccccccgttttttgggacccccacccaggggccggggagattcgtgtatttagtagaatacatcctctcgttgaacggaagagagtgtagatgacgtgccagggtgattgatcaacacgtatcatacgcaactacgaagcgactgcttccaatgcctccgctcctccacgtcagagtcatatactgtgtgtgcaaacaactaccactccacacgataaaaa

SEQ ID NO: 29038 - DNA, 690 bp, Zea mays
  misc_feature: Ceres CLONE 1403504-F
  misc_feature: Encodes the peptide sequence at SEQ ID NO. 29039
  misc_feature (358)..(358): n is a, c, t, g, unknown, or other
  misc_feature (359)..(359): n is a, c, t, g, unknown, or other
  misc_feature (480)..(480): n is a, c, t, g, unknown, or other
  misc_feature (574)..(574): n is a, c, t, g, unknown, or other
  misc_feature (611)..(611): n is a, c, t, g, unknown, or other
aaagctggagctccccgcggtggcggccgctctagaactagtggatcccccgggctgcaggaattcgcacgagaccattacctagaacatcctaatcgaaaagaggatatgtttccctcaccttcgaccaccactaacctctgcatccgcatctctctctctcgcgcgcgccgcccttcccagcgccgtcggctgccgctcctcccctccaccgccgcctctgctccgcccgtcctcgcgccgtcgcgaccgctgcggcttcgtctctccccattgtctgtcccctctcaacgcactctacgacggaccgatgacttgacggatctgggggtttgtctagggtgggtgaacggaaggnngatggagtcacggagtcgttcaagcagacgggcccgtgctccttctcccccgactcgcgcttccttgctatggccgtagactaccgcctcgtcgtccgcgacgtactctcactgaaggtgntacaattattttcatgcgtggacaagataagctctgtagaatgggcaccagattcagaatatattttatgtggactttacaagcgacccatggntgcagcttggtcattgacccaaccctgatggacctgncagattgatgaaggtccagcagggattgcatatgctcgctggagtcctgacagtcgcatatattaactacatctgagtt

SEQ ID NO: 29039 - protein, 57 aa, Zea mays
  misc_feature: Ceres CLONE 1403504-F
  misc_feature (18)..(18): Xaa is any aa, unknown, or other
  misc_feature (49)..(49): Xaa is any aa, unknown, or other
MAVDYRLVVRDVLSLKVXQLFSCVDKISSVEWAPDSEYILCGLYKRPMXAAWSLTQP

SEQ ID NO: 29040 - DNA, 651 bp, Zea mays
  misc_feature: Ceres CLONE 1403505-F
  misc_feature: Encodes the peptide sequence at SEQ ID NO. 29041
  misc_feature (286)..(286): n is a, c, t, g, unknown, or other
  misc_feature (329)..(329): n is a, c, t, g, unknown, or other
gctctagaactagtggatcccccgggctgcaggaattcgcacgagaccattacctagaacatcctaatcaaaaactctctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcnaggttcgagagtctcactgacaagagcaagctcgatgcgcagnctgagcttttcatccaccttgtcccagacaaggccacgaacacgctctccatcatcgacagcggcatcggcatgaacaagtccgaacttgtcaacaacctcggaccatcccccaggtccggaaccagggagttcatggaagcccttgctgccggcgctgagtggtcctggattggccacgttcggggggtcggtttctactcgtgctacctcggtcgccaaataaaagttggcggtgacccaccaggcccaaccgatgcacaaacagaacatggggggaagtcccccagcgggggggggactccttccacggggatacccgg

SEQ ID NO: 29041 - protein, 127 aa, Zea mays
  misc_feature: Ceres CLONE 1403505-F
  misc_feature (21)..(21): Xaa is any aa, unknown, or other
MRWTRSRFESLTDKSKLDAQXELFIHLVPDKATNTLSIIDSGIGMNKSELVNNLGPSPRSGTREFMEALAAGAEWSWIGHVRGVGFYSCYLGRQIKVGGDPPGPTDAQTEHGGKSPSGGGTPSTGIP

SEQ ID NO: 29042 - DNA, 662 bp, Zea mays
  misc_feature: Ceres CLONE 1403506-F
  misc_feature: Encodes the peptide sequence at SEQ ID NO. 29043
  misc_feature (172)..(172): n is a, c, t, g, unknown, or other
  misc_feature (227)..(227): n is a, c, t, g, unknown, or other
  misc_feature (416)..(416): n is a, c, t, g, unknown, or other
aagctggagctccccgcggtggcggccgctctagaactagtggatcccccgggctgcaggaattcgcagagaccattacctagaacatcctaattgaaaagctgtcttatcccttcgtccacgctccctgcagccgccgcccaaaccctagcaatccgtcctccgccatggncgacgaccactactcctctaagaggagtacgacgacccctcgccgccgccgcggngcacggggttctcttcgggcccgccgcctgcctcgccgctcgcgggcggcgccccgtcgtacacagcgtgccaccgccccccgatgagatccagctcgcgaagcagcgcgcgcaggagatcgcggcgcggatctttaacgccgcagaggccaagcgtcctcgcgtcgacaacggcgacgatgacagcgncggcttcggtgtaagcctgggcagcactggtggcggtgccgcatcgggcggcggagactcggcttctcgtcctctgccggtggtgggcacggggcttctatcccacaattatctcctcagagcagcgcacctcagtactcctcttatggtgggatatcggggtacaagcaaaaagatggaatttccaaatggaagggtttggtgttatcatttgaaaagcccgggaaacctatatgtaattcccca

SEQ ID NO: 29043 - protein, 33 aa, Zea mays
  misc_feature: Ceres CLONE 1403506-F
MVGYRGTSKKMEFPNGRVWCYHLKSPGNLYVIP

SEQ ID NO: 29044 - DNA, 651 bp, Zea mays
  misc_feature: Ceres CLONE 1403508-F
  misc_feature: Encodes the peptide sequence at SEQ ID NO. 29045
cgcggtggcggccgctctagaactagtggatcccccgggctgcaggaattcgcacgagaccattacctagaacatcctaatcgaaaaccaaaaagcccaatcttttactcgtgctcttttcttcctttctttgtcccggtgcgccgtgtgctcgcgtgtcgtcaagagcgacgacagctcggcggagttcacgaccgagtgctcccacgccttccacttcccctgaatcgcagtccacgcgcgctcctcctccgccaacggagttctgtcctgccccgtctgcgcctcgcagtgacgccaggaacccttcctctgctccctaccgctgcactgctcgttccacgacgaaagccccgatgagggaggtgacggacgcaatactccgtcgcgcgtcatgctataccacgacgacgatcctctgcgtgcgccaatggcgagggcaaaggaggtggctccacccgatgccgaggtcccagtaggatgacaataaggaaaaggggccccctgttcaaaggttttttcgctaccccaagacctaagactgctgggcctggggcctaatctaagaacccgaattcaggccttattactgcaaaaaagcgctcaagggactttggggggggggaaaaacattgaattccgaactttgtg

SEQ ID NO: 29045 - protein, 29 aa, Zea mays
  misc_feature: Ceres CLONE 1403508-F
MLYHDDDPLRAPMARAKEVAPPDAEVPVG

SEQ ID NO: 29046 - DNA, 644 bp, Zea mays
  misc_feature: Ceres CLONE 1403509-F
gcggtggcggccgctctagaatagtggatcccccgggctgcaggaattcgcacgagaccattacctagaacatcctaatcgaaaaatgctgggaccgcgggtgtgggatagggacggatgacaaagcaagagcagaaaaaagaactttcaccatcctccctatcaatacaagattcatctacacaaattataatatactccgtgcgaaggaaagatcaaattagagattcattcgatcaattctgattgtttccttccattccaaaccaccttcaattctgatttctgcgggtggtgggatatcgtccccccttgccattccaaatcctcctctgcaattttctcatggcagctgacgtttccatccccactcgatccgcgtcaccgcccgctatttcctcctagttctagtcccctctcttctgggcggaatcatcttttttcctcgggcacttccctgttgtggtggttggcgggaaaaatcaatccccgcaaaggtccaaaaggatacaaaaatttttgacaaagggttagccccaaaagagaaaaaccactttccccccttggttttttttggaggattcgccccggggccacgggggagatttccaaggggggaccccggggaaaacaccaactttttg

SEQ ID NO: 29047 - DNA, 664 bp, Zea mays
  misc_feature: Ceres CLONE 1403514-F
  misc_feature: Encodes the peptide sequence at SEQ ID NO. 29048
  misc_feature (334)..(334): n is a, c, t, g, unknown, or other
  misc_feature (373)..(373): n is a, c, t, g, unknown, or other
  misc_feature (374)..(374): n is a, c, t, g, unknown, or other
  misc_feature (469)..(469): n is a, c, t, g, unknown, or other
  misc_feature (511)..(511): n is a, c, t, g, unknown, or other
  misc_feature (526)..(526): n is a, c, t, g, unknown, or other
  misc_feature (570)..(570): n is a, c, t, g, unknown, or other
gctctagaactagtggatcccccgggctgcaggaattcgcacgagaccattacctagaacatcctaatcgaaaaactccgtcttcctcctgtaaccagatctgaacccgcggcgacagaaacaaacgctcgctcgctcgttcgttgtccgttcattgtcttcgccggcgccgagggaccctgagagggcaggcgggcgagatggcgggcggcggcgttgaggacgtgtacggcgaggaccgcgctaccgaggagcagctgatcacgccgtgggccttctccgtcgcaagcggctacaccctgctgcgcgacccgcggcacaacaagggcctggncttctcggaggcggagcgcgacgcgcactaccctccggnngctgctgccgccggcgctggcgtcgcaggagctgcaggagaagaagctcatgcagaacctgcgccggtacgagcagccgctgcaccgctacatcngcatgatggacctggcaggagcgcacgagaggctcttctacnagctcctcatcgacnacgtcgaggagctgctccccgtcgtctacacgccccacgtcggngaggcatgccagaagtacggcagcatctaccgccgcccgcaggggctgtacatcagcctcagggacaagggcaagatcctcgaggtgctcagga

SEQ ID NO: 29048 - protein, 80 aa, Zea mays
  misc_feature: Ceres CLONE 1403514-F
  misc_feature (21)..(80): Pfam Name: malic Pfam Description: Malic enzyme, N-terminal domain
  misc_feature: SWISSPROT Homolog: EC 1.1.1.40 Malate dehydrogenase (oxaloacetate-decarboxylating) (NADP(+))
  misc_feature (16)..(16): Xaa is any aa, unknown, or other
  misc_feature (30)..(30): Xaa is any aa, unknown, or other
  misc_feature (35)..(35): Xaa is any aa, unknown, or other
MQNLRRYEQPLHRYIXMMDLAGAHERLFYXLLIDXVEELLPVVYTPHVGEACQKYGSIYRRPQGLYISLRDKGKILEVLR

SEQ ID NO: 29049 - DNA, 644 bp, Zea mays
  misc_feature: Ceres CLONE 1403517-F
  misc_feature: Encodes the peptide sequence at SEQ ID NO. 29050
  misc_feature (206)..(206): n is a, c, t, g, unknown, or other
  misc_feature (226)..(226): n is a, c, t, g, unknown, or other
  misc_feature (349)..(349): n is a, c, t, g, unknown, or other
  misc_feature (371)..(371): n is a, c, t, g, unknown, or other
  misc_feature (388)..(388): n is a, c, t, g, unknown, or other
ggagctccccgcggtggcggccgctctagaactagtggatcccccgggctgcaggaattcgcacgagaccattacctagaacatcctaatcaaaaaattaatttccagggatgcacgcaggcaagtttaatttggaggatcaatggtagctagctagagctactagagacatacatggcggatcctctggtgcgagcgcgacccanaaggaagaaggtcttagcgnactacttggtgcgactccgatggattcctgccctcttcgtggccttccaatatctgcgctgatctacctgagcgtcttcctggggaacacgtggtcccgcatgaaatccgagaagcgtcgacngagggaacacaggagaacgtanagggcttgaaaaggtcntgaaacgtccaaggagagggacccaaaaaaggacggcctcctctgcaccccaagaaaccatgggtggggccgggccttgcgaaacggggatacaagggcgcccaaactttttaagggcaacccttcccccggtgagagaaatcccccaaaaacccccggggaaaaaagtgccccccaggggaagattcctcctccaggatgggcccaaaaaacaaaggggacctcgccccccaaaaccctccgtctcgcggggggg

SEQ ID NO: 29050 - protein, 44 aa, Zea mays
  misc_feature: Ceres CLONE 1403517-F
  misc_feature (35)..(35): Xaa is any aa, unknown, or other
  misc_feature (42)..(42): Xaa is any aa, unknown, or other
MDSCPLRGLPISALIYLSVFLGNTWSRMKSEKRRXREHRRTXRA

SEQ ID NO: 29051 - DNA, 651 bp, Zea mays
  misc_feature: Ceres CLONE 1403520-F
  misc_feature (330)..(330): n is a, c, t, g, unknown, or other
  misc_feature (389)..(389): n is a, c, t, g, unknown, or other
  misc_feature (410)..(410): n is a, c, t, g, unknown, or other
  misc_feature (461)..(461): n is a, c, t, g, unknown, or other
caccgcggtggcggccgctctagaactagtggatcccccgggctgcaggaattcgcacgagaccattacctagaacatcctaatcaaaaaaaattcatcttcttcgtcttcatcgcagcatcggcgctccatcttctgctccctcccccacttcgtgctcgggttccatcttccgctccttcccccactcgcggtcggcacgcaggctcggccggcgtcagcggctccccatcccgccagtacaggaagagggccgccgcttggagctcgcgggaggtagcgtcgccgccgcccgcatggaggtcccgaatggctgaatcctgaccgctngcctggagagtctcgcgcctaaatcacatcatattgagcttctcgccctttggatccgntcttattatttgctcacactngaagaattagtttgcactttggagaaaaaatgagtgggctcccaaagaggntgctcgaaggaaggtagtcactccacaccaacaaaacgcccctttggatgacagcagctttgtattcgagtcctggaaaatttattccagcccgggggggagggaatttcccatggttcttctggccatggatggaaaatttgcgaaatttccaagggggtgaagtctcgggggagaaaagaaggccatc

SEQ ID NO: 29052 - DNA, 669 bp, Zea mays
  misc_feature: Ceres CLONE 1403523-F
  misc_feature (669)..(669): n is a, c, t, g, unknown, or other
acccgcggtggcggccgctctagaactagtggatcccccgggctgcaggaattcgcacgagaccattacctagaacatcctaatcgaaaaatcttcgccgccgctaaacgttccccccacgccccaacctatccacgcgaaaccttctttcccccgggagacgattcgtcagggagaggaaagaggcagaggggccatggacgctgccaagttggtgacgccggtcgctgtgtctcacattctggcgcaaccgtcggcgggctcccaaggcgcaaggaccgatctcgtccgttcagggcctccacctggagtcccgccgggaaggggaagcccggttccattttcccgggaacgggggcgggaaggagaaaaaattaggggagttgtttccccccccaattttgggggggaaaggagcccccttggtaaaaccgtagaaaaaccgggggggccaccccgaaaatcgccaaaaaacctttggaaaggccgccctaaggggaaaaaggagaaaaaattttgtgtggtcgcacaaaagggtaaaaatttgggggcaaaaaggtgtgtggtcaccccaattatacaatacgtggggcgcccaaaacacagtgcccccccctagggctcgcgcgaccctccgatgaggaatgggaatgggcgccgccccccccn

SEQ ID NO: 29053 - DNA, 669 bp, Zea mays
  misc_feature: Ceres CLONE 1403524-F
  misc_feature: Pfam Name: HCO3_cotransp Pfam Description: HCO3- transporter family
  misc_feature (251)..(251): n is a, c, t, g, unknown, or other
  misc_feature (487)..(487): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
tggagctccccgcggtggcggccgctctagaactagtggatcccccgggctgcaggaattcgcacgagaccattacctagaacatcctaatcgaaaagtagcggttacctccctttcgctctactgctctctctctctctctggaccttgccgttctctccctcgtcggcaatcagcccgcttcctgtgctctctatgctccccttccgttcgtagcctcggccttcgtctccctccatggacccgcgctnaatgcatcgcgagattccaaaccggtagcgtttcttcctgctccatccgccgcaagatgtaagcaggggcctcacttcacacccggagtgggagaccatccagaatacatcctcagatcttcttgtgtctgagaaaaaagcgacgccctttcatgggagagagcttcgtgcccttgcggggcatcaagaacgaccctcacgggaggcttcgctgctacaagcaggactgggccggnagggtcccctgccggaatcaggatcctggggcccgacgacctaattattttttcggtccgggataccgttcttatcgccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29054 - DNA, 760 bp, Zea mays
  misc_feature: Ceres CLONE 1403526-F
  misc_feature: Encodes the peptide sequence at SEQ ID NO. 29055
  misc_feature (1)..(1): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (49)..(49): n is a, c, t, g, unknown, or other
  misc_feature (52)..(52): n is a, c, t, g, unknown, or other
  misc_feature (569)..(569): n is a, c, t, g, unknown, or other
  misc_feature (571)..(571): n is a, c, t, g, unknown, or other
  misc_feature (600)..(600): n is a, c, t, g, unknown, or other
nttttttccccccnnnnnnnnattttttccggggtcttttcccgtattnttntcaaagtggagctccccgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttggtccagacaagggcacgaacacgctctccatcatcgacagcggcatcggcatgaccaagtccgaccttgtcaaacaacctcggtaccaatcccccgggcccgggaaacgaagaagtcctgggaaagccccttgctgcccgngnccttgatggtgtccatccagatgccccgntttccggcggtcgggtttctaactctggcctaacctcgtcccccccaaaaaaagaggtgggccgggacccccccaggcaccaacgatggacccaccccagtccccgggggggggaagttccccaaggggcggggcgggggtccgtatccaccttggttaa

SEQ ID NO: 29055 - protein, 117 aa, Zea mays
  misc_feature: Ceres CLONE 1403526-F
  misc_feature (116)..(116): Xaa is any aa, unknown, or other
MASETETFAFQAEINQLLSLIINTFYSNKEIFLRELISNSSDALDKIRFESLTDKSKLDAQPELFIHLGPDKGTNTLSIIDSGIGMTKSDLVKQPRYQSPGPGKRRSPGKAPCCPXP

SEQ ID NO: 29056 - DNA, 885 bp, Zea mays
  misc_feature: Ceres CLONE 1403529-F
  misc_feature: Encodes the peptide sequence at SEQ ID NO. 29057
  misc_feature (1)..(1): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (885)..(885): n is a, c, t, g, unknown, or other
ngggaggtggccnnnnnnnannntcgaaccacagtggagagtnnnnngcaaaaggacaagctggagctccccgcggtggcggccgctctagaatagtggatcccccgggctgcaggaattcgcacgagaccattacctagaacatcctaatcaaaaccccgggccttgcgtggcgatcgagttgccaccagacaactcggctcggctcgtcgtccaccgaccctcctcctcgctccaagcttccctctccccctcctcctccgtcaggtggggagctagctagggagcggcgccggcggctgatcgagcggacagacagctgaacgagccggaaatggccggcggggcgcgccccctggttccccgcccgccctcctgggcggtggcttatgggggggggcctgcccgcccgggggttcctgggtggaaaaaaaaccaaccctgcggggtggttgggcgcccccgaaaaaccttccgggggggccaccaccaaaccgccgccccattggggaaaattttcggggggggggccccgaattaaacgggtggtggaccgcttccccacggggggggtccgtctattctttaacccggggaaaaaccaaaaaccccccaccggggggcggcccaaaccaaattttccaaaccccccaaagattctaaagggcgccaaggtccccccgcgccggccccgcggtaattcccctccctgggttctggaacgcgggggagaaaaagcttacctctccccccccccaaagagggtggtgaaaaaccctcacaacttctccgggaccccggttgtccaccctctcttattattcccccaaacaaggggggggaacaaaaaaggtcttgtttgcgcagatgggtacgcccccccgn

SEQ ID NO: 29057 - protein, 165 aa, Zea mays
  misc_feature: Ceres CLONE 1403529-F
MGGGLPARGFLGGKKTNPAGWLGAPEKPSGGATTKPPPHWGKFSGGGPRIKRVVDRFPTGGVRLFFNPGKNQKPPTGGRPKPNFPNPPKILKGAKVPPRRPRGNSPPWVLERGGEKAYLSPPPKRVVKNPHNFSGTPVVHPLLLFPQTRGGNKKGLVCADGYAPP

SEQ ID NO: 29058 - DNA, 683 bp, Zea mays
  misc_feature: Ceres CLONE 1403531-F
acccgcggtggcggccgctctagaactagtggatcccccgggctgcaggaattcgcacgagaccattacctagaacatcctaatcaaaaaggacccttgtttgcctatacactgccagcctgccttttctaagatcttcttcaatcgctccacccccacccccttctctctcgtaacaacgtttggggcgccgtcgctgccgctctactcgggagcccaggtcgtgttcggacccttcgccggcgagccagcggacactttcttggtgatgagaggataatcgcccaattattatgatggatcaccacgacattgatgatactgaggatgagtatgatatggatgatcctgttgatgacatgaaacacgagcagagaggggataggaattctgatgcgaaggaaatggataatgcataaccagaggaaaaaaacgcgagatactttctcaccacaatgcaaaaaatgggaagggaatttaaaggaaataccctggggagcagcttaagcataacccggataaaaaatttagaacgggccaggaataataacatgtccaaaaattaatgaaaaatgtaccttaacttcttggggaaaaagagctaattgaaggttttcgctagcccaacagaaaaaaggtgtggaatgggtaatttatgaatgtcagaaacaaaaaaaactttc

SEQ ID NO: 29059 - DNA, 750 bp, Zea mays
  misc_feature: Ceres CLONE 1403536-F
caaagctggagctcaccgcggtggcggccgctctagaactagtggatcccccgggctgcaggaattcgcacgagaccattacctagaacatcctaatcgaaaaaaccacgcgcgcacacgccccgtccggccgtacccgctcttcattccccactgcacacaaatactactgtgactccgtgagggagcaacaggaggaagaagcaggggggagaggggaggggaggggaggcattcgggctccttttttcttcctactgcacgagtacaggactgcgctgcctgtctctcctcgcctgctgccgacttcgcggcctcgtcgccctggcttgtccaccatggaccgaaggctacgggccctacttgggaccaccgacgacgaatacgacgaacttcataacgcaggatgaaccccgccaaggaatcgtcttcgaacaacgaatccctcggccggaggccaccaattggtaagggttagatagccgcgaatgaaatcacgggatattggcttgaaatgtatcaagggtcattgattgatccccacccttggccattagggaagggctattttaacccccggactggggggaagggttcatgggaaggccttccaatgggggacctataaaggaaggcgaaaaaaaaattaaagaatggagggcaccccctcacgcagaaatcgaaaaactaacttccagaagaacccctttggggcgcaaaatttcaagacaaacattcccctccccccgc

SEQ ID NO: 29060 - DNA, 692 bp, Zea mays
  misc_feature: Ceres CLONE 1403537-F
  misc_feature: Encodes the peptide sequence at SEQ ID NO. 29061
  misc_feature (488)..(488): n is a, c, t, g, unknown, or other
  misc_feature (512)..(512): n is a, c, t, g, unknown, or other
  misc_feature (580)..(580): n is a, c, t, g, unknown, or other
aaaagctggagctcaccgcggtggcggccgctctagaactagtggatcccccgggctgcatgaattcgcacgagaccattacctagaacatcctaatcgaaaaaaaagctgacaaccagacgcgccagggtttcaggcttccacgaatctccccgccgccctcaattcccctcggcgccgccgcctcctcccctcgcttcggtcctcggttagttaaccatccaggttctgtcaagatgtctgatagccatgagactgacaggaacattgagatttggaaaattaagaaactgatcaaggcattggaatcagccagaggcaatggcacaagcatgatctctctgatcatgcctccacgtgatcaggttgctcgagtggctaagatgttaggtgatgaatatggtactgcttcgaacatcaagagtagagttaatcgtcaatctgtggtggctggcatcacctcagctcagcagaggttgaagctctancacaaaagtgctctaaacgatggntctgtcactggaactattgtactgaagacggaagggaaagaagttactattgattttgaccattcagnctatcatggatccctctaccttggggacacaagttcccactgaggcttaaatgactctttgaatctgaggacagttggggtcatgttatgaaggaagggaccttttttggcc

SEQ ID NO: 29061 - protein, 128 aa, Zea mays
  misc_feature: Ceres CLONE 1403537-F
  misc_feature (6)..(127): Pfam Name: eRF1_1 Pfam Description: eRF1 domain 1
  misc_feature (84)..(84): Xaa is any aa, unknown, or other
  misc_feature (115)..(115): Xaa is any aa, unknown, or other
MSDSHETDRNIEIWKIKKLIKALESARGNGTSMISLIMPPRDQVARVAKMLGDEYGTASNIKSRVNRQSVVAGITSAQQRLKLXHKSALNDGSVTGTIVLKTEGKEVTIDFDHSXYHGSLYLGDTSSH

SEQ ID NO: 29062 - DNA, 713 bp, Zea mays
  misc_feature: Ceres CLONE 1403540-F
  misc_feature: Translation starting site: 183
  misc_feature: SWISSPROT Homolog: EC 2.3.1.15 Glycerol-3-phosphate O-acyltransferase
  misc_feature (619)..(619): n is a, c, t, g, unknown, or other
  misc_feature (680)..(680): n is a, c, t, g, unknown, or other
aaaagctggagctcaccgcggtggcggccgctctagaactagtggatcccccgggctgcaggaattcgcacgagaccattacctagaacatcctaatagaaaaactgccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatctagatggtggcgcgctccgtgctccccaggttctacgcgggcgacgtgcacccggagagcttggagggtgttcagctccttcggcaggcgctacgtcgtcacggccagccccagggtcatggtcgagcccttcgccagggccttcctaggcgccgacnaggtcgtcgggaccgagctggaggtcggcagggacggcaaggccacgggcttcatggccangccaggcgtgctcgtcgggacaacaagaaggaa

SEQ ID NO: 29063 - DNA, 696 bp, Zea mays
  misc_feature: Ceres CLONE 1403541-F
  misc_feature: Encodes the peptide sequence at SEQ ID NO. 29064
  misc_feature (341)..(341): n is a, c, t, g, unknown, or other
  misc_feature (384)..(384): n is a, c, t, g, unknown, or other
  misc_feature (437)..(437): n is a, c, t, g, unknown, or other
  misc_feature (508)..(508): n is a, c, t, g, unknown, or other
  misc_feature (509)..(509): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (529)..(529): n is a, c, t, g, unknown, or other
  misc_feature (532)..(532): n is a, c, t, g, unknown, or other
  misc_feature (577)..(577): n is a, c, t, g, unknown, or other
  misc_feature (587)..(587): n is a, c, t, g, unknown, or other
  misc_feature (603)..(603): n is a, c, t, g, unknown, or other
  misc_feature (627)..(627): n is a, c, t, g, unknown, or other
  misc_feature (638)..(638): n is a, c, t, g, unknown, or other
  misc_feature (667)..(667): n is a, c, t, g, unknown, or other
  misc_feature (674)..(674): n is a, c, t, g, unknown, or other
ggagctccccgcggtggcggccgctctagaactagtggatcccccgggctgcaggaattcgcacgagaccattacctagaacatcctaatcaaaaaacaacaacaacaaccatctccaacgcagcaagcagacacagggacaggcaggcagcgagtgcaaccgcgagagcgatcagcgatgggctccttcttctcgaccttagtgacgccccctccgcccgccgccgacgacccgaactgcgccgtggtggccgcgcactccaaggccacctacgacgagcagtgggcggcccacaagagcagcagcaagctgatggtgatcgacttctcggcgtcctggntgcggccctgccgcttcatcgagccggccttcaaggagctggncctccgcttcaccgatgccatcttcatcaaggtcgacgtcgacgagctcgcgnaggtcgcaaggacatggaaggtagaggcgatgccaacgttcgtgctggtcagatgaaaaaaggaaggtaanncnnnnnnaacnnnaaataanaanaaaaaccaccacccgaaaaaaaaaaaaaaaacccccccccccccnaataaaaaancacaaaaaaccccacncccaccaccaatcccaccaaaaanccacccccccnccaaaaaaaacccccccaaacaaaaaaanaccaaanccccccaataaactggcgcagg

SEQ ID NO: 29064 - protein, 104 aa, Zea mays
  misc_feature: Ceres CLONE 1403541-F
  misc_feature (23)..(105): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature (55)..(55): Xaa is any aa, unknown, or other
  misc_feature (69)..(69): Xaa is any aa, unknown, or other
  misc_feature (87)..(87): Xaa is any aa, unknown, or other
MGSFFSTLVTPPPPAADDPNCAVVAAHSKATYDEQWAAHKSSSKLMVIDFSASWXRPCRFIEPAFKELXLRFTDAIFIKVDVDELAXVARTWKVEAMPTFVLVR

SEQ ID NO: 29065 - DNA, 674 bp, Zea mays
  misc_feature: Ceres CLONE 1403546-F
ggagctccccgcggtggcggccgctctagaactagtggatcccccgggctgcaggaattcgcacgagaccattacctagaacatcctaatcgaaaaaggccatcgcccgccagccaccgagcggagggggaagcaaaagcttgataaaaaggagaggaggagacgagacgtgccgtccggacccaagcaacttcctcccaccacctcctccctcccatgcccgcatcgagatcttagcgggacagcgagaggagaggcgacgccgacgcgggcgccccctgatccctcctcgccgccgccgccgaccgaccgaccgggggaggaggaggggaggggaggacggacacgatggaggcggactccgggaagctcttcgtcggcggcatctcttgagagacggacgaggatcgcctccgcgcgtacttcggtcggtttggcgaggtcaccgaggccgatatcatgcgggaccgcaacaccggcgcggcccgtgggtttcgggggtcatcagtcttcgccgaattccgggatcgccgaaacgcgccaccctggaataacacgatgatcgacggggagatggtgggaaccaaacaaagcccgtgccaaaggaaacatcgatggatgttgccccccatggacctacgggaaaacattagggaccccctggtgcccaggag

SEQ ID NO: 29066 - DNA, 713 bp, Zea mays
  misc_feature: Ceres CLONE 1403549-F
  misc_feature: Encodes the peptide sequence at SEQ ID NO. 29067
  misc_feature (316)..(316): n is a, c, t, g, unknown, or other
  misc_feature (343)..(343): n is a, c, t, g, unknown, or other
  misc_feature (385)..(385): n is a, c, t, g, unknown, or other
  misc_feature (564)..(564): n is a, c, t, g, unknown, or other
  misc_feature (565)..(565): n is a, c, t, g, unknown, or other
  misc_feature (603)..(603): n is a, c, t, g, unknown, or other
  misc_feature (609)..(609): n is a, c, t, g, unknown, or other
  misc_feature (710)..(710): n is a, c, t, g, unknown, or other
caaagctggagctccccgcggtggcggccgctctagaactagtggatcccccgggctgcaggaattcgcacgagaccattacctagaacatcctaatcaaaaccagatccctcttccctctccgctcccccacgtcatctagtcgccgcccccgctcaccgattgtcctctgctgtggagcgagcaagcagcggcgaagcgatggaggaggagatcagaaaggagttccagagtaacggcttctccatcggaggagccggccccgaggacgccgcccagatcctctccacgctgctgacctactgcatcaactacnagatgagccccgcggatctcgtctcanactgggaggtctactacctcaataggcaattggatggcttanagctcgaaagctcgtatcttgatggttttctgtcacaccttcaaaatgaagttaaagacaggataataaaagaagaagctaaccttcacatttactccagtaacgatgttgacatgctcttaagcaattcacatgtagatgaagcagcattccatgacacaccaggctatgaacaggannaggcaccctgaggatcatctatctctgagttaactccntcgggncagtgacagaacatcattccagcagagtggccaaaacaaatgctgatcgtattaccccttttgcacacgagtaaataattttacccaacagtatgttctcnatt

SEQ ID NO: 29067 - protein, 124 aa, Zea mays
  misc_feature: Ceres CLONE 1403549-F
  misc_feature (39)..(39): Xaa is any aa, unknown, or other
  misc_feature (48)..(48): Xaa is any aa, unknown, or other
  misc_feature (62)..(62): Xaa is any aa, unknown, or other
  misc_feature (121)..(121): Xaa is any aa, unknown, or other
  misc_feature (122)..(122): Xaa is any aa, unknown, or other
MEEEIRKEFQSNGFSIGGAGPEDAAQILSTLLTYCINYXMSPADLVSXWEVYYLNRQLDGLXLESSYLDGFLSHLQNEVKDRIIKEEANLHIYSSNDVDMLLSNSHVDEAAFHDTPGYEQXXAP

SEQ ID NO: 29068 - DNA, 827 bp, Zea mays
  misc_feature: Ceres CLONE 1403550-R
  misc_feature (30)..(30): n is a, c, t, g, unknown, or other
  misc_feature (420)..(420): n is a, c, t, g, unknown, or other
caccccccccacccaaccccccctcattancccccgccccccccaggatattaaacaccaattgggtcccggcccccccctcgaggccgactttcccaaaattatttttttttttttttggcccactggggggtataaaattatgattgaaggcgtatttagctacaataatcatgtctggcattacacaagtggttacaatgaaactttgatgtttagagtacatacagccgatgatcttagctgactgtcagcaccttcgtcctcatctccaaaggcttcagcaattagccgcatcaaactgtgtgccactctgatgttgacaagatccccagcatgctcaaaaactctgttcatggtctggatgaaccactgatcgctaggcgcaaattgctctgcgagttcgacacaacaagatgnaaactcatgtcttgcaacgatgatcaccccatgttgatcatgtactcaaccaatccccaccaacaatcagactcaaaatcacgtaaaccttaccccccctcataacagacaccccaacgccccgccgccttcaaacgagtctatctggggtcccccccaagccacgaagtgagcacaccacgcctcgaggcaacttacctgaaaaaacccctgcccactcccctcctcttctctacaccctccccaacaacaacacactctccctccacacgcacccaccaaaaaattgatacaaaacactaacaccaaccccatcaaaaaaccactgggacaccctcgccccttaaccccctccgccctcctacgtacgccgcccgcccacacgcgagcccccccccaacccaaaa

SEQ ID NO: 29069 - DNA, 713 bp, Zea mays
  misc_feature: Ceres CLONE 1403550-F
  misc_feature: Encodes the peptide sequence at SEQ ID NO. 29070
  misc_feature (643)..(643): n is a, c, t, g, unknown, or other
caaagctggagctccccgcggtggcggccgctctagaactagtggatcccccgggctgcaggaattcgcacgagaccattacctagaacatcctaatcaaaaaattcgtcgctaatcacaatcccgatctccaagcaaacccacctcccgtcagttccctactcgccgatccagatctcctacagctttccactccgccactccaaccggacgcctccgccgtcgccggcggcggtcgagccacgcgcgcacgccgctgaggaacccggagagggcggcggcaatggagcagctgcggacgttcgggcgggagctggcgatggggtcgcagggcgggtgggggcagtccaaggatttcctcgacctcgtcaagtctatcggcgaggcgcgctccaaggcggaggaggaccgcatcatcgcgcgcgagcttgagcacctcaagcgccgcctggccgaccccgacgtgccacgccgcaagatgaaggagcttctcctccgcctagtctacgccgagatgctcggccacgacgcttccttcggccacatccacgccgtcaagatgacccacgacgagtcgctaccgctcaagcgtaccggctacctcgccgtcgcactcttcctcgacgagcgccacgacctcgtncatcctcgtggtcacaccatccagaaggacctcaggtcggacaactacctcgtcgtctgcgcacacttca

SEQ ID NO: 29070 - protein, 143 aa, Zea mays
  misc_feature: Ceres CLONE 1403550-F
MEQLRTFGRELAMGSQGGWGQSKDFLDLVKSIGEARSKAEEDRIIARELEHLKRRLADPDVPRRKMKELLLRLVYAEMLGHDASFGHIHAVKMTHDESLPLKRTGYLAVALFLDERHDLVHPRGHTIQKDLRSDNYLVVCAHF

SEQ ID NO: 29071 - DNA, 749 bp, Zea mays
  misc_feature: Ceres CLONE 1403551-F
  misc_feature: Encodes the peptide sequence at SEQ ID NO. 29072
  misc_feature (12)..(12): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (57)..(57): n is a, c, t, g, unknown, or other
gggagggggaanggggggnnnctataaaaatataaatagcgggagncnncctctatntttacaaaatggagctccccgcggtggcggccgctctagaactagtggatcccccgggctgcaggaattcgcacgagaccattacctagaacatcctaatcgaaaaatgaccgactagcccatggtctctctccgctccgacgcgcccgacccaccaccacatccctcatggctgccctcgccgacatcgactcctcggcacttccgccgtccgagtcatccaaaggcaagggcaagatggacaaggaggaggaggacgaggcgaagggcgcggagaagatgtgcggcatctgcctatctcgacggccggcgggccatccgcggcgagctcgactgctgcgcccatttcttttgctttgtctgcatcatggcttggggccgcgccaagtcaccgctgtcccttctgcagggcccgcttccacaccatccgccgcccgcccgttcgccggacggttccccgacccccgattcgtctcgatccaagagcgcaaccgggtacaccatccctcagggcaacgggggcagcataggcggggggacaatccttacgggggcaccataatggggcgggttgcagcaggtcgcgggggaaaaaaaagggggtgggtacggctgacaaggttctacaaaagacaggtggaggggggcgttacgtgagagccggggctgggtggtacgactggtggcgccgt

SEQ ID NO: 29072 - protein, 146 aa, Zea mays
  misc_feature: Ceres CLONE 1403551-F
MVSLRSDAPDPPPHPSWLPSPTSTPRHFRRPSHPKARARWTRRRRTRRRARRRCAASAYLDGRRAIRGELDCCAHFFCFVCIMAWGRAKSPLSLLQGPLPHHPPPARSPDGSPTPDSSRSKSATGYTIPQGNGGSIGGGTILTGAP

SEQ ID NO: 29073 - DNA, 675 bp, Zea mays
  misc_feature: Ceres CLONE 1403552-F
  misc_feature: Translation starting site: 444
  misc_feature: SWISSPROT Homolog: EC 3.4.16.6 Carboxypeptidase D
  misc_feature (296)..(296): n is a, c, t, g, unknown, or other
  misc_feature (373)..(373): n is a, c, t, g, unknown, or other
  misc_feature (675)..(675): n is a, c, t, g, unknown, or other
gctctagaactagtggatcccccgggctgcaggaattcgcacgagaccattacctagaacatcctaatcgaaaagcggctactgtttctgtttcttccttcgaccccggtcgtcccgtcctccgctgggcatcgaaagtcgaacgcctcccccctccctccctcccagttccgtcgtcggctcctgcagcagcagcaagcaatggcggcttcctggagagcccgtggcgctggcggtggccgcagtgggctggcttcttgccggtgccgcgcgggcgttcccgggcgaggacttgntcgcgcggctgccggggcagcctccggtcacgttcagggcagtcgccgggtacgtggacgtcgacgccaaggccggnaggagcctcttctactacttcgccgagccgcgggaggacgccgccgccaaggcgctcacgctgtggctgaatggaggtcctgcctggtcctcgggttggaggtggtgctttcaccgaggtagggcccattttatccgcgaggagacggccgaccgctcagatcgacaaagaggtcatgaaacagagcgtccaatcctcctgttcgtgaaatcaccggctgggagtgggatggtttaattcaaacacttcatgggactacaggactggaaaacgtgggaactgttcatggactggaccaaatn

SEQ ID NO: 29074 - DNA, 680 bp, Zea mays
  misc_feature: Ceres CLONE 1403556-F
  misc_feature: Translation starting site: 174
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
aagctggagctccccgcggtggcggccgctctagaactagtggatcccccgggctgcaggaattcgcacgagaccattacctagaacatcctaatcgaaaagccgttctaaaccctaaacctttcgacctgctttatactagacctcatcgagaatctcacgcgtcggcgaccatggcggcgtctccgtcttctccccatgccgcccccggagttagcggccagagcctgtccccctcagcgccgtctccccacctccccaactatttcatgtggagggaatttgtctggggaggaattgcaggtgcatttgggggaaggcatgatgcatccagttgacactctgaaaaacaggcttcagagtcaagctataatgacagggggctaaggctcagaagaatatactccagatggtcaggacagtttgggcttctgatggtctaagaggtttttacagaggaatcaggccannngtgtactggatctcttgcgactggcgctacatatttttgtattattgaatcaaccaaggcatgggtgggagattgctaatcctaatctagggggacactgttcacatttttatcgctggaagcgattggtgatacacttgggattcctttggctatggggccttgcgaaatcatgaaacaaaagaatggaaaatccaaggcccccaaa

SEQ ID NO: 29075 - DNA, 704 bp, Zea mays
  misc_feature: Ceres CLONE 1403557-F
  misc_feature (646)..(646): n is a, c, t, g, unknown, or other
agagctggagctccccgcggtggcggccgctctagaactagtggatcccccgggctgcaggaattcgcacgagaccattacctagaacatcctaatcaaaaaactctcgctttctctctgtttcgcgtcgccttcgcttttgttcgattttttccctttctcgcgttccccatgacatcgtcttcctcccccacacccatgggtcgccgcccccgtggtcccggtctcctcggtacagagacgagggggtccgcgccgttcccacggcacaccgcgactcgcatcagatctccgcctgctccgaccgtccatacgccctccctcgaacgggttctccggatcgctggtacctccgagcgcggctccgagctcatgttcctccatcgactgagatcggcagaggcggcttgttgccggccaaccttcgaacgggtacgcactcgccagagttttggaacatgcgttggtgtgcaccgtggggaatagccaagttactgcacagactcatatttccgttgtaaagagatgctgcccggcatcaaattcgctgacttcatcgacgtcctgcctggtcatgatgatgggccgtcctttggagggaatcttctgagacatggcctcctacctgaaagctagggcagggganccacatgtccgtcagcccgcctctgcagcatgcaacatcagcatgcgtgggggcgtcg

SEQ ID NO: 29076 - DNA, 693 bp, Zea mays
  misc_feature: Ceres CLONE 1403558-F
  misc_feature (252)..(252): n is a, c, t, g, unknown, or other
  misc_feature (254)..(254): n is a, c, t, g, unknown, or other
  misc_feature (301)..(301): n is a, c, t, g, unknown, or other
  misc_feature (340)..(340): n is a, c, t, g, unknown, or other
  misc_feature (540)..(540): n is a, c, t, g, unknown, or other
aagctggagctccccgcggtggcggccgctctagaactagtggatcccccgggctgcaggaattcgcacgagaccattacctagaacatcctaatcaaaaaactgccccatggcccattgcttacgcataactgcggcggggacacgcgacgctaccgacttcgccgccgcctccttccttccgcccgtcgagtcgaccgatcgattgttcgcggcctccctcctagtcagatccactcaatcccaagaggncnaagtcaaaccctacccacacccttctcaacagcgatgatggcagcgnagcactcgccgtcggttcccctccaccgcgctgacgccntgaaaccctccgcctcgaatcatcctcggtggccggcgccggtacggcctcacttcccacggaccccttcttcgggccactaactccccgaacggcgccggaaggagagcctttttggctccacaaatccaaaaggggaaattttccccccccccgggcccaaatgtccccccttggcccgggttgtgggggggaaaatncccccccccgggggtcccaaaaaaccgcgtttgggtccccaaaaaaacccgggcccccccaggggggggcccccccggggaaccccccgggccggaaatatttttttttctcaccaccccccccctttttgggggggggggagaaagacaccc

SEQ ID NO: 29077 - DNA, 642 bp, Zea mays
  misc_feature: Ceres CLONE 1403565-F
  misc_feature: Encodes the peptide sequence at SEQ ID NO. 29078
  misc_feature (333)..(333): n is a, c, t, g, unknown, or other
  misc_feature (381)..(381): n is a, c, t, g, unknown, or other
aagctggagctccccgcggtggcggccgctctagaactagtggatcccccgggctgcaggaattcgcacgagaccattacctagaacatcctaatcgaaaaagagttcttgtagtcttctcggcctcccgctaaccgccatccaccacaccgagccccaaggcccccaactcccgagccctcggacctccatccctgttcccatggctgtgcctccccggtgggcgaacctcgacatcgacctggtgacggaaatcatgaaccgcgccccgtgcgtaatcgaccgcgcgcgaatggccgccgtctgcccagcgtgcctcgaggctgtcgcgcnggcagagcctctgacatttcagctcccgtcgctcctccctccgcccgnggacgtgactggcgtctactgctacctcagcggcttccgcgaccacaacatgtttccccggccccgctacttcggctcgtacgacggcggctgtttcttccctcgcctacggcagactcgcgggcaccggctgttcacatccgcacccgagatcctacgagctacccgacgggctcgcggatatcttcactaacgatatccacagcatggtcgtcctccgcgccaacctctcgttcccgcctcatccaccgggatgcggcg

SEQ ID NO: 29078 - protein, 123 aa, Zea mays
  misc_feature: Ceres CLONE 1403565-F
  misc_feature (44)..(44): Xaa is any aa, unknown, or other
  misc_feature (60)..(60): Xaa is any aa, unknown, or other
MAVPPRWANLDIDLVTEIMNRAPCVIDRARMAAVCPACLEAVAXAEPLTFQLPSLLPPPXDVTGVYCYLSGFRDHNMFPRPRYFGSYDGGCFFPRLRQTRGHRLFTSAPEILRATRRARGYLH

SEQ ID NO: 29079 - DNA, 562 bp, Zea mays
  misc_feature: Ceres CLONE 1403567-F
  misc_feature: Encodes the peptide sequence at SEQ ID NO. 29080
ggagctccccgcggtggcggccgctctagaactagtggatcccccgggctgcaggaattcgcacgagaccattacctagaacatcctaatcaaaaatcacacactaatcaacaagcaggaccagctagctagctcctctcactgctatcacccgcccagcccatctcgctgaaagagaaaagcgcagccatggaagaactactagctcggggcatttgcagccgtcctactggtgggcatgggtgggaggtcattcccggtgggcgaatttcgtgttccgaggtgtcaagacctgtgccgggctgccttcctggagggagggacccaacccgggaaaggaacaacagggttgcacggggggaggcccctgacccgggggggaaacccggccgaagggaggcccgggcggggccccagggggcctacttagggcccccttggtccccccggggggggaagtcccccgggaattgccccttttttgtaaaaaaaatcccccccaatttttggggggaaaaaaaaaaggagggatcatcttccccttccgaaaacccaggggggg

SEQ ID NO: 29080 - protein, 124 aa, Zea mays
  misc_feature: Ceres CLONE 1403567-F
MEELLARGICSRPTGGHGWEVIPGGRISCSEVSRPVPGCLPGGRDPTRERNNRVARGEAPDPGGKPGRREARAGPQGAYLGPPWSPRGGKSPGNCPFFVKKIPPNFWGEKKKEGSSSPSENPGG

SEQ ID NO: 29081 - DNA, 686 bp, Zea mays
  misc_feature: Ceres CLONE 1403570-F
  misc_feature: Translation starting site: 429
  misc_feature (470)..(470): n is a, c, t, g, unknown, or other
aagctggagctccccgcggtggcggccgctctagaatagtggatcccccgggctgcaggaattcgcacgagaccattacctagaacatcctaatcgaaaaagagttcttgtagtcttctcggcctcccgctaaccgccatccaccacaccgagacccaaggcccccaactcccgagccctcggacctccatgccctgttcccatggctgtgcctccccggtgggcgaacctcgacatcgacctgtagacggaaatcatgaaccgcgccccgtgcgtaatcgaccgcgcgcgaatgtccgccgtctgccagacgtggctcgaggctgtcgctcgctcactagctctgacatttcagatcacgtcgctcctcatccgcccgcggacgtgactggcgactactgctacatcagctggttcggcgacatcacatgtttcacggggccggctacttcggctcgtacgacagcagntggttcttcatacgcctacgccagactcggggatacgggatgttcaacatcagcaccggagaatcctacgagctactcgacgtggtcggggatatcttcactaacgatatccacggcatggtcggtctcgacgacaccctgtcgttgctgcaatatcacccgggatgccgccgcgggggaatcgtcacctaccagtcgtacatcgacgggccgggg

SEQ ID NO: 29082 - DNA, 665 bp, Zea mays
  misc_feature: Ceres CLONE 1403571-F
cccgcggtggcggccgctctagaactagtggatcccccgggctgcaggaattcgcacgagaccattacctagaacatcctaatcgaaaaagtctggggtccgcttcttttctgttgggctaacggagaagaaggaagacggttaggctatccacgctcgtttcccctcatctccttcagagacgcacgcgcggatctgccctctcgatatccttcccctcggagccggatggcgagcatcagcctacatgcgcttgccacgactgcgagcatcgatattgggaggattcgccatgtctgacatggagtccgacacatgctcttatgatgtcgacgagctccaagatacagcagattcaggaggcatttgctgagcttgacagtaagagcacgtgttctatgaagctcaagtggaagcagcttgaagaccactttcgaggtcttgaagagcgctaaggaatatgtttgacgagctaaaagagccgggagaaggagttccaggagactggcgaaaaatcacatttagattctggaacagcggccaggcacgtgtttgtgagaaaggaaatggacctccttttgtaggaacctgcagggaagaaaaggaaaaatttgccataaagctatggacccttttagcaaggtcacaggcctttcccattacat

SEQ ID NO: 29083 - DNA, 714 bp, Zea mays
  misc_feature: Ceres CLONE 1403572-F
  misc_feature (285)..(285): n is a, c, t, g, unknown, or other
  misc_feature (286)..(286): n is a, c, t, g, unknown, or other
  misc_feature (303)..(303): n is a, c, t, g, unknown, or other
  misc_feature (329)..(329): n is a, c, t, g, unknown, or other
  misc_feature (345)..(345): n is a, c, t, g, unknown, or other
  misc_feature (346)..(346): n is a, c, t, g, unknown, or other
  misc_feature (352)..(352): n is a, c, t, g, unknown, or other
  misc_feature (353)..(353): n is a, c, t, g, unknown, or other
  misc_feature (358)..(358): n is a, c, t, g, unknown, or other
  misc_feature (439)..(439): n is a, c, t, g, unknown, or other
aaaagctggagctcaccgcggtggcggccgctctagaactagtggatcccccgggctgcaggaattcgcacgagaccattacctagaacatcctaatcaaaaagaggcaaagccgttagccaatctgctgttgcgtgttgcaccgatcaacgtcggttcccagcgcttgctcgtcaagcgtgtcctgctgctgttctctgctcctgcttgccgcgagagctcctctcgctcatctacccaaggtccgacagcaacgacttcgtcgagctgctatgggagaaacgnncagcggtggtgcacggnaaggagaagcagcatccccagggcgnctttcccgcctttcannctgcgnngcggncagcagcagtagagctcaagaaaaacaggcgggtactacccgacccgggtctcgctgttcaggacgggaaggcctcttcgncggaattttcgttccgggctaaaagcccgcccgtgggaaccgtggactttgacgacaccggggccctggatccacttggccatcctccaagaaaaaaagggcgcaacccgcaactgccctcggggaggggtacagcgcccaatttcttttccgaagctccttgtaccgggtttaaaaaggcgggggggagaaaaaaaccttaaacctctgtcaccccccgggtcagaaaaaagaaagacccgcggttgccccccccagcaagagaatagaaccct

SEQ ID NO: 29084 - DNA, 2889 bp, Zea mays
  misc_feature: Ceres CLONE 1403583
  misc_feature: Encodes the peptide sequence at SEQ ID NO. 29085
gtcaaggatattttaggcaatgcgttgcccaattccacaggccacgtcacacgtggtgcggctctaaccgtatcgtccctgcccggtggggccgcggtcgcgtagcagacaccgacgggccgtcacgggccctgctcgccgcagacgatccaggggccaggcggcgcgcgggtgatctcgccacggcgcgttttgtgtggcccgcccgtgacgggaggcggaagagggaagaggcgacgcgacgcgacgcggctctataaaaccgcgcctccaaccagtactcccccggcaccctagagagattctgttttcgcaccagcgccggcacaggcaacgcagcaccgcaccgagccgagccacttagcgagcgagggaacagcctccacggcgaggagagaatggggagaggagggatcggaggcgcggcggccatggccatggccatggagaccgccgatcctgcccgtgcattcgtgaaggacgtcaagcgaatcattatcaaggtgggcacggctgttgtcactggcatgaatggccgattggccatggggaggctcggttctctctgtgaacaggtgaagcaactgaattttcaagggtatgaggtgattctggtaacctcaggagctgttggtgttgggaggcagaggctccaataccgtaaacttatccatagcagcttcgcagatctgcaaaatcctcagatgaactttgatggaaaggcatgtgctgctgttggtcaaagtgtcctgatggcgatctatgacacattatttagccaacttgatgtaacgtcatctcaacttcttgtgacggatcgtgatttcaaggatccaagttttggggaccagctccgtgagactgttttttcactgttagatcttaaagtagtacccttatttaatgagaatgatgccatcagtacccggagacagccatatgaggattcatctggtatattctgggataatgacagtctagcagctctgttggcagcagaacttaatgctgatcttcttatcatgcttagtgatgtggagggactctatagtggtccaccaagcgatcctcagtcaaagattatccacacatatgtcaatgaaaagcatgggaagctaattagttttggagagaaatctagtgttggaagaggtggcatgcaagctaaagtgactgctgctgctaatgctgcatcaaaaggtgtacctgttgttattgcaagtggatttgcaacggatagcatcattacagttctcaaaggcgaaaagatcggtacacttttccacaatgaagcaaatttgtgggcatgttccaaggaagctacagcccgagagatgtcagttgcggcaagagactgttcgaggcgtctacagaagttgtcatcagaggaacgcaaacagattttgctagatattgctgatgctctggaagcaaatgaggatgcaattatgtctgaaaatgatgccgatgttgaggcagcacaagttgctggttatgaaaagtcgttggttgctaggatgaccctaaagccaggaaagataacaaaccttgcaagatccattcgtaaaactgctgacatggaggaccctatttcccatacattgaaaagaacagaggttgctaaagatctggtttttgagaaagcatattgcccattgggtgttctgctcattatttttgagtctcgtcctgatgcattggtccagattgcatctctagcgatccgaagtggtaatggtctccttttgaaaggagggaaagaagttatgagatcaaatgcaatattacacaaggtcataactggggtcattccagatactgttggcaaaaagctcataggccttgtgactagcaaagaggaaattgctgatctgctagcgcttgatgatgtaattgatcttgtcattccgagaggtagtaagtctctagtctcccaaatcaaagcaacaactaagattccagttttaggtcatgctgatggtatctgccatgtttacattgacaaatcagccgacatggatatggcaaaacggatagtattggatgctaagattgattatccagcagcatgtaatgcaatggaaacactacttgttcataaagatcttaacaagagtgagggacttgatgatctattagtggaacttgaaaaggaaggagtagttatttatggtggacctgttgcacatgacaaactgaaagtaccaaaggtagactcatttcgtcatgagtatagctcaatggcatgcacagtcgaatttgttgatgatgtgcagtcagctatcgatcacataaatcgttatggaagtgcacacacagactgcatcatcacaactgatagaagtgctgcagaggcctttctgcagcaagttgatagtgccgctgtgtttcataatgcaagcacaaggttttgtgatgggacgcgttttgggctaggtgctgaggttggcataagtacagagcgcatacatgcccgcggacctgttggagttgatggacttctaactactcgctgcattttgcgcggtagtggacaagtggtgaatggtgacaagggagtggtttacacccacaaggatcttcctttgcaatgaggcaaataacctccgttgtggtcgtaacgaatggctggacttcccttttaagtaccattttctttattccatgctacaaagtttggtgtcgtaacaagcagaatgcctatttagtaggcaatgatgtaatcagaccattttgtcgtggtgttccttgtcgtataaaaacatccgagacatgtgtattagaggcgtggtagctagttgatacgcgattgttttggatgaaatttggatctgttccaatgcaatgataatgcatgtgtgatgaggtcctaaaaaaaaaaaaaaaaaa

SEQ ID NO: 29085 - protein, 731 aa, Zea mays
  misc_feature: Ceres CLONE 1403583
  misc_feature (30)..(275): Pfam Name: AA_kinase Pfam Description: Amino acid kinase family
  misc_feature (295)..(690): Pfam Name: Aldedh Pfam Description: Aldehyde dehydrogenase family
  misc_feature: SWISSPROT Homolog: EC 1.2.1.41 Glutamate-5-semialdehyde dehydrogenase
MGRGGIGGAAAMAMAMETADPARAFVKDVKRIIIKVGTAVVTGMNGRLAMGRLGSLCEQVKQLNFQGYEVILVTSGAVGVGRQRLQYRKLIHSSFADLQNPQMNFDGKACAAVGQSVLMAIYDTLFSQLDVTSSQLLVTDRDFKDPSFGDQLRETVFSLLDLKVVPLFNENDAISTRRQPYEDSSGIFWDNDSLAALLAAELNADLLIMLSDVEGLYSGPPSDPQSKIIHTYVNEKHGKLISFGEKSSVGRGGMQAKVTAAANAASKGVPVVIASGFATDSIITVLKGEKIGTLFHNEANLWACSKEATAREMSVAARDCSRRLQKLSSEERKQILLDIADALEANEDAIMSENDADVEAAQVAGYEKSLVARMTLKPGKITNLARSIRKTADMEDPISHTLKRTEVAKDLVFEKAYCPLGVLLIIFESRPDALVQIASLAIRSGNGLLLKGGKEVMRSNAILHKVITGVIPDTVGKKLIGLVTSKEEIADLLALDDVIDLVIPRGSKSLVSQIKATTKIPVLGHADGICHVYIDKSADMDMAKRIVLDAKIDYPAACNAMETLLVHKDLNKSEGLDDLLVELEKEGVVIYGGPVAHDKLKVPKVDSFRHEYSSMACTVEFVDDVQSAIDHINRYGSAHTDCIITTDRSAAEAFLQQVDSAAVFHNASTRFCDGTRFGLGAEVGISTERIHARGPVGVDGLLTTRCILRGSGQVVNGDKGVVYTHKDLPLQ

SEQ ID NO: 29086 - DNA, 605 bp, Zea mays
  misc_feature: Ceres CLONE 1403585-F
  misc_feature (380)..(380): n is a, c, t, g, unknown, or other
  misc_feature (381)..(381): n is a, c, t, g, unknown, or other
  misc_feature (419)..(419): n is a, c, t, g, unknown, or other
  misc_feature (420)..(420): n is a, c, t, g, unknown, or other
  misc_feature (461)..(461): n is a, c, t, g, unknown, or other
  misc_feature (462)..(462): n is a, c, t, g, unknown, or other
  misc_feature (467)..(467): n is a, c, t, g, unknown, or other
aaagctggagctccccgcggtggcggccgctctagaactagtggatcccccgggctgcaggaattcgcacgagaccattacctagaacatcctaatcgaaaaggaatcctctcgagctcgtcgaaccttctggctcgccgccagcgcgctccattctccaactacctcaccaccctataaatgtagtcgcctactcgcctctgcgccgtcaccatcgcgaagacacactgggtaggaagatcgcagaaaaggaacagcagctttgatcgggtggagtttcttgctcactgatcgtcgagttcctgttcgattgaagttccaggcgcggacacgcactgaagcctttggggtccgtgacgatgtcgaagagaagccgcaanncgttgttgctcgcgtgcctcgtcgcgtgacagcggcgnnctttgcggacggggcctgcttccggtgttcgggaacgccgnngcggnttcacgaggaacggggttccacatgggcctcctggggcgcgaccgtttcggaatcgggaaacggtcccctcgggttcaaacgggaaaaaaggggcctgggttcctatgggccccggggaaatgggccgaaaaccccaa

SEQ ID NO: 29087 - DNA, 638 bp, Zea mays
  misc_feature: Ceres CLONE 1403586-F
  misc_feature: Encodes the peptide sequence at SEQ ID NO. 29088
  misc_feature (154)..(154): n is a, c, t, g, unknown, or other
  misc_feature (194)..(194): n is a, c, t, g, unknown, or other
  misc_feature (197)..(197): n is a, c, t, g, unknown, or other
  misc_feature (273)..(273): n is a, c, t, g, unknown, or other
  misc_feature (327)..(327): n is a, c, t, g, unknown, or other
  misc_feature (375)..(375): n is a, c, t, g, unknown, or other
  misc_feature (561)..(561): n is a, c, t, g, unknown, or other
aagctggagctccccgcggtggcggccgctctagaatagtggatcccccgggctgcaggaattcgcacgagaccattacctagaacatcctaatcaaaaaacgtctcgtcagtttttttccctttttcccgtggcccgtgggtgtgcgtcctangtgtgcggcgggcggtgcgccgtgcgcctcctctcctcgncgngacgcttgcgtgttcgcgattcagcgccgtgctcgacgcccctccctccttcagaagtcagcgacgcatctccggntgcagagacttgcgctgccacctctcccgcttttcgccttcagttggtcgacgnccctcctcccctcagagtcaggggagggtctcccctcttcacgccttngggttggggaaaccgggtcctttcaataaaaaaggtttgtttccgcattcggggggcaacccggattccagggacactaaatgttggggagcccgatcttggggggccccccccctccaaaaggggtttgggtgtgggtaaatccgccgaaaaagcggaaggaaaaaaacccgggcgggggggggnaatttgccccccaggaatttctctatttggcccccccgcttaaggggaacaaagggggggcaggggtttaaaatttt

SEQ ID NO: 29088 - protein, 58 aa, Zea mays
  misc_feature: Ceres CLONE 1403586-F
  misc_feature (36)..(36): Xaa is any aa, unknown, or other
MLGSPILGGPPPPKGVWVWVNPPKKRKEKNPGGGGXFAPQEFLYLAPPLKGNKGGAGV

SEQ ID NO: 29089 - DNA, 703 bp, Zea mays
  misc_feature: Ceres CLONE 1403588-F
  misc_feature: Encodes the peptide sequence at SEQ ID NO. 29090
  misc_feature (209)..(209): n is a, c, t, g, unknown, or other
aaagctggagctccccgcggtggcggccgctctagaactagtggatcccccgggctgcaggaattcgcacgagaccattacctagaacatcctaatcgaaaaagacgcctcccttttcttctcactccactccgccgcccggattcagagcgacagcgagaggaggcggagagggcggacatggcggcgatgttggtgggcgcgctgcnggagggaagtggatgccgcggcggcttgcgccttatcgctcattcgcttcgcagattcgtgagcacgctcgtcgtagcggagcacgaagggcgggtcgtcaagccgtcgtcgctgagcgcatgggcccgccgcggagcaattgcccagggacacaaagtttctgtcctgctgggtggtcccgggccgggcttcacaggccgccgaccatgccgggggctacatccactgggggctaggggctctgggcgatcccaaaccttggggatcctctggttgaaccgtgggccgattactccgttcggtcagaaaaagggggcgaccccctggcaaacctcccccccaccttcgggaaaaattggttcccgggggggggtctccttgggggccccccgttacgtgggcccccggaaaaaggcccacccctttttggggggcctttttggggaaaagcctttttgggggaaaaaaacggggggagggcccttttattaaa

SEQ ID NO: 29090 - protein, 173 aa, Zea mays
  misc_feature: Ceres CLONE 1403588-F
  misc_feature (10)..(10): Xaa is any aa, unknown, or other
MAAMLVGALXEGSGCRGGLRLIAHSLRRFVSTLVVAEHEGRVVKPSSLSAWARRGAIAQGHKVSVLLGGPGPGFTGRRPCRGLHPLGARGSGRSQTLGILWLNRGPITPFGQKKGATPWQTSPPPSGKIGSRGGVSLGAPRYVGPRKKAHPFLGGLFGEKPFWGKKTGGGPFY

SEQ ID NO: 29091 - DNA, 684 bp, Zea mays
  misc_feature: Ceres CLONE 1403589-F
  misc_feature: Translation starting site: 200
  misc_feature (449)..(449): n is a, c, t, g, unknown, or other
  misc_feature (532)..(532): n is a, c, t, g, unknown, or other
aaaagctggagctccccgcggtggcggccgctctagaactagtgcatcccccgggctgcaggaattcgcacgagaccattacctagaacatcctaatcgaaaatccaaagtttcgtccaccatttggctcccgcaagcaccgatttgtttactgctctctccgacgcgcggcggcggagctccctacgacaactgaaccatgtgcggcggcgcgatccttgccaaccttcgcgagccggcgccgcgccggctcacagagcgggacatctggcagcagaagaagaagctcaagaggggcggcggcggcgggaggcgctcgttcgcggcggaggacgatgaggacttcgaggccgactttgaggtcttcgaggcagactccagtgattcagatttggagctcagggaggggactgacgacgacgtcgtcgagatcaagcccttcactgccnagaggactttctccagcgatggcttaagcaccatgactagtgctgtagcaaggtcagcccagaggaagagaaagatctatacnggggtatccgccagaggcttggggcaagtggctgctgaaaacaaagatcctcagaaggggccggggttgggtttggactttcaaaagcctggaggagctgcaaaacttatgatgcttaacccgccagattcctgccaaaaagggcaggtaaa

SEQ ID NO: 29092 - DNA, 705 bp, Zea mays
  misc_feature: Ceres CLONE 1403592-F
  misc_feature: Translation starting site: 199
  misc_feature: SWISSPROT Homolog: EC 2.7.11.1 Non-specific serine/threonine protein kinase
  misc_feature (590)..(590): n is a, c, t, g, unknown, or other
  misc_feature (684)..(684): n is a, c, t, g, unknown, or other
aaagctggagctccccgcggtggcggccgctctagaactagtggatcccccgggctgcaggaattcgcacgagaccattacctagaacatcctaatcgaaaactgggaggcagagacgaaagcctactagcttccctttgggtcggtctcgcgctcccgctgcgcgtctgtctgtctgtctgtcttggagcctcatcaatggctaccatcagagaggagtccgactacgacagcagccggtcctcgctgacggcgccgggcggctcccgccggagctggatcagcgacattggcagcgccagctcggtctcggcgcgctccgtggcggggcgaggctgggacgcgccggcgtgccgccaccgccacaagcctcacaaggcgaaccaggccgagtgggaggccatcgggcgcgtccgcgccgccgcgggccgcgtcggcctggagcacttccgcctggtgcggcgcctgggcagcggcgacctcgggaacgtctacctctgccagctgcgcgagccctggtccaccacggggtgcctgtacgccatgaaggtggtggacaaggacgcgctggcgttcccaagaagctgcgncgcgcggaggtggagcgcgagatcctccgcgcgctcgaccaccccttcctccccacattgtacgccgacttcgaggcgtcgcactacgcctgcnttcgtcatggagttctgcccc

SEQ ID NO: 29093 - DNA, 661 bp, Zea mays
  misc_feature: Ceres CLONE 1403597-F
  misc_feature: Encodes the peptide sequence at SEQ ID NO. 29094
  misc_feature (435)..(435): n is a, c, t, g, unknown, or other
ggagctccccgcggtggcggccgctctagaactagtggatcccccgggctgcaggaattcgcacgagaccattacctagaacatcctaatcaaaaaaccaggcaagcaagcgggagccgccaactcgtgcctctcggcagcggcgtctgaactctgaaccgaccgaccgaccgaccgttccgttccgttcaccccaccatggaggcgccgccgggaccggggcccatggagctggacgccccacctcccgccgccgccgccgcggtgattcctcccgccggcagcgacaggcacaaggacggggaagggggagacgctgtgacggtccatatcatctccaccaccatcggcgggaagaacggcgagcccaagcggaccatcagttacatggcagaacgtgtcgtgggcacaggctcatttgggatcgtcttccangctaagtgtctggaaacaggagagaccttcgccatcaagaaggtgctgcaagatcggcgttacaagaaccgggagctgcaacttatgcgtgccatggagcacccccacgtcatctgcctgaagcactgcttcttctcgacaaggagaaggggacgaattgtttttaaaactttgtcatgggattcgtcccctgagattcctataccggaggccctgaagcactacg

SEQ ID NO: 29094 - protein, 154 aa, Zea mays
  misc_feature: Ceres CLONE 1403597-F
  misc_feature: SWISSPROT Homolog: EC 2.7.11.1 Non-specific serine/threonine protein kinase
  misc_feature (79)..(79): Xaa is any aa, unknown, or other
MEAPPGPGPMELDAPPPAAAAAVIPPAGSDRHKDGEGGDAVTVHIISTTIGGKNGEPKRTISYMAERVVGTGSFGIVFXAKCLETGETFAIKKVLQDRRYKNRELQLMRAMEHPHVICLKHCFFSTRRRGRIVFKTLSWDSSPEIPIPEALKHY

SEQ ID NO: 29095 - DNA, 735 bp, Zea mays
  misc_feature: Ceres CLONE 1403598-F
  misc_feature: Encodes the peptide sequence at SEQ ID NO. 29096
tagaagtggagctccccgtggtggcggccgctctagaactagtggatcccccgggctgcaggaattcgcacgagaccattacctagaacatcctaatcaaaaaacctcccaaactcgcgagcgagtcgaggctccaaccccggtacatcacaggaggaggaggaggacccgcccaccatggtcatggcgagggccctcctcaagctctgcgcccacggtctgggacgcctgccgctgtgccgcatcatgccgttctacgacctggcgtcccttcccgccgccgacgagagatgcggaatcaccggagactaagcaggacaacgcgccgctggagaagaacgacccccatatcgttgagagcaggtaccacgagagggaccgccaagaggaagggaatggagctcatcccgagggagaatttcatatggatgacattgatgcaggcaataccttccgggatgagcagcccagacctttggggggacgctggcgtaagagactactggggatatgagattattgagtgtgcgcactcctggtgtcaaaaacgtgctttggaggcctagcagtttggacccaggcgaagagcccagtgaaggattcaacctctatcgagtgtggccgccgactttcatgcatgcgctgcactcttggaggcgcaggaaaggaactggggtttccagccttctcacggaggacatctttcctaatggctaccggatccggcctctgagg

SEQ ID NO: 29096 - protein, 91 aa, Zea mays
  misc_feature: Ceres CLONE 1403598-F
  misc_feature: SWISSPROT Homolog: EC 2.1.2.1 Glycine hydroxymethyltransferase
MRNHRRLSRTTRRWRRTTPISLRAGTTRGTAKRKGMELIPRENFIWMTLMQAIPSGMSSPDLWGDAGVRDYWGYEIIECAHSWCQKRALEA

SEQ ID NO: 29097 - DNA, 647 bp, Zea mays
  misc_feature: Ceres CLONE 1403599-F
  misc_feature: Encodes the peptide sequence at SEQ ID NO. 29098
  misc_feature (435)..(435): n is a, c, t, g, unknown, or other
cgctctagaactagtggatcccccgggctgcaggaattcgcacgagaccattacctagaacatcctaatcgaaaatcaagccaacagcttccgaaaagtttccgaaagctccttcagatctgttggttaatggatacactcatcctgtacctatgtctactgctggctggccaaccaatgctagtttagtgcctgttcagagcactggatcaatgactgcaactggttggccacccaatggtgggtcaaatgcttttccaagtactgcatctctatcagctgctggtaattacaacattaaccagtcgcttcccaggtcttccgttggttgggctgtcaatggtgagcaaagtgttattcctagcattgctccaagatttgaactcgtgcagcctgttgaagagcctgtttccagctggacaagcagtggtgcanaagcatgttggtactcagcacaagcacacaggtttactttttccaagatggtatgtctgaaccacttgtatctgcatcaatggtcccaaacgtttcagtagcactgatttattcgaaaatttctcagtgaacaagaaatgctccctaagtgaatggaactgaaatactgtcactttaactggaaatgggtaaatttaaaagcagaactgcgc

SEQ ID NO: 29098 - protein, 127 aa, Zea mays
  misc_feature: Ceres CLONE 1403599-F
  misc_feature (95)..(95): Xaa is any aa, unknown, or other
MSTAGWPTNASLVPVQSTGSMTATGWPPNGGSNAFPSTASLSAAGNYNINQSLPRSSVGWAVNGEQSVIPSIAPRFELVQPVEEPVSSWTSSGAXACWYSAQAHRFTFSKMVCLNHLYLHQWSQTFQ

SEQ ID NO: 29099 - DNA, 550 bp, Zea mays
  misc_feature: Ceres CLONE 1403600-F
  misc_feature: Encodes the peptide sequence at SEQ ID NO. 29100
  misc_feature (402)..(402): n is a, c, t, g, unknown, or other
  misc_feature (412)..(412): n is a, c, t, g, unknown, or other
  misc_feature (446)..(446): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
aaagctggagctccccgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctcntccatcatcngacagcgggcattcggcatgaccaagtccgaccnttgtcacaaccctcgtaccatcgccaggtccgggacgaaggagttcatggaaagccctttgctgcggcgctgatgtggtcatgattggnnncagttcggcgtcg

SEQ ID NO: 29100 - protein, 119 aa, Zea mays
  misc_feature: Ceres CLONE 1403600-F
  misc_feature (78)..(78): Xaa is any aa, unknown, or other
  misc_feature (81)..(81): Xaa is any aa, unknown, or other
MASETETFAFQAEINQLLSLIINTFYSNKEIFLRELISNSSDALDKIRFESLTDKSKLDAQPELFIHLVPDKATNTLXHHXTAGIRHDQVRPLSQPSYHRQVRDEGVHGKPFAAALMWS

SEQ ID NO: 29101 - DNA, 674 bp, Zea mays
  misc_feature: Ceres CLONE 1403607-F
tggagctccccgcggtggcggccgctctagaactagtggatcccccgggctgcaggaattcgcacgagaccattacctagaacatcctaatcgaaaaaacttcgacccacacccacggcacggcagtcggcagcagccagtgtcgagcgcagtgccctcttgtttgctgcatcctacctcccgcccgatgccccgtgccattctcattccacactcacacgtgtcgatcggagggggttgagagatggagccagattcggagacgacgaggctcgcattgatggcgctgcttctcttggggaggcccgaccgcccggtctaggaggttccgggggaaggatggcctgctccaccattgttgaattttggaaccggccccgggcggtggttttcgaaagaattttggccctggtgcttaaaggaggttacgccaatcccctggttgggaaataataatgggtaaagggcaaactttttttttacttgagccaaacaaccagggttgggattgatccttttttttgttccacaggagaaacccttgggtttaagggtttgggaattatatgctacacgttgggaaaagtgggcgaaccacacaaaaaaaggcttcggaatatactttgggcacttttaacccctttcccgggaatgtggaccaaatttgagggaat

SEQ ID NO: 29102 - DNA, 741 bp, Zea mays
  misc_feature: Ceres CLONE 1403608-F
  misc_feature: Translation starting site: 202
  misc_feature: SWISSPROT Homolog: EC 2.7.7.27 Glucose-1-phosphate adenylyltransferase
  misc_feature (608)..(608): n is a, c, t, g, unknown, or other
  misc_feature (690)..(690): n is a, c, t, g, unknown, or other
  misc_feature (698)..(698): n is a, c, t, g, unknown, or other
caaagctggagctccccgcggtggcggccgctctagaactagtggatcccccgggctgcaggaattcgcacgagaccattacctagaacatcctaatcaaaaaccgtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagaggatgaggatcaactgctgcagcatcaggcgcaacaaggcactgaggaggatgtgtttcagtgcaagggatgctgtgagcagcacgcagtgtgtgctcacatcagatgctggcccagacactcttgtcgtccgaacatcctttcggaggaattatgctgatcctaatgaagtcgctgccgtcatttttgggtggtggtaccgggactcagcttttccctctcacaagcacaagggccacccctgctgttcctatttggaggatgttacaggcttattgatatccccatgagcaactgtttcaacagtggcataaacaagatnatttgttatgactcagttcaactcagcttctcttaaccgtcacattcatcgacctatcttggggggggggggatcacttccntgatgaantctctgtttgaggtgctggctgcaacacaatggcctggggagg

SEQ ID NO: 29103 - DNA, 668 bp, Zea mays
  misc_feature: Ceres CLONE 1403609-F
  misc_feature: Encodes the peptide sequence at SEQ ID NO. 29104
  misc_feature (407)..(407): n is a, c, t, g, unknown, or other
  misc_feature (472)..(472): n is a, c, t, g, unknown, or other
  misc_feature (477)..(477): n is a, c, t, g, unknown, or other
  misc_feature (478)..(478): n is a, c, t, g, unknown, or other
  misc_feature (609)..(609): n is a, c, t, g, unknown, or other
  misc_feature (610)..(610): n is a, c, t, g, unknown, or other
tccccgcggtggcggccgctctagaactagtggatcccccgggctgcaggaattcgcacgagaccattacctagaacatcctaaaaaaaactttctgacctcttctggaatcctgcgacgaggggaccgaaatggcctcgtcctcctctgactccggccgcatcgccggaaccctagccttgcgtacgagctcggccttagcggcggcgtcgctaatcccggggctcccggacgacgttgcagctgtcattctctgcctgctcaccttccccgaccagtcccgcctccgcgccacctcgcgcggcttggtgcttgctcctctctgcggctacgctcctcccgctccgccgtagcctccgtctcccgcgccgccaccttctctgcctcttccccaccgacccatcccntcgcctccccgatcctgctcgaccccgccgcacctacccacctggtggcccctcccgccgctccnctggnntcgcggcagctttacggcctcgccacttaacggccccttcggcggtggcgccactctcgttcccccgggggggtctttgcttcgacgccgcagcttaaccctttggggcaccctcccccccccggcgcggnnctaccggcttgaccttgcaactctccgacttttgctgggaacgccttccgactgaggt

SEQ ID NO: 29104 - protein, 73 aa, Zea mays
  misc_feature: Ceres CLONE 1403609-F
MASSSSDSGRIAGTLALRTSSALAAASLIPGLPDDVAAVILCLLTFPDQSRLRATSRGLVLAPLCGYAPPAPP

SEQ ID NO: 29105 - DNA, 675 bp, Zea mays
  misc_feature: Ceres CLONE 1403611-F
  misc_feature (267)..(267): n is a, c, t, g, unknown, or other
  misc_feature (397)..(397): n is a, c, t, g, unknown, or other
  misc_feature (398)..(398): n is a, c, t, g, unknown, or other
  misc_feature (471)..(471): n is a, c, t, g, unknown, or other
  misc_feature (472)..(472): n is a, c, t, g, unknown, or other
aagctggagctccccgcggtggcggccgctctagaactagtggatcccccgggctgcaggaattcgcacgagaccattacctagaacatcctaatcgaaaaaacagaaccttcgttccctgccgtctcttgtcggtctggccggccgaggtgggtgatctgtagagcgaaaacgccgagccgggagaggagggaggccgcaccggcgattgtagaagcagaaccggtggaggagtagaggagggcgccgaatcgatgcgcggctccngcggacgccgtcgtggttgcttcgggacgtggtggcctcgtcgagcccgtccaaggcccgcgtcggcgttggacatgacgaggtacgcgaatccaccaccaatcccgttcgcctgccgctgcagctgagnntgcagcgttgtggtttcgtcgggtgttctttcctgagaccaaagccgcgaatttgcgctctcgtttccgcagnncagtgggttgttgccggctccttgcggggctgattcgaacaagttttctccttttcgtgccgtggtcgcggccccttctctgctgttctcctcgcaagctcttcgagggcgccgtttgatctgcgggcaaggccagttgttctcgcgtctcgcagcctgtgtctcacccgccacctggggcgggtggttcctccctgggcccg

SEQ ID NO: 29106 - DNA, 699 bp, Zea mays
  misc_feature: Ceres CLONE 1403615-F
  misc_feature: Encodes the peptide sequence at SEQ ID NO. 29107
  misc_feature (1)..(1): n is a, c, t, g, unknown, or other
  misc_feature (564)..(564): n is a, c, t, g, unknown, or other
  misc_feature (633)..(633): n is a, c, t, g, unknown, or other
  misc_feature (641)..(641): n is a, c, t, g, unknown, or other
naaagctggagctccccgcggtggcggccgctctagaactagtggatcccccgggctgcaggaattcgcacgagaccattacctagaacatcctaatcgaaaaaatcacgagaagggcgccgatctgggaaggcattgtcttgttgtactttcccttccggcagtggcctcgattcgcatccccttttcccgtccatgcgcgcgccggcgggcggtgccagtgccaccgcgctcgcggcggccatgaacattaagcagccgctgcacggcgcatcgacgctgttcgcgctgctctctctctcgctgctcctcctccgcctgctcctccgcctccgcctggccgccttccgcgacgcggcgctgtcgctccacctgctggcgcgcctccgcctccgccccgtcctcctctgcctcccggcagcctgccacgacggcggcgccggcgccggcgccaccacgctgcgcgtctggtgccccgccaccccatcctccaagccgccgctgctcctcctccacggcttcggcggggacgccaagtggacgtgggcgcgcaacctcccgcgnctgtcccgccacttccacgtgtacgcgccggacctcgtgttcttcggcgcgcagtcccgggtcgcgtcngcgctgcngctcgtggcgttccaggcccgctgcgcccgcgaggcatgcgccctcctcgcgtgcccc

SEQ ID NO: 29107 - protein, 168 aa, Zea mays
  misc_feature: Ceres CLONE 1403615-F
  misc_feature: SWISSPROT Homolog: EC 3.1.1.3 Triacylglycerol lipase
  misc_feature (149)..(149): Xaa is any aa, unknown, or other
MRAPAGGASATALAAAMNIKQPLHGASTLFALLSLSLLLLRLLLRLRLAAFRDAALSLHLLARLRLRPVLLCLPAACHDGGAGAGATTLRVWCPATPSSKPPLLLLHGFGGDAKWTWARNLPRLSRHFHVYAPDLVFFGAQSRVASALXLVAFQARCAREACALLACP

SEQ ID NO: 29108 - DNA, 710 bp, Zea mays
  misc_feature: Ceres CLONE 1403620-F
aaagctggagctccccgcggtggcggccgctctagaactagtggatcccccgggctgcaggaattcgcacgagaccattacctagaacatcctaatcgaaaaattcttttctgctgctgcgaccgtaggatcggcgtccagcagcctcgccgcgtcggtatggttttcccttggcccacacatcctagctcttccgcattcttgaatttcgtggtcgaggattagggggtttctcgtgcgctggtccaatttcgcgctaatcgtcctgttcctgcctcggattactcgccttctcgtggtccccatctgttcttggcgttcgcacgcttgccgtgcggcgggcagggctgcagcagcagccggtagcgcgtgcatcttgcgaccccctttccaagaaccagctgcaagctttggccttttccgcctgccgtacccgaaatcccgcaagaaactccacccaagaaaaaagcggcgcccttttggctggctggctgccattcctcacgccccacgagtttggtgaggctttgaaacgagcacagctcacaagacagtgaggctgcgaggggtgttccctcgtcggagatgcagggaaatttgccgccgcaaaccatgttcccaggcgggagccccttcaatctgggggaagcgtttcacttccccgtccaaccccgggggctccaggttttaccaggaaggctcccctgccc

SEQ ID NO: 29109 - DNA, 586 bp, Zea mays
  misc_feature: Ceres CLONE 1403627-F
  misc_feature (236)..(236): n is a, c, t, g, unknown, or other
  misc_feature (242)..(242): n is a, c, t, g, unknown, or other
  misc_feature (245)..(245): n is a, c, t, g, unknown, or other
  misc_feature (284)..(284): n is a, c, t, g, unknown, or other
  misc_feature (292)..(292): n is a, c, t, g, unknown, or other
ggagctccccgcggtggcggccgctctagaatagtggatcccccgggctgcaggaattcgcacgagaccattacctagaacatcctaatcgaaaaaccttgtctacaagggttttccgctgtcttatcccttcgtccacgctccctgcagccgccgcccaaaccctagcaacccgtcctcccgcatggccgacgaccactactccctctagaggaagtacgacgacccctcgccgncgccgnggngcacggggttctcttcgggcccgccgcctggctcgccgntcgggggnggggccccgtcgtaacacagcgtgccaccgccccccgatgaaatcagctccgcgagcagcgcgcgaaggaaatcgcgggccgaatttttaacggccgaaaggcaagggtctcccggtcaaaaaggggaaaaagaacgggggggtttcggggaaggcctgggaaaaattgggggggggggcccaatcggggggggaagagaaccggtttccccccccctgcgcggggggggggaccggggtttttatccccccaatttttttttttcaaagagagggcgccctcgaaatcccctt

SEQ ID NO: 29110 - DNA, 742 bp, Zea mays
  misc_feature: Ceres CLONE 1403628-F
  misc_feature: Encodes the peptide sequence at SEQ ID NO. 29111
  misc_feature (341)..(341): n is a, c, t, g, unknown, or other
  misc_feature (397)..(397): n is a, c, t, g, unknown, or other
  misc_feature (398)..(398): n is a, c, t, g, unknown, or other
  misc_feature (422)..(422): n is a, c, t, g, unknown, or other
  misc_feature (425)..(425): n is a, c, t, g, unknown, or other
  misc_feature (452)..(452): n is a, c, t, g, unknown, or other
  misc_feature (513)..(513): n is a, c, t, g, unknown, or other
  misc_feature (520)..(520): n is a, c, t, g, unknown, or other
caaagctggagctccccgcggtggcggccgctctagaactagtggatcccccgggctgcaggaattcgcacgagaccattacctagaacatcctaatcgaaaactgctcctctaccccttcctctcccggcgaccagctggcctctcctttgttgaggcgagagacccccacccgatccggcgatggacgccgcgtccaggccgcctccgccccacggagcaggggtccgcgtccgcgccccgctggtggagtctgtctcctgctactgcagattagatacaggccttaaaactgttgttgaggccaggaagtttgttcctggcgcgaaaatgtgcatgcnacctgaaagtcaacaaacaagcgcaaagtcaggggctcaaaaaaggaaaggtgcanngactcagcaccacttttacctggnctncctgatgatcttgctattgccctgccntatacgagtcctcgacttgaacaggccaaactcaggatggtttgcaaaagatggaacccgncttttgnctgggaaattactttacctccttgcgaaaaaaaatggaagtggccaaaaaatgggttggatgtcttttaaaagggaacggggaagggaaaaattcgggggatgcctttgacccctcccccccttttggaagcccctccccccctttccccaaaattttcaaaaaatttgggcttttgggggggccccttgagggggggttatcgaacttttttggggggaaa

SEQ ID NO: 29111 - protein, 148 aa, Zea mays
  misc_feature: Ceres CLONE 1403628-F
  misc_feature (53)..(53): Xaa is any aa, unknown, or other
  misc_feature (72)..(72): Xaa is any aa, unknown, or other
  misc_feature (80)..(80): Xaa is any aa, unknown, or other
  misc_feature (81)..(81): Xaa is any aa, unknown, or other
  misc_feature (90)..(90): Xaa is any aa, unknown, or other
  misc_feature (113)..(113): Xaa is any aa, unknown, or other
MDAASRPPPPHGAGVRVRAPLVESVSCYCRLDTGLKTVVEARKFVPGAKMCMXPESQQTSAKSGAQKRKGAXTQHHFYLXXLMILLLPCXIRVLDLNRPNSGWFAKDGTRLLXGKLLYLLAKKNGSGQKMGWMSFKRERGREKFGGCL

SEQ ID NO: 29112 - DNA, 618 bp, Zea mays
  misc_feature: Ceres CLONE 1403636-F
  misc_feature: Encodes the peptide sequence at SEQ ID NO. 29113
  misc_feature (564)..(564): n is a, c, t, g, unknown, or other
  misc_feature (579)..(579): n is a, c, t, g, unknown, or other
gagctccccgcggtggcggccgctctagaactagtggatcccccgggctgcaggaattcgcacgagaccattacctagaacatcctaatcgaaaaccacagcctccccagcatcagtgaagctcgctcaccgtcattcgacgacgccctcccgcacacacgaccatggccgcggcgatgaccggcagtgctcgcgccagcaccggctccttgctcgtgcttctcttcgtcgcgctggccggcgcgaccgccggggcgagtgccaccgttgccttcagcagcggcgacagcaacgcggcggcgctgctgacgacgccagcatcggcgtccccggggcagctgaacggcatcatccagtgccttatgggctgcttcacgcaggtggtcggctgttcgttcggatgcatgggcaagcagggcgctgacctgccgctctgcatcatcagctgcgaccagaagagcgtcgtgtgcatggtcagctgcggccttgcggcgtcaccgccatcaccgtcggcgcccacgcccaaaccacagcacccaggccgccacgcccaagccgcccggnccgccctacaccccngcgtacgccgccgctgccgtcaccggacgcaatctggct

SEQ ID NO: 29113 - protein, 151 aa, Zea mays
  misc_feature: Ceres CLONE 1403636-F
  misc_feature (134)..(134): Xaa is any aa, unknown, or other
  misc_feature (139)..(139): Xaa is any aa, unknown, or other
MAAAMTGSARASTGSLLVLLFVALAGATAGASATVAFSSGDSNAAALLTTPASASPGQLNGIIQCLMGCFTQVVGCSFGCMGKQGADLPLCIISCDQKSVVCMVSCGLAASPPSPSAPTPKPQHPGRHAQAARXALHPXVRRRCRHRTQSG

SEQ ID NO: 29114 - DNA, 688 bp, Zea mays
  misc_feature: Ceres CLONE 1403638-F
  misc_feature: Encodes the peptide sequence at SEQ ID NO. 29115
  misc_feature (206)..(206): n is a, c, t, g, unknown, or other
  misc_feature (213)..(213): n is a, c, t, g, unknown, or other
  misc_feature (225)..(225): n is a, c, t, g, unknown, or other
  misc_feature (240)..(240): n is a, c, t, g, unknown, or other
  misc_feature (276)..(276): n is a, c, t, g, unknown, or other
  misc_feature (359)..(359): n is a, c, t, g, unknown, or other
  misc_feature (372)..(372): n is a, c, t, g, unknown, or other
  misc_feature (470)..(470): n is a, c, t, g, unknown, or other
caaagctggagctccccgcggtggcggccgctctagaactagtggatcccccgggctgcaggaattcgcacgagaccattacctagaacatcctaatcgaaaaatccgccactacgccacaaaatcctctcctactccggcagttctgctcgccgccgcctccacgatgacggaagacgtgcagatgaacgactcggagccccagnctgcggnctcagctcccgncgtcggggcggcggngctctccacactacaccatctgaaggagatcgcgtncgtgatcgagggcgggtctctggtcaaggaggtcggcggatctccgcggctttcggctcacggtgcgctttcgtgcggctcgncgcgggggagagntcggctttctcggctttgcggtaaccgcgttcttcgaaaactaaagaggctcactgggctggtggccacgaagaagatactgagatgggtgttgatgntgcagcttctgccactcctattttattaaacatggtcgtccccgaggatgaaagataattggtactagctcgcactgagtattcttcatggtggatagaaacaattatgaggcttagggttggggcacggggacattgttccctctgaagaatacttaacgcagaacagctgaatggttttggacatcacaggggctctactatcactaaaggggtag

SEQ ID NO: 29115 - protein, 110 aa, Zea mays
  misc_feature: Ceres CLONE 1403638-F
  misc_feature (14)..(14): Xaa is any aa, unknown, or other
  misc_feature (16)..(16): Xaa is any aa, unknown, or other
  misc_feature (20)..(20): Xaa is any aa, unknown, or other
  misc_feature (25)..(25): Xaa is any aa, unknown, or other
  misc_feature (37)..(37): Xaa is any aa, unknown, or other
  misc_feature (65)..(65): Xaa is any aa, unknown, or other
  misc_feature (69)..(69): Xaa is any aa, unknown, or other
  misc_feature (102)..(102): Xaa is any aa, unknown, or other
MTEDVQMNDSEPQXAXSAPXVGAAXLSTLHHLKEIAXVIEGGSLVKEVGGSPRLSAHGALSCGSXRGRXRLSRLCGNRVLRKLKRLTGLVATKKILRWVLMXQLLPLLFY

SEQ ID NO: 29116 - DNA, 650 bp, Zea mays
  misc_feature: Ceres CLONE 1403639-F
  misc_feature: Translation starting site: 410
aaagctggagctccccgcggtggcggccgctctagaactagtggatcccccgggctgcaggaattcgcacgagaccattacctagaacatcctaatcgaaaaatcaggcccacgctttgttaacaaagaattccctcatagccgccgccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgccgctcgcgaatcgggggttccacacatagcttcgtcgttttgaatttgatgtactactggagtctaagggtgccaagaagtctagcagtagtcgttccatgatgtatgaagctccccttggctacagcattgaggacgttcgacctccggaggcgcgaagaagttccagtctgctgcttactccaactgcgcaaagaagccatcctgatatcgcttttggcttcctcgttctagaagtttaggatttcttttctgacacttcgattcttaacaatccccctggtctgctgctttcctgaaaatcgaccagttccccagtcttgctccccgcaagcctcc

SEQ ID NO: 29117 - DNA, 637 bp, Zea mays
  misc_feature: Ceres CLONE 1403642-F
  misc_feature: Encodes the peptide sequence at SEQ ID NO. 29118
tccccgcggtggcggccgctctagaactagtggatcccccgggctgcaggaattcgcacgagaccattacctagaacatcctaatcgaaaaaatccgtcttcctcctgtaaccagatctgaacccgcggcgacagaaacaaacgctcgctcgctcgttcgttgtccgttcattgtcttcgccggcgccgagggaccctgagagggcaggcgggcgagatggcgggcggcggcgttgaggacgtgtacggcgaggaccgcgctaccgaggagcagctgatcacgccgtgggccttctccgtcgcaagcggctacaccctgctgcgcgacccgcggcacaacaagggcctggcccttctcgggaggcggagcgcgacgcgcacttacctccggggcctgctgcccgccggcgctgggcgtcgcaggagctgcagggagaagaagctcatgcagaacctgcgccggtacgagcagccgctgcaccgctacttcgccatgatggacctgcaggagcgcaacgagaggctcttctacagctcctcacgacaacgtcgaggagtggctccccgtcgtctaccggccaccggtcgggagggatggcagaagtacggcgcatctacgccgccccgcagggctgta

SEQ ID NO: 29118 - protein, 140 aa, Zea mays
  misc_feature: Ceres CLONE 1403642-F
  misc_feature: SWISSPROT Homolog: EC 1.1.1.40 Malate dehydrogenase (oxaloacetate-decarboxylating) (NADP(+))
MAGGGVEDVYGEDRATEEQLITPWAFSVASGYTLLRDPRHNKGLALLGRRSATRTYLRGLLPAGAGRRRSCREKKLMQNLRRYEQPLHRYFAMMDLQERNERLFYSSSRQRRGVAPRRLPATGREGWQKYGASTPPRRAV

SEQ ID NO: 29119 - DNA, 722 bp, Zea mays
  misc_feature: Ceres CLONE 1403643-F
  misc_feature: Translation starting site: 559
  misc_feature: SWISSPROT Homolog: EC 2.3.1.119 Icosanoyl-CoA synthase
  misc_feature (667)..(667): n is a, c, t, g, unknown, or other
cagagctggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcggtgaggagcaggcgctgctgtcgacggagatcgtgaaccgcggcgtggagccgtcgggcccggacgccggctcgccggccttctcggtgcgcgtgcgccgccgcctgccggacttcctgcagacggtgaacctcaagtacgtgcgcctcggggaccactacctcatcagccacggcgagtacctggccaccatccccgtcatcgtgctggtgtgcggcgccgagctgggcagactcagccgcgacgagctgtggcgcaaggtgtaggggggaggccacctacgacctcgccaccgtgctcgacttcctcgccgtcctcgccttcaccatctccgtctacatcatgtccaggcccaggcccgtgtacctcatcgacttcgcatgctacaagccaggcgacgagctcaaggtgtcccaaggcggagttcatcgacctggcgcgcaagttcggncatgttcgacgaggtcagccttggcgttacaggtcgcgcctgcttgccaagtccg

SEQ ID NO: 29120 - DNA, 731 bp, Zea mays
  misc_feature: Ceres CLONE 1403644-F
  misc_feature (463)..(463): n is a, c, t, g, unknown, or other
  misc_feature (473)..(473): n is a, c, t, g, unknown, or other
  misc_feature (497)..(497): n is a, c, t, g, unknown, or other
  misc_feature (554)..(554): n is a, c, t, g, unknown, or other
cagagctggagctccccgcggtggcggccgctctataactagtggatcccccgggctgcaggaattcgcacgagaccattacctagaacatcctaatcgaaaaaaggataaaaatgacatgagttcccgttttgctcccgagttctctctcacgtccatccctctctctcgtctcgttctttagcagggccggctggagcgcccactcctccctccagcccggccccagccgcgccgccgcgccggtcgtagacccaacgcccgccgcccagcccagcgcgccctccggccgtgaggcggagaggatcgggcgggcctcggggcgagcgccacgcgtagacggcggttgaggagcctgagaaaacaacggtcctcctttcagatcctgatccctacgcgcaggcgtaggagattgtattccgtctgattaaatcgcggagagcaagcgggtggtgcggctgcncgagcatggncggcgaggaagctgccggaggcancgaaaccaggaggcccttggatctaaactgaatctcggcttcccttcattgccgggnccctcagtttggttggacccgacgttgatgcccaactgacccggggtggcccagaaatccccaataatggggaccctggagaattcttggccctggggggggaaccaattctcccgcaaagggcttttcccccccggggggccccccaggtgtggccccaaagttttttcgggggcc

SEQ ID NO: 29121 - DNA, 718 bp, Zea mays
  misc_feature: Ceres CLONE 1403648-F
  misc_feature: Encodes the peptide sequence at SEQ ID NO. 29122
  misc_feature (413)..(413): n is a, c, t, g, unknown, or other
acaaagctggagctccccgcggtggcggccgctctagaactagtggatcccccgggctgcaggaattcgcacgagaccattacctagaacatcctaatcgaaaacacacaacccaaagcagccacagcagcctccttcctcctctcactctcgctcgcgctgcgctcgctacctcgcttcgcattccattcgaaaagaggggaggaaaggcaagatgttcatcgagagcttccgcgtcgagagcccccacgtgcggtacggcccgatggagatcgagtcggagtaccggtacgacacgacggagctggtacacgagggcaaggacggcgcctcacgctgggtcgtccgccccaagtccgtcaagtacaacttccggaccagaaccgccgtcctccagctcggggtgatgcttngtggggtggggaggcaaaacacgggtcacgctgacggctggggtcattgcaacagggaggggatctcatgggcgaccaaggacaaggtgcagaagccaactactacgggtccctaccccaggcctcccccatcaaagcgggagtttacacggggaggagatttaggcccgttaaaaagcctctttcaaatggacccaaaacaattgggttgcggggggggaattaaaaaaaaaaactgggccatctttaacagggcaggggggtgattttcccttaaaaaaaactccccccccagggggcggggt

SEQ ID NO: 29122 - protein, 154 aa, Zea mays
  misc_feature: Ceres CLONE 1403648-F
  misc_feature: SWISSPROT Homolog: EC 5.5.1.4 Inositol-3-phosphate synthase
  misc_feature (67)..(67): Xaa is any aa, unknown, or other
MFIESFRVESPHVRYGPMEIESEYRYDTTELVHEGKDGASRWVVRPKSVKYNFRTRTAVLQLGVMLXGVGRQNTGHADGWGHCNREGISWATKDKVQKPTTTGPYPRPPPSKREFTRGGDLGPLKSLFQMDPKQLGCGGGIKKKNWAIFNRAGG

SEQ ID NO: 29123 - DNA, 681 bp, Zea mays
  misc_feature: Ceres CLONE 1403650-F
  misc_feature (218)..(218): n is a, c, t, g, unknown, or other
  misc_feature (352)..(352): n is a, c, t, g, unknown, or other
  misc_feature (353)..(353): n is a, c, t, g, unknown, or other
  misc_feature (411)..(411): n is a, c, t, g, unknown, or other
  misc_feature (648)..(648): n is a, c, t, g, unknown, or other
ctccccgcggtggcggccgctctagaactagtggatcccccgggctgcaggaattcgcacgagaccattacctagaacatcctaatcaaaaaaattgcgacgccgccgccgtcactgtcgccgcaggagtgcgaaccacgctgccgcccgctcccgccgcccaaacagctttatccgagccccgattcgccggatcacatgctgcggccacctctcanatgacctctcaactccagagcactttgctcctgctcccgctcttcgccgccgctgctttggggccgcggcggcgacgcctcgactgcgccggtcgctggagttccaccatcggttctcgcaccgctgcggcggnntgggtgaaaggcccgaggggcgcgctccccggggggggggggccggcttcccggaagnggcccgcgtacgtccgccgcccttggccggccacgatcgcccccccgggggcggggtcggcaagcaaaggggggaaataaaccaggggacgcaccacccgctcacttttccggccgagggaaaatgccacccctcaaggtcaggaaaacctccggattttttgcacctatggctcttggggaccgttggcacacccgggccaaaagttcattgggggggccctggaaacaaggcagngaatcctcttcgggttgcccttggccaggggga

SEQ ID NO: 29124 - DNA, 821 bp, Zea mays
  misc_feature: Ceres CLONE 1403651-F
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
ggggaaaagggggannngggaaagggaaaggaacgaaagcaacaaaaaaaaaacccccccccccaactggagctccaccgcggtggcggccgctctagaactagtggatcccccgggctgcaggaattcgcacgagaccattacctagaacatcctaatcaaaaaaattgcgacgccgctcgccgtcactgtcgccgcaagagtgcgaaccacgctgccgcccgctcccgccgcccaaacagctttatccgacccccgattcgccggatcacatgctgcggccacctctcaaatgacctctcaactccagagaactttgctcctgctcccgttcttcgccgccgctgtttaggcccacggaggaaaacccctccactgcgccgtagctggagttccaccatgcgcctctcccccaccgttggcaaaaatagtgttggcggccccaagggcggcggcgctccctgggcgggatgggccgggattcccggcaaaccgcccacgttcggtcgacccgccccttggccagggccaaccaacccgcccacccgggacggggggttcgtttagccatgggcggatagtaacccggggcgagcacaccccccggtttcatctttatcaacaggagggaaaaaggccccccccctgcaaaggctcaagcaaaccctggggaattctttcggccccaacggcctcctcggaacaaccggttcgaacaacccccgtgccaaagacccctttccgggggggggccccttgggcaaaaggggaagagggacttttctttcaggggatgctccttgggccacacggacaacccg

SEQ ID NO: 29125 - DNA, 666 bp, Zea mays
  misc_feature: Ceres CLONE 1403655-F
  misc_feature: Encodes the peptide sequence at SEQ ID NO. 29126
  misc_feature (284)..(284): n is a, c, t, g, unknown, or other
tggagctcaccgcggtggcggccgctctagaactagtggatcccccgggctgcaggaattcgcacgagaccattacctagaacatcctaatcgaaaacccaagggtcggctaggtgtaggagcgatccaaggtttccgcctttccacgccaccattctccacacccgtgagcctcagcaatcacccatccagcatcgccgattcgccgcggcaccgacacctcgacgtacatggacgcgtcgtcctcgagtgacaacccgtccccagaggcacacgagcagcgngagcaggagactctcgtctccggcgccatctccctcacggtcatcgggggcgccttctcgcgctccaccgtcaacgcgctgacgggatgacctcgcgccgacgtgcgactcgtttcgtctgcccggatccccgatgccgccgccgccggaacttcaaggaaatactcagggggggctcggtcacgccttggggctccaaatttttacggccatggaaattggcggcggttgaggaaagggcgacaccggatgggccccaggtccccaaagaggaacaaaccattggttggcccgggggagaagccctcccaatagaattggaggggtttttcggaaagaaccgtgccccacggggccgggggtggaaacaaccgggggggtt

SEQ ID NO: 29126 - protein, 47 aa, Zea mays
  misc_feature: Ceres CLONE 1403655-F
MDASSSSDNPSPEAHEQREQETLVSGAISLTVIGGAFSRSTVNALTG

SEQ ID NO: 29127 - DNA, 671 bp, Zea mays
  misc_feature: Ceres CLONE 1403656-F
  misc_feature: Encodes the peptide sequence at SEQ ID NO. 29128
  misc_feature (456)..(456): n is a, c, t, g, unknown, or other
ggagctccccgcggtggcggccgctctagaactagtggatcccccgggctgcaggaattcgcacgagaccattacctagaacatcctaatcaaaacaaaccctagtctcagagcagccgcatccacaacctgcctctctcgtcccctggcggcgtccgcggcaggatggcggaatctacggcgaggacggtgaaggatgcaacccgcacgagttcgtcaaggcctactccgcccacctcaagcgctccggcaagatggagctccctgagtgggttgacattgtgaagactgcgaggttcaaggagcttcctccttatgatcctgactggtactacatcagggctgcatccattgcaaggaagatctacctaaggcaaggcatcgggtgtgggtggctttcagaagatctacggtggccgccagaggaatggctcccgcccacacattctgcagagnaaagggttgctgttgcacgcaacatcctgcagcagctgcagatatggcaattcaatcgatgcgataccccaagggtggacgcctcatcacaaccaggggaaaggccggatctggacaggggggtggaaaaagggctcccttttttaaacggggagcagggccctccttgggttccaagggggcctggtttttaggagggaaaaaaaaccttgcct

SEQ ID NO: 29128 - protein, 131 aa, Zea mays
  misc_feature: Ceres CLONE 1403656-F
  misc_feature (1)..(112): Pfam Name: Ribosomal_S19e Pfam Description: Ribosomal protein S19e
  misc_feature (68)..(68): Xaa is any aa, unknown, or other
MELPEWVDIVKTARFKELPPYDPDWYYIRAASIARKIYLRQGIGCGWLSEDLRWPPEEWLPPTHSAEXRVAVARNILQQLQIWQFNRCDTPRVDASSQPGERPDLDRGVEKGLPFLNGEQGPPWVPRGPGF

SEQ ID NO: 29129 - DNA, 660 bp, Zea mays
  misc_feature: Ceres CLONE 1403658-F
  misc_feature: Encodes the peptide sequence at SEQ ID NO. 29130
ggagctccccgcggtggcggccgctctagaactagtggatcccccgggctgcaggaattcgcacgagaccattacctaaaacttcctaatcgaaaagaaaataagaatatctctcaaccatctatagacagcggcccgtgcagcgaacagaggaacgagtaagactgcgtggacgacgacatcctcgcgaaggacagactggtctgatcgacagctctcgattccggaaggagttggtcaagaactgctcatcctgatgagaatatgaaatccaatccgggggactgagatacgttcgcgacccggatagaattggtaggaatgccacattgaaggatgcgagatgttaaacatatattcatctgatgacgatgcccacaggagcaacaacaaacatgagagtgcgagtgaggctcctggtgtcactagtacgaataagttgaaccatgcagctgtggctgagaatattcaaggcgtcttccctgcaataaaagggtcggatccacaggaaatcgtattcatagaacatcctacatgatgacagggataggatcccacaatataaacagttgctggtgactgcatttatagactgcaaagacagctcctacgacattctctttcgaggaaaaagaatagcagtcgctgaaaccatatgcc

SEQ ID NO: 29130 - protein, 64 aa, Zea mays
  misc_feature: Ceres CLONE 1403658-F
MLNIYSSDDDAHRSNNKHESASEAPGVTSTNKLNHAAVAENIQGVFPAIKGSDPQEIVFIEHPT

SEQ ID NO: 29131 - DNA, 620 bp, Zea mays
  misc_feature: Ceres CLONE 1403664-F
  misc_feature: Encodes the peptide sequence at SEQ ID NO. 29132
  misc_feature (74)..(74): n is a, c, t, g, unknown, or other
  misc_feature (120)..(120): n is a, c, t, g, unknown, or other
  misc_feature (126)..(126): n is a, c, t, g, unknown, or other
  misc_feature (325)..(325): n is a, c, t, g, unknown, or other
cgctctagaactagtggatcccccgggctgcaggaattcgcacgagaccattacctagaacatcctaatcgaanaataaataacacacaaagttgtccgatcaaagcttgcgcgtttacnatgtcntggacgatcaaggcacttcacaatgtccaccccttctcgctacgagcttcttctttgtactcctatgcagctcgctacaagtacgtggcgtgaactacacgttcgtgaaagacgcggcgctgccgcccagcgtgtcgtatacacacctccatccggggggcgggggcccggccgggggcccgctgcaccccaccctttncggaaggcttccccgggggtggggggtgggggggggggccccccccctaaaaaaaaaaacggattgggggaaaggggcccccttccgggaaaccccttttggaaacccccccccgggttccccccccaaagtttttttgggtaaaaaaagagggggttaaaacccggcgcccgggtgtttttttgccccgaaaattttataaaaagggggttttaaaaggggggcaaaaaaaaaaaaaatgggggggggagcggggggaaaaaccgggggcccccccatgggtgaacaacagggg

SEQ ID NO: 29132 - protein, 32 aa, Zea mays
  misc_feature: Ceres CLONE 1403664-F
MSWTIKALHNVHPFSLRASSLYSYAARYKYVA

SEQ ID NO: 29133 - DNA, 647 bp, Zea mays
  misc_feature: Ceres CLONE 1403668-F
  misc_feature: Translation starting site: 190
  misc_feature (216)..(216): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (269)..(269): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (415)..(415): n is a, c, t, g, unknown, or other
  misc_feature (443)..(443): n is a, c, t, g, unknown, or other
  misc_feature (449)..(449): n is a, c, t, g, unknown, or other
  misc_feature (456)..(456): n is a, c, t, g, unknown, or other
  misc_feature (457)..(457): n is a, c, t, g, unknown, or other
  misc_feature (540)..(540): n is a, c, t, g, unknown, or other
  misc_feature (542)..(542): n is a, c, t, g, unknown, or other
  misc_feature (580)..(580): n is a, c, t, g, unknown, or other
  misc_feature (586)..(586): n is a, c, t, g, unknown, or other
tggagctcaccgcggtggcggccgctctagaactagtggatcccccgggctgcaggaattcgcacgagaccattacctagaacatcctaatcgaaaaaagtctggccaggtctctcccatatcgggttctcccttcctcttcctgtttccgcgcgcgagatcgccgccccgggtgggctctagatcccgatggcctcgcgccgccgcacccctggncttcaagggttcatttcatcctcggnnncgacagcgggggttgggaaagaacnttctnnnnnnnnnnnnnnnnnnnnnnnnnnnnnnnnnnnnnnnnngnnnnnnnnnnnnnnnnnnnnnnnnnnnnnnnnnnnnnnnnnnnnnngnnnnnnnnnnnnnnnnnnnnnnngnnngnnnnnnagnnnnnnnnnnnnnnngngggggggggggggggggcgggggggggngggcgnggggggnnggggggggggggcggggggggggggggggggggggggcgcggggggcgcggccggcgcgcgggggcggggcggcggggggcgncncggggcgggcgcgggggggcggggggcggggggcgccnccggcngcgcgggcggcgggggggggggggggcgggggagggcgggggcggcgggcaggggggcggg

SEQ ID NO: 29134 - DNA, 719 bp, Zea mays
  misc_feature: Ceres CLONE 1403673-F
  misc_feature (440)..(440): n is a, c, t, g, unknown, or other
  misc_feature (494)..(494): n is a, c, t, g, unknown, or other
  misc_feature (510)..(510): n is a, c, t, g, unknown, or other
caaagctggagctccccgcggtggcggccgctctagaactagtggatcccccgggctgcaggaattcgcacgagaccattacctagaacatcctaatcgaaaactaggctttcagccgctctcctagtctcctactctcctctcagccgtcgccgtcgctctccacaccgctctcctctctcctccgagccgcagctcttctctctccctctcccctgcgtgccgccactgcgggcaccctgcacgccgccgctgcgtggccctacacgccaccgctacgggtgccctacgcgccgccgtcactgctccagctctcctctgtttcccagccaatgccgccgctctaactccccaggcatcgccccgacgacggctcaacgaagccccgtcgacgcctcgcggacgccctggcgcgcagcgggcgctttacgctccatggncaggcgcgtagatgcctcagggtccacagggcgctttagcgctaagcgacgctnaggcgcgcttcagatnagcatgcttttggaataagatggaaggataaagctccatgggaagaatctagacctaccatgggattcaggggttggtttcctattttccaaccgttcaacctggtcctggatggtaagggattccttagggagatggttttctgtggaaaaaaaaacttgggggtgagatttaaccccccccccaaaaccttggaaagggtttccaaa

SEQ ID NO: 29135 - DNA, 707 bp, Zea mays
  misc_feature: Ceres CLONE 1403674-F
  misc_feature: Encodes the peptide sequence at SEQ ID NO. 29136
  misc_feature (500)..(500): n is a, c, t, g, unknown, or other
aaagctggagctccccgcggtggcggccgctctagaactagtggatcccccgggctgcaggaattcgcacgagaccattacctagaacatcctaatcgaaaaaaaaagcagcagcagcagaccttcttgacctagcaagcaatggggccgccgttcctcgccgtcgccgtcatcgtcgccttcctggccgccgccgcgcaggccgccgaccccttcgccttcttcgactgggacgtctcctacatcaccgcctcccctctcggcgtcccgcagcaggtcatcgcagtcaacaagcagttcccaggccctatcatgaacgtcactaccaactacaatgtggtcgtcaatgtgctcaacagcttagacgagcccctgctcatcacttgggatgggatccagcagcgcaagaattgctggcaggatgggggtctcgggaccactgccccataccgcccggttggaaactgaacctacaacttccggggcaaggaccaaatggnagtttctttacttccacccttggaatgcaccggccccgggggggtttcaaagaatcactgaaaaaaacccggggggaattttgggcccattgaaaacccccaaggggaactccccctttttacgggggagggggaaaaaagaaacccccccccctttgagaaaaattccccaaccccccaaaaaatgggggggcccccaaagggttt

SEQ ID NO: 29136 - protein, 108 aa, Zea mays
  misc_feature: Ceres CLONE 1403674-F
  misc_feature (31)..(109): Pfam Name: Cu-oxidase_3 Pfam Description: Multicopper oxidase
  misc_feature: SWISSPROT Homolog: EC 1.10.3.3 L-ascorbate oxidase
MGPPFLAVAVIVAFLAAAAQAADPFAFFDWDVSYITASPLGVPQQVIAVNKQFPGPIMNVTTNYNVVVNVLNSLDEPLLITWDGIQQRKNCWQDGGLGTTAPYRPVGN

SEQ ID NO: 29137 - DNA, 727 bp, Zea mays
  misc_feature: Ceres CLONE 1403675-F
  misc_feature: Encodes the peptide sequence at SEQ ID NO. 29138
  misc_feature (542)..(542): n is a, c, t, g, unknown, or other
  misc_feature (580)..(580): n is a, c, t, g, unknown, or other
  misc_feature (601)..(601): n is a, c, t, g, unknown, or other
aaagctggagctccccgcggtggcggccgctctagaactagtggatcccccgggctgcaggaattcgcacgagaccattacctagaacatcctaatcgaaaagagattcgccgtctcaccccttccctgcctgctccctcgtctaagaaaagcgggcagagcagaagacggcggcggcaggccatcgcggactcccgctcaccctcgtctgccaccgcctcccaggtcaggggccgacggcgacgggtggggaggggcggcagaggtagtccgaggggaggctgtggagcggagggcggagagaggccacgccgtccggagtctccagttccgtcgccacagcttcctgccgcgcctgggccgaggtaaacgagagggatcgaggaagaagtatcccccggagccccttcccccgaacccgaaggctccggaatggcgcactgggttagcgacagtgatggcagtgacaactttgaatgggatagtgatggcaatgggggaggagccagcgaacttcaatgctgctgggtgccggttcatcnagctctgagatcaacgaacactgatgctccaggtcctnccaacacgggttgctaatggncattggggaaggctgggccattctgcctcctttggtcaaaagtatatggggacatggggttcaccgggaagagattttgttcggaaagccatgaaggacaaatggggaataaatggggagcagatt

SEQ ID NO: 29138 - protein, 54 aa, Zea mays
  misc_feature: Ceres CLONE 1403675-F
  misc_feature (37)..(37): Xaa is any aa, unknown, or other
  misc_feature (50)..(50): Xaa is any aa, unknown, or other
MAHWVSDSDGSDNFEWDSDGNGGGASELQCCWVPVHXALRSTNTDAPGPXNTGC

SEQ ID NO: 29139 - DNA, 715 bp, Zea mays
  misc_feature: Ceres CLONE 1403676-F
  misc_feature (557)..(557): n is a, c, t, g, unknown, or other
  misc_feature (689)..(689): n is a, c, t, g, unknown, or other
  misc_feature (690)..(690): n is a, c, t, g, unknown, or other
  misc_feature (707)..(707): n is a, c, t, g, unknown, or other
aaagctggagctccccgcggtggcggccgctctagaactagtggatcccccgggctgcaggaattcgcacgagaccattacctagaacatcctaatcaaaaagcggcggtgttgacccacccacccgttcctcccccaccccatcagcgctggaggcggcggtgcgtaagtcccccggacccttcggcggcggcggcggcgcgcggttatgccgagaggctcccaggtttcatcatcgtgctctgctggagttatagcattttcagcaaggatatggagtacaccccctgcacagcaagttcctctgtatcccacatctcgctgctcgaggaagttcttggctggaggttttgtctttacggagacttcctggtcatctcttttgtcaactgcacttgaggatcaacccacgcttagtgactgccttgcctggtcccatgctgtcagacattagagttgcccagtgattacactattacagtgcagctgtagcacatttatttgagcatgggtggatctgtttctctggcaacattccagtaatcttttgtcttggntgctatcagccagcagaagttaccatcaagacatctttggacacttggatctaacgcttagagctttgcttcctataggctcttagggttgggggttttcgttttctgctagctttctctactctacatggnnagtttcagttgatcggnccaaaagt

SEQ ID NO: 29140 - DNA, 699 bp, Zea mays
  misc_feature: Ceres CLONE 1403677-F
  misc_feature: Encodes the peptide sequence at SEQ ID NO. 29141
  misc_feature (290)..(290): n is a, c, t, g, unknown, or other
  misc_feature (661)..(661): n is a, c, t, g, unknown, or other
  misc_feature (671)..(671): n is a, c, t, g, unknown, or other
aagctggagctccccgcggtggcggccgctctagaactagtggatcccccgggctgcaggaattcgcacgagaccattacctagaacatcctaatcgaaaaaatgaccattgcgtgatagatcgcaccggtctcggtctccgtgtctcactctcaagttgcagcagccagtcatttcgttggcaaccagggcagaaataaatatccgtggataagagctgcgctgtgtgctgctgagatatcaagaacggtagggtggaagacaaggccccgttctcgattaacccaagncaaagagtcagagggagagagagagagagagtcgtattggtcgcacctgtcgaagggttttcggtgtctcctgagccacagctgctgctgctgctggaaccatggagatggaggccgtggagtcgcacggcggcgccggtcgccggacgcccaagagggatcgcggcatctcctgggcctgcgtcttcatcctggcgagtaactgcttccagttcatcgcctacttcgccgtgtcgacgaacctggtgaactacctcaaggaccgcctgcaccagggcagcaaagccgccgcgaacgggtcaccaaactggatgggcacgagcgccatcacgccgctcgtcgccgccttcctcgccgacgctttcctcggnagatactggnacatcgcgctcttcttggtcatctccgc

SEQ ID NO: 29141 - protein, 102 aa, Zea mays
  misc_feature: Ceres CLONE 1403677-F
  misc_feature (94)..(94): Xaa is any aa, unknown, or other
MEMEAVESHGGAGRRTPKRDRGISWACVFILASNCFQFIAYFAVSTNLVNYLKDRLHQGSKAAANGSPNWMGTSAITPLVAAFLADAFLGRYWXIALFLVIS

SEQ ID NO: 29142 - DNA, 731 bp, Zea mays
  misc_feature: Ceres CLONE 1403678-F
  misc_feature: Translation starting site: 168
  misc_feature (385)..(385): n is a, c, t, g, unknown, or other
  misc_feature (539)..(539): n is a, c, t, g, unknown, or other
  misc_feature (540)..(540): n is a, c, t, g, unknown, or other
  misc_feature (542)..(542): n is a, c, t, g, unknown, or other
  misc_feature (551)..(551): n is a, c, t, g, unknown, or other
  misc_feature (557)..(557): n is a, c, t, g, unknown, or other
  misc_feature (590)..(590): n is a, c, t, g, unknown, or other
aaagctggagctccccgcggtggcggccgctctagaactagtggatcccccgggctgcaggaattcgcacgagaccattacctagaacatcctaatcaaaaagttagtagttcaccagagttcacacaaaaatcacaagcaagcagtcgcgtgtgtagctcgcaacaatggcgacgaaccccggcctcttcaccgagtggccgtggaagaagctcggcaacttcaagtacctgctgctggcgccgtgggtggcgcacggcggctaccaagcggcgaccaaaggggtggagggcggccgacctggggtacgtggccatcctcccgtcgctgctcctccgggcgctgcacaaccaggcgtggatcaccgcgtcccgcctgcagagcngcgcgcggccggcggcaggtcgtggaccgcggcatcgagttcgagcaggtggaccgcgagcgcaactgggacgaccagatcctgctcagcggcatcctcctgtacctgggctcactaacccttggcgggggggccagaaccctgccgctggtgnngncgcggacgncgcccncgctcatcggccctgctgcacgcccggccccgntcgagctcgtctactactgggctgcaccgcgcgctgcaccaccaacttcctctactcccgttaccactcccaccaccaggcctccttcgtcaccgagccaatcacctcccgtcatccatccatttggtgagcttcgggcgt

SEQ ID NO: 29143 - DNA, 670 bp, Zea mays
  misc_feature: Ceres CLONE 1403684-F
  misc_feature (156)..(156): n is a, c, t, g, unknown, or other
  misc_feature (174)..(174): n is a, c, t, g, unknown, or other
  misc_feature (175)..(175): n is a, c, t, g, unknown, or other
  misc_feature (184)..(184): n is a, c, t, g, unknown, or other
  misc_feature (185)..(185): n is a, c, t, g, unknown, or other
  misc_feature (203)..(203): n is a, c, t, g, unknown, or other
  misc_feature (259)..(259): n is a, c, t, g, unknown, or other
  misc_feature (318)..(318): n is a, c, t, g, unknown, or other
  misc_feature (320)..(320): n is a, c, t, g, unknown, or other
  misc_feature (325)..(325): n is a, c, t, g, unknown, or other
  misc_feature (342)..(342): n is a, c, t, g, unknown, or other
tccccgcggtggcggccgctctagaactagtggatcccccgggctgcaggaattcgcacgagaccattacctagaacatcctaatcgaaaagtggtggtggagatggagtggacgcgttcatgcccgcgcctagctagctagcttacctgtccacngcctccgtgctgtgtccnntcttggctnntctctttcccgctctccntcctcgcttgccccccgccagctcgatctccagggagtggactagtgcagggaggnagggaagaaaggagtggtgcagctgtgagtgaagccgcctctcgttccctttgatgatngnagccnaacccgaatgtgatgcnagagaagtgggcaaattaacacccgttgcaaggaaccaactgagcaatcctcttgaggcccaaaccccccctttccagttaccatttcctgaagggacaatcacgggtttttttttaaaaaaatgcctggggcaaattccaaaatccgggaggttgggagggccccacccccccgggggccaaaaaaggggccccctttgccccccccccccgaaagggattttggggggtggcccccccaaggggggggcgttttttaaaaaaaggcggggaagagccccccccccccgggggggggccccttaaaggggggggcacccccctcgcg

SEQ ID NO: 29144 - DNA, 697 bp, Zea mays
  misc_feature: Ceres CLONE 1403686-F
  misc_feature: Encodes the peptide sequence at SEQ ID NO. 29145
  misc_feature (384)..(384): n is a, c, t, g, unknown, or other
  misc_feature (420)..(420): n is a, c, t, g, unknown, or other
  misc_feature (450)..(450): n is a, c, t, g, unknown, or other
  misc_feature (452)..(452): n is a, c, t, g, unknown, or other
  misc_feature (465)..(465): n is a, c, t, g, unknown, or other
  misc_feature (466)..(466): n is a, c, t, g, unknown, or other
  misc_feature (474)..(474): n is a, c, t, g, unknown, or other
  misc_feature (550)..(550): n is a, c, t, g, unknown, or other
aaagctggagctccccgcggtggcggccgctctagaactagtggatcccccgggctgcaggaattcgcacgagaccattacctagaacatcctaatcgaaaaatcgatccgccaccacgccacaaaatcctctcctactccggcagttctgctcgccgccgcctccacgatgacggaagacgtgcagatgaacgactcggagccccagcctgcggcctcagctcccgccgtcggggcgccggcgctctccactctacaccatctgaaggagatcgcgtccgtgatcgaggccggttctctgtccaaggaggtccgccggatctcccgcgccttccgcctcaccgtcgcgctccgtcgccgcctcgccgcgcgggacgtctccgncttcctcgccttcgcgctacccgcgtcctccgaagncctacgacgcctcactggcctggtgcccangnagatgatactgannatggatgntgatgctgcagctccagcaactcagatttcaatcaacatgggctccctgagatggaataaatggctacttgctcgnactgatttttcttaattgacatagaaatatgatgggcctaggcatgcgcagtgggagcattgctcggctgaaaatcttaaccgaaaaaggtgtgggggttttggatccggaccgacctctataatcctataggggatgggctaaccc

SEQ ID NO: 29145 - protein, 131 aa, Zea mays
  misc_feature: Ceres CLONE 1403686-F
  misc_feature (72)..(72): Xaa is any aa, unknown, or other
  misc_feature (84)..(84): Xaa is any aa, unknown, or other
  misc_feature (94)..(94): Xaa is any aa, unknown, or other
  misc_feature (95)..(95): Xaa is any aa, unknown, or other
  misc_feature (99)..(99): Xaa is any aa, unknown, or other
  misc_feature (102)..(102): Xaa is any aa, unknown, or other
MTEDVQMNDSEPQPAASAPAVGAPALSTLHHLKEIASVIEAGSLSKEVRRISRAFRLTVALRRRLAARDVSXFLAFALPASSEXLRRLTGLVPXXMILXMDXDAAAPATQISINMGSLRWNKWLLARTDFS

SEQ ID NO: 29146 - DNA, 701 bp, Zea mays
  misc_feature: Ceres CLONE 1403687-F
  misc_feature: Translation starting site: 388
  misc_feature: SWISSPROT Homolog: EC 2.3.1.41 Beta-ketoacyl-acyl-carrier-protein synthase I
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (391)..(391): n is a, c, t, g, unknown, or other
  misc_feature (392)..(392): n is a, c, t, g, unknown, or other
  misc_feature (397)..(397): n is a, c, t, g, unknown, or other
  misc_feature (412)..(412): n is a, c, t, g, unknown, or other
  misc_feature (422)..(422): n is a, c, t, g, unknown, or other
  misc_feature (460)..(460): n is a, c, t, g, unknown, or other
  misc_feature (482)..(482): n is a, c, t, g, unknown, or other
  misc_feature (513)..(513): n is a, c, t, g, unknown, or other
caaagctggagctccccgcggtggcggccgctcttgaactagtggatcccccgggctgcaggaattcgcacgagaccattacctagaacatcctaatcaaaaaggacaccactcatctttcttctcccccgcctcgtttccatcgccaccaccctcttcttcctgcggtccttcccccgtcccactcccaccccccttcgcctccgcctccactgcagctgccgccattgcagaagcctcctcctgcccaccgctgccgtggccccggtggcgcctccgtgcggaaggcggaatctcccgggacgcctctccgtccgcgcctccgcgacggtggtagcggcaccgcggcgggagacggatccaagaagcgggtggtgatcacggnnnatgnngctgntctccgttttcgggnaacgatgtanacgcttactacgaccgcctgctagtcggggagagcggnattcggcccatcgaccgtttcnacgcttctaagttcccacccgctttgccggncaaaatccgggtttctcctcgagggatacttcaccgaaaaacaacccgcccccttatgatgcctccaaactggattcccagggggaaaaaggttttcaaggcccccggattccccccggttctggccctggaaaaatatgcaaaccccggccccggttttttgggccccttaatatggcgccccccgt

SEQ ID NO: 29147 - DNA, 687 bp, Zea mays
  misc_feature: Ceres CLONE 1403691-F
  misc_feature: Encodes the peptide sequence at SEQ ID NO. 29148
cagagctggagctccccgcggtggcggccgctctagaactagtggatcccccgggctgcaggaattcgcacgagaccattacctagaacatcctaatcgaaaagcaatcttcaatctccccagcaatccctagcagaagccttccatcctcactcgctcgatggcccgcacgaagcagacggcgaggaagtccaccggcggcaaggcgccgaggaagcagctggcgactaaggcggcccgcaagtctgcccctgcgaccggcggagtgaagaagccccaccgcttccgccccggcaccgtcgcgctccgggagatccgcaagtaccagaagagcacggagctgctgatccgcaagctgccgttccagcgcctggtgcgggagatcgcgcaggacttcaagaccgacctacgcttccagagctctgctgtctccgcgctgcaggaggcggctgaggcctaccttgtcgggctcttcgaggacaccaacctctgcgccatccacgccaagcgcgtcaccatcatgcccaaggacatccagcttgcccgccgcatcccgcggggagagggcctaagcgtcatattttctgtcatcagtgcccgatcagaagatgaagaatatgctgggttcctgggagtttgggggtactgtcgaatcatccgaagggttggctgttcactgctggtact

SEQ ID NO: 29148 - protein, 175 aa, Zea mays
  misc_feature: Ceres CLONE 1403691-F
  misc_feature (58)..(132): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIPRGEGLSVIFSVISARSEDEEYAGFLGVWGYCRIIRRVGCSLLV

SEQ ID NO: 29149 - DNA, 703 bp, Zea mays
  misc_feature: Ceres CLONE 1403693-F
  misc_feature: Encodes the peptide sequence at SEQ ID NO. 29150
  misc_feature (435)..(435): n is a, c, t, g, unknown, or other
  misc_feature (569)..(569): n is a, c, t, g, unknown, or other
  misc_feature (623)..(623): n is a, c, t, g, unknown, or other
caaagctggagctcaccgcggtggcggccgctctagaactagtggatcccccgggctgcaggaattcgcacgagaccattacctagaacatcctaatcgaaaagttcgccttcctcgcccccatctctttctcgccgtgccactcccacctcttttcgctgataagcacgccgctactccccactccatccatccacccgccgcttttctctcttctttggagaagagccgcacgcagtggttgctgccgctggtccgccagggtcccgggcgctgtgctcattccaccggtcggcggtgcactttcaggcttcttcgacggcgtcgagagtggaggaaatgtcgaccacggagtgcgcggacctcggggaggagttctggctgccggaggactttttggacgacgacttcttctccgaggaggagaaaggcggncgtggcggcccggagcgagagcgacgaggaggaccagcctggcgggtctctcgcggccgcctcgcgggcctcctcggcgacggggggagagcgcaaggctcccgcgggcaaggcggaggtgaacggttgggtcnccgcaagtcgacgctgtgcgggctggccaagtcgggggcaggagagccccagcnggcggggcgtcaaagggcacctcccccgccgtcgtcgccccctggaagcagaggccccgaaaaaccggtgggatctgatc

SEQ ID NO: 29150 - protein, 121 aa, Zea mays
  misc_feature: Ceres CLONE 1403693-F
  misc_feature (77)..(77): Xaa is any aa, unknown, or other
  misc_feature (95)..(95): Xaa is any aa, unknown, or other
MSTTECADLGEEFWLPEDFLDDDFFSEEEKGGRGGPERERRGGPAWRVSRGRLAGLLGDGGRAQGSRGQGGGERLGXRKSTLCGLAKSGAGEPQXAGRQRAPPPPSSPPGSRGPEKPVGSD

SEQ ID NO: 29151 - DNA, 677 bp, Zea mays
  misc_feature: Ceres CLONE 1403695-F
  misc_feature: Encodes the peptide sequence at SEQ ID NO. 29152
  misc_feature (384)..(384): n is a, c, t, g, unknown, or other
  misc_feature (494)..(494): n is a, c, t, g, unknown, or other
  misc_feature (556)..(556): n is a, c, t, g, unknown, or other
acaagctggagctccccgcggtggcggccgctctagaactagtggatcccccgggctgcaggaattcgcacgagaccattacctagaacatcctaatcaaaaaattaatttccagggatgcacgcaggcaagtttaatttggaggatcaatggtagctagctagagctactagagacatacatggcggatcctctggtgcgagcgcgacccaaaaggaagaaggtcttagcggactacttggtgcgactccgatggattcctgccctcttcgtggcccttccaatatctgcgctgatctacctgagcgtcttcctggggaacacgtggtccgccatgaaatccgagaagcgtcgacagaaggaacaccaggagaacgtagaganggctgagagggtcgtgaagcgtctcaaggagagggatccgaagagggacggcctcgtctgcaccgcgaggaaccatggggtggtcgtgggcatgcgcaacgtggactacnagcgcgcagaacgcttcgaggtcgacctctccgcgttgaggacatcctcgagatcgacgcgnagaggatggtcgcccagggtggagtctctcgtcagcatgggccagataaccaagttacctgcccctgaacctctcggtcgcggggctcccggagtggcgaccttaccggccggggccgaaa

SEQ ID NO: 29152 - protein, 165 aa, Zea mays
  misc_feature: Ceres CLONE 1403695-F
  misc_feature (68)..(68): Xaa is any aa, unknown, or other
  misc_feature (105)..(105): Xaa is any aa, unknown, or other
MADPLVRARPKRKKVLADYLVRLRWIPALFVALPISALIYLSVFLGNTWSAMKSEKRRQKEHQENVEXAERVVKRLKERDPKRDGLVCTARNHGVVVGMRNVDYXRAERFEVDLSALRTSSRSTRRGWSPRVESLVSMGQITKLPAPEPLGRGAPGVATLPAGAE

SEQ ID NO: 29153 - DNA, 711 bp, Zea mays
  misc_feature: Ceres CLONE 1403699-F
  misc_feature: Encodes the peptide sequence at SEQ ID NO. 29154
  misc_feature (161)..(161): n is a, c, t, g, unknown, or other
  misc_feature (296)..(296): n is a, c, t, g, unknown, or other
  misc_feature (334)..(334): n is a, c, t, g, unknown, or other
  misc_feature (398)..(398): n is a, c, t, g, unknown, or other
  misc_feature (413)..(413): n is a, c, t, g, unknown, or other
  misc_feature (417)..(417): n is a, c, t, g, unknown, or other
  misc_feature (418)..(418): n is a, c, t, g, unknown, or other
  misc_feature (424)..(424): n is a, c, t, g, unknown, or other
  misc_feature (430)..(430): n is a, c, t, g, unknown, or other
  misc_feature (443)..(443): n is a, c, t, g, unknown, or other
  misc_feature (485)..(485): n is a, c, t, g, unknown, or other
aaaagctggagctccccgcggtggcggccgctctagaactagtggatcccccgggctgcaggaattcgcacgagaccattacctagaacatcctaatcgaaaagctggtgcttctacggggcctggcgatttgaattcgagtggtgcgtgtatagagcgtngagagagagaaaagagagtggctcttgcgctctgcagtccagttcttgaatccagagctgcgattcgtgctcgcctgacgccgatgggccggagcctgagcccgctgctacggcaggagctggacaacctggacnaggacgctgacagccgccgcgccgccatgaaggcgctncagtcgtacgccagacacctggactccaagtccatcccgcactccctcggcgaggtctcgacancaccgcggccggggnccgnngccggnaggggnatgcccaaccggnggcgaagttcacatctcgtttctccgagggcctggccccggntgcaccgccccaaaatcggtgccggaaattgggaaaattatgggcccccattagggggcagcgtcttcccccggggggggttcctttccggttccccagggctggttccaggggggggccccccatttggggggaggggtattaacccttccccccccccgaggggaaaaaagccgggatattttcccccccttttggggggccctttggagccctctttgggtgg

SEQ ID NO: 29154 - protein, 155 aa, Zea mays
  misc_feature: Ceres CLONE 1403699-F
  misc_feature (18)..(18): Xaa is any aa, unknown, or other
  misc_feature (52)..(52): Xaa is any aa, unknown, or other
  misc_feature (57)..(57): Xaa is any aa, unknown, or other
  misc_feature (58)..(58): Xaa is any aa, unknown, or other
  misc_feature (67)..(67): Xaa is any aa, unknown, or other
  misc_feature (81)..(81): Xaa is any aa, unknown, or other
MGRSLSPLLRQELDNLDXDADSRRAAMKALQSYARHLDSKSIPHSLGEVSTXPRPGXXAGRGMPNRXRSSHLVSPRAWPRXHRPKIGAGNWENYGPPLGGSVFPRGGFLSGSPGLVPGGGPPFGGRGINPSPPPRGKKPGYFPPLLGGPLEPSLG

SEQ ID NO: 29155 - DNA, 721 bp, Zea mays
  misc_feature: Ceres CLONE 1403702-F
  misc_feature: Encodes the peptide sequence at SEQ ID NO. 29156
  misc_feature (353)..(353): n is a, c, t, g, unknown, or other
  misc_feature (511)..(511): n is a, c, t, g, unknown, or other
  misc_feature (516)..(516): n is a, c, t, g, unknown, or other
  misc_feature (530)..(530): n is a, c, t, g, unknown, or other
acaagctggagctccccgcggtggcggccgctctagaactagtggatcccccgggctgcaggaattcgcacgagaccattacctagaacatcctaatcgaaaaaagaagagccgccctacctattccttctccccgccgtcgagctgcccaacccagagcaccagcagccctcacctccttcctctcggccggtccttccaacgagcccgctggtcttggagccgccgccggtctcgttctggacgaacgttcaaggagattgcatttgtggatgctctaatggagtcgaaaggtggcaagaagtctagtagtagtaatagtaatttcatgtacgaagctccccttggctacnagatcgaggacgttcgcccagccggaggaatcaagaagttccagactgctgcttattccaactgcgtccgccagccatcctgatatcgcctcacagggcattcgcagtagagtaggattttaattcagtttttctcttggggtcggtagtttctccgntgggntctgggtggcatcntcggcttctgagattcaacttggccttaacccatcctcccctttttcccccccacaaccccccctttttttgggaaaaagccatcccaagggggaagctttccacaaaatctggggccctttccccggccccccataggggtttggggggaaaaaaaagcccccgaaaaaactttttcttgagggcggtgt

SEQ ID NO: 29156 - protein, 51 aa, Zea mays
  misc_feature: Ceres CLONE 1403702-F
  misc_feature (1)..(51): Pfam Name: AdoMetDC_leader Pfam Description: S-adenosyl-l-methionine decarboxylase leader peptide
  misc_feature (25)..(25): Xaa is any aa, unknown, or other
MESKGGKKSSSSNSNFMYEAPLGYXIEDVRPAGGIKKFQTAAYSNCVRQPS

SEQ ID NO: 29157 - DNA, 725 bp, Zea mays
  misc_feature: Ceres CLONE 1403705-F
  misc_feature: Encodes the peptide sequence at SEQ ID NO. 29158
  misc_feature (326)..(326): n is a, c, t, g, unknown, or other
  misc_feature (369)..(369): n is a, c, t, g, unknown, or other
  misc_feature (372)..(372): n is a, c, t, g, unknown, or other
  misc_feature (393)..(393): n is a, c, t, g, unknown, or other
aagagctggagctccccgcggtggcggccgctctagaactagtggatcccccgggctgcaggaattcgcacgagaccattacctagaacatcctaatcaaaaaaacaaccgatcgcccacgcaaacctctcctcaactcgatcaaaccggggacggaaaaggcccaccaaaatcccccaaaatttcgtacctcctcagccccagcaatctcgaatcccgatgctcacagcctccaccgaatccctggcggtcgtcatcagcgcatgagctttcttcgctcgctagcggactccttctcatcgctgctcttctcgtcgggaggcggngcggtgtccatggacgcggcgggggcggccccgtcgccggcgncgntggtgggggagcgcgtggcgntgaaactcagggggtacttcgacctcgcaaaagagagatcgacaaggcgtgcgcgctgaggagtgggggctcccgacgaggccacgcgcactacggaaggggatggggtcatgctcgaagccaagccgggggggcccccgatgcgttccctcggggaaagggggaaggtcaggggaaccaagaaaaaatgcaaggggaagggccagggcggggagggttcaaagggtttgacaaaaaaaggggaaggggccctggtggaaaatggcccaaaaggggggtaaaaaaccttttttttgggggggaaaacgggggaaaaaaaatccaagaatccc

SEQ ID NO: 29158 - protein, 62 aa, Zea mays
  misc_feature: Ceres CLONE 1403705-F
  misc_feature (36)..(36): Xaa is any aa, unknown, or other
  misc_feature (37)..(37): Xaa is any aa, unknown, or other
  misc_feature (44)..(44): Xaa is any aa, unknown, or other
MSFLRSLADSFSSLLFSSGGGAVSMDAAGAAPSPAXXVGERVAXKLRGYFDLAKERSTRRAR

SEQ ID NO: 29159 - DNA, 714 bp, Zea mays
  misc_feature: Ceres CLONE 1403707-F
  misc_feature: SWISSPROT Homolog: EC 2.3.1.15 Glycerol-3-phosphate O-acyltransferase
  misc_feature (499)..(499): n is a, c, t, g, unknown, or other
  misc_feature (616)..(616): n is a, c, t, g, unknown, or other
  misc_feature (630)..(630): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccattacctagaacatcctaatcaaaaaaagtgactcgcacgcagtagtacgacgtctctcctctgggtctggggccgagacaccgagcacgtactaccagcaagatggtggcgtctcccagattcaagcccatcgagtagtgctgctcggaggggcggtcggagcagacggtggccgccgacctggacggcacgctgctcatctccaggagcgcgttcccctactacctcctcgtgggtctcgaggccggcagtgtcctccgcgccgcgctgctggtcctgtccgtgccgttcgtctacgtaacctacgccttcttctccgagtcggtggacatcagcacgctggtgtacatctccgtggcgctgctcaaggtgcgcagtatcgagatggtgccgcgctccgtgctccccaggttctacgcggncgacgtgcacgcgtagagcttgtaggctgatcagctccttcgtgaggtgctacgtcgtcacggccagccccagggtcatgtgcgagaccttcgccagggccttcctcggcgccgacnaggtcgtcgggacngagctggaggtcgaagttacggcaagggcacggncttctggcccagtcagttgtgctcgtcggcgacgacaagaagaagggcgc

SEQ ID NO: 29160 - DNA, 716 bp, Zea mays
  misc_feature: Ceres CLONE 1403708-F
  misc_feature: Encodes the peptide sequence at SEQ ID NO. 29161
  misc_feature (528)..(528): n is a, c, t, g, unknown, or other
  misc_feature (537)..(537): n is a, c, t, g, unknown, or other
  misc_feature (572)..(572): n is a, c, t, g, unknown, or other
  misc_feature (573)..(573): n is a, c, t, g, unknown, or other
aaagctggagctccccgcggtggcggccgctctagaactagtggatcccccgggctgcaggaattcgcacgagaccattacctagaacatcctaatcgaaaatcgagaggaacggcccccgcttctatttatccggcccttgtccctgcgccgacccgcgttgccccagtcccgatctcgccgcccccttctcctcccttcgcgtccatcgcacccgctcctgatcccgcttgcttgctctggttctgcttccgccgtttgtctcgcgggtcctgggagctcctgagccctggttctgtctctagcctgtcttgccatggggaagagcaagaagagcaaggcccgcggcggcagggacgacctgctcgacagcagcgacgccgacagcgtcagctcctcgtccaccgcactgtcggatctctccatctcgtacgctaccgagcacgtcaactcgcagtagttcgtcctggacaagtacatcgacgcgctctacgagaagagggggtctacaagagaggcagcattggntaaactggntgatgcctttgaaagtttatgctccatgggcttgnngaggacaggatgccactctgatgggcaataaaaaattcggggaaaagggatttactaaggaggtttttcggggatccattccttggggttttggatataaccccgggggtggggccttctctggaaaaagggggggccccttc

SEQ ID NO: 29161 - protein, 47 aa, Zea mays
  misc_feature: Ceres CLONE 1403708-F
MGKSKKSKARGGRDDLLDSSDADSVSSSSTALSDLSISYATEHVNSQ

SEQ ID NO: 29162 - DNA, 709 bp, Zea mays
  misc_feature: Ceres CLONE 1403710-F
  misc_feature: Encodes the peptide sequence at SEQ ID NO. 29163
  misc_feature (335)..(335): n is a, c, t, g, unknown, or other
  misc_feature (541)..(541): n is a, c, t, g, unknown, or other
  misc_feature (542)..(542): n is a, c, t, g, unknown, or other
  misc_feature (547)..(547): n is a, c, t, g, unknown, or other
  misc_feature (563)..(563): n is a, c, t, g, unknown, or other
  misc_feature (679)..(679): n is a, c, t, g, unknown, or other
  misc_feature (692)..(692): n is a, c, t, g, unknown, or other
caaagctggagctccccgcggtggcggccgctctagaactagtggatcccccgggctgcaggaattcgcacgagaccattacctagaacatcctaatcgaaaaaccattcgaaagatccctccaggaaagatttttcttccctcctccgacgccccagcccaccaacacactctataaagcagccccccagtcacacacagaacgcacaagcgcaagcagggcaagaaaactccgcaggccagtctgcgcgagttggatggccttcttcttggccctcgtgtgcatcctcgtcttgctagccatcgcctcctacgtccagtacactcgctggagnaaggggaaaggccgcttcggcggccatgggaggtctgctcccttgaagctgcctcctggctccatgggctggccttaccttggcgagaccctccagctttactcccaggaccccagcgtcttcttcgcttccaaacagaagaggtacggcgagatcttcaagacgcaccttctgggctgcccgtgcgtgatgctggcgagcccgannggcgncgcggttcgtgctggntgacgcaggcgcacctgttcaagccgacctacccgcggagcaaggagcgcatggatcgggccgtcggctctcttcttccaccagggcgactaccacctccgcctccgcaagctcgntcaggcggttttngggccccgacgcgctgc

SEQ ID NO: 29163 - protein, 102 aa, Zea mays
  misc_feature: Ceres CLONE 1403710-F
  misc_feature: SWISSPROT Homolog: EC 1.14.13.93 (+)-abscisic acid 8'-hydroxylase
  misc_feature (26)..(26): Xaa is any aa, unknown, or other
  misc_feature (95)..(95): Xaa is any aa, unknown, or other
  misc_feature (97)..(97): Xaa is any aa, unknown, or other
MAFFLALVCILVLLAIASYVQYTRWXKGKGRFGGHGRSAPLKLPPGSMGWPYLGETLQLYSQDPSVFFASKQKRYGEIFKTHLLGCPCVMLASPXGXAVRAG

SEQ ID NO: 29164 - DNA, 691 bp, Zea mays
  misc_feature: Ceres CLONE 1403712-F
  misc_feature: Encodes the peptide sequence at SEQ ID NO. 29165
  misc_feature (455)..(455): n is a, c, t, g, unknown, or other
  misc_feature (526)..(526): n is a, c, t, g, unknown, or other
  misc_feature (596)..(596): n is a, c, t, g, unknown, or other
  misc_feature (597)..(597): n is a, c, t, g, unknown, or other
  misc_feature (604)..(604): n is a, c, t, g, unknown, or other
caaagctggagctccccgcggtggcggccgctctagaactagtggatcccccgggctgcaggaattcgcacgagaccattacctagaacatcctaatcgaaaactccctccctcctccattggactgcttgctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctgctcaggaagcaattgtgctccccccatggggtgcacttgctatcaggccaaggcctggtgtctgggattacattncggtgaatgtaagtgagctggctgtggaggagctgagtgtttctgagtacttggcattcaaggacagctgntggatggacaatccacagccacttgtgcttggagctgattttgagcccttcatggctccttcctcggctnncccaggncgaagccatgggaaatggagggaattccttaacgaaactggtcgtccagttggtccagacaagggaaagttggacccctgggtaact

SEQ ID NO: 29165 - protein, 174 aa, Zea mays
  misc_feature: Ceres CLONE 1403712-F
  misc_feature: SWISSPROT Homolog: EC 2.4.1.13 Sucrose synthase
  misc_feature (96)..(96): Xaa is any aa, unknown, or other
  misc_feature (119)..(119): Xaa is any aa, unknown, or other
  misc_feature (143)..(143): Xaa is any aa, unknown, or other
MAAKLTRLHSLRERLGATFSSHPNELIALFSRYVHQGKGMLQRHQLLAEFDALFDSDKEKYAPFEDILRAAQEAIVLPPWGALAIRPRPGVWDYIXVNVSELAVEELSVSEYLAFKDSXWMDNPQPLVLGADFEPFMAPSSAXPGRSHGKWREFLNETGRPVGPDKGKLDPWVT

SEQ ID NO: 29166 - DNA, 704 bp, Zea mays
  misc_feature: Ceres CLONE 1403713-F
  misc_feature: Encodes the peptide sequence at SEQ ID NO. 29167
  misc_feature (651)..(651): n is a, c, t, g, unknown, or other
caaagctggagctccccgcggtggcggccgctctagaactagtggatcccccgggctgcaggaattcgcacgagaccattacctagaacatcctaatcgaaaaaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcacccggccggacaccttcttcaccgccgccgactccgtgaggtctgtctgcacggaggtggccacggacctgcagatcctcgtggataactgcctctaccatctccacaaggtaattagctcaaggatcgtcagagatcgtgcccaccctttggcctttattcaggaatttgaatctttagttaggatcgttccatacagtgggatcccgtctaggctttgttcggttttcacggattggagacccagaataattcctagccggattacttctctaatttatataaattttgatgagttggaacgaaaccgggtttattccaatagaaacgaacggccccctaggaaaatggagaagtcccccccggccgatcttgagattaangactctttctgtttcttggcattgtccgtcctgtgcatggcttgctgggacgt

SEQ ID NO: 29167 - protein, 152 aa, Zea mays
  misc_feature: Ceres CLONE 1403713-F
  misc_feature (135)..(135): Xaa is any aa, unknown, or other
MKFMRLGTRPDTFFTAADSVRSVCTEVATDLQILVDNCLYHLHKVISSRIVRDRAHPLAFIQEFESLVRIVPYSGIPSRLCSVFTDWRPRIIPSRITSLIYINFDELERNRVYSNRNERPPRKMEKSPPADLEIXDSFCFLALSVLCMACWD

SEQ ID NO: 29168 - DNA, 634 bp, Zea mays
  misc_feature: Ceres CLONE 1403714-F
  misc_feature: Encodes the peptide sequence at SEQ ID NO. 29169
  misc_feature (336)..(336): n is a, c, t, g, unknown, or other
  misc_feature (337)..(337): n is a, c, t, g, unknown, or other
  misc_feature (364)..(364): n is a, c, t, g, unknown, or other
  misc_feature (365)..(365): n is a, c, t, g, unknown, or other
aaaagctggagctccccgcggtggcggccgctctagaactagtggatcccccgggctgcaggaattcgcacgagaccattacctagaacatcctaatcgaaaaatccgctccccgccttccgcttccctaccccccgcatcacctaccaacgccgacaccatgggggccttcgcgaaggaggagcaccagttcctagccgagctcggcctcgcgcagcgcacccaggcgcgttcgcatgcggtgcgtgaggcggctcaggtcccaccggtcacctccacgaggccgagcgacatcaggtcatcgcagaggtcgtggaggcgtccgtgccgactacnnagagggcatgcgcgcctgcttcgatgnncgcagacatgaatggcgattcctgctccaaagcgaggagagatcggtgggcaaatccggggatgcactggaaagcaaggttccttcaccttgggcaggttggggtactttgattgggggaaaatctttctggaagggatcgggggaggttcggggaatcatccgcagtgggggattaggggggggggttaaaaccccccctaaaggggtcccttttaccccttggggggccaaccctttgtggggggggggggggggaacccctggggg

SEQ ID NO: 29169 - protein, 71 aa, Zea mays
  misc_feature: Ceres CLONE 1403714-F
  misc_feature (59)..(59): Xaa is any aa, unknown, or other
  misc_feature (68)..(68): Xaa is any aa, unknown, or other
  misc_feature (69)..(69): Xaa is any aa, unknown, or other
MGAFAKEEHQFLAELGLAQRTQARSHAVREAAQVPPVTSTRPSDIRSSQRSWRRPCRLXRGHARLLRXXQT

SEQ ID NO: 29170 - DNA, 665 bp, Zea mays
  misc_feature: Ceres CLONE 1403716-F
  misc_feature: Encodes the peptide sequence at SEQ ID NO. 29171
  misc_feature (442)..(442): n is a, c, t, g, unknown, or other
  misc_feature (649)..(649): n is a, c, t, g, unknown, or other
caaagctggagctccccgcggtggcggccgctctagaactagtggatcccccgggctgcaggaattcgcacgagaccattacctaaacatcctaatcgaaaaaccaacccttgtagtctcagtcaatctgtagattgagactacgatgagcctgtcaccgctcgactcctcctccccgccggccgcggctgcggctgctgctacggaggtgcccctcgccccgggcttccgcttccaccccaccgacgaggagctcgtctcctactacctccgccgccgcgtcctcggccgccgcctccgcgtcgacgccatcgccgagatcgacctctaccgcctcgagccctgggacctcccctccctctcccgcatccgcagccgcgacgcccagtggtacttcttcgcccgtctcgaccgcaaagtcgccggcgctgggcgcgggggncggggcggtcccggcaacaggacaacccgcgtacgccgaggggggactggaaaaacacggcaaaggaacgcgagggggaccccccggcaaagcccgtcggaatgaaaaaaaagctccgcttcccccccgggaggggggcctaaggggggaaagggacaaacgggggtagtgggccgggatccccgcctcctccgagtgaaaggaggncttgggggttgggtgg

SEQ ID NO: 29171 - protein, 133 aa, Zea mays
  misc_feature: Ceres CLONE 1403716-F
  misc_feature (24)..(133): Pfam Name: NAM Pfam Description: No apical meristem (NAM) protein
MSLSPLDSSSPPAAAAAAATEVPLAPGFRFHPTDEELVSYYLRRRVLGRRLRVDAIAEIDLYRLEPWDLPSLSRIRSRDAQWYFFARLDRKVAGAGRGGRGGPGNRTTRVRRGGTGKTRQRNARGTPRQSPSE

SEQ ID NO: 29172 - DNA, 704 bp, Zea mays
  misc_feature: Ceres CLONE 1403717-F
  misc_feature: Translation starting site: 295
  misc_feature: SWISSPROT Homolog: EC 3.2.1.51 Alpha-L-fucosidase
  misc_feature (428)..(428): n is a, c, t, g, unknown, or other
  misc_feature (434)..(434): n is a, c, t, g, unknown, or other
  misc_feature (438)..(438): n is a, c, t, g, unknown, or other
  misc_feature (493)..(493): n is a, c, t, g, unknown, or other
  misc_feature (494)..(494): n is a, c, t, g, unknown, or other
  misc_feature (536)..(536): n is a, c, t, g, unknown, or other
aaagctggagctccccgcggtggcggccgctctagaactagtggatcccccgggctgcaggaattcgcacgagaccattacctagaacatcctaatcgaaaaaccgcctagacacgggtcgcgcgcaataacccaccgatcgagctgagcacgcacgacctggcgctcgctttaaactctcgctctcaatcgtcgtcgcctcaggctctcggcagacagctgcggcggcgtgcctggcagtgaagcggtagcaggtagagccagccagtctagcttagccaccacactagtgtgatggcgaccaccggcggcggcaaggcggcactggtgctggggcggcttctgcttctgctgtgcgtgctcggccatggagctgcgcagcggtacaacgccatctggagcttcggcgactccatctccgacccggnacctcntggntgggggggggcgggtgccccttcctggctcaccacggggcagccgcccctacggnngagaccttcttcggccgccccaccggacgctgctccgacggncgcgtcatcgtcgacttcctggccgagcactttgggctgcccctgctgccggcttcgaaaagcggcggcgacttgaagaagggggcggacatggggatcatcggcgccaccacatggactttgacttcttcaagccatcgggctcagcgaccagatctggaacaacgg

SEQ ID NO: 29173 - DNA, 760 bp, Zea mays
  misc_feature: Ceres CLONE 1403718-F
  misc_feature: Encodes the peptide sequence at SEQ ID NO. 29174
  misc_feature (1)..(1): n is a, c, t, g, unknown, or other
  misc_feature (316)..(316): n is a, c, t, g, unknown, or other
  misc_feature (325)..(325): n is a, c, t, g, unknown, or other
  misc_feature (373)..(373): n is a, c, t, g, unknown, or other
  misc_feature (377)..(377): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (509)..(509): n is a, c, t, g, unknown, or other
  misc_feature (656)..(656): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
naaagctggagctccccgcggtggcggccgctctagaactagtggatcccccgggctgcaggaattcgcacgagaccattacctagaacatcctaaatcgaaaagtcatagagagccacaggccacaggcaagaacaggcaggaggatcggacgagtcggcgaggaagctgcctgcttttcagaatagagttattaagaatggcgttgcttcggctgcttgccctgatctccctgctcttcgcagtggccactcctgtcagggacatcgcccacgatgcctgctcgtcagaagtgaaggatttccagcacctgaancacagctcngggctccacctgacgctgcaccacccgcagagcccctgctcccccggngcgntgcccgcgactctcttttctcgcggnnnnccccccagaagggnnncnnnnatcnnnnnnnnttcgccgggggcctggccaagaagccggccttctcgcccaaccttggttgacaaaagccggcggggggtcntccttctcctcccccgaaaaagaacccctcggggtccgggcccgtttggcccaagaaaggtccgttgggggggggaaaaatacttccccccgagggggcctcggacccgccggcaaaagttaaatttttggggctggaaacaggggncccctctcccacgggggtccagggccccccccggggggggggggggccacaccccaaannnggcgcgggtttaacccccagggggctcgcacccaactcctcca

SEQ ID NO: 29174 - protein, 176 aa, Zea mays
  misc_feature: Ceres CLONE 1403718-F
  misc_feature (39)..(39): Xaa is any aa, unknown, or other
  misc_feature (60)..(60): Xaa is any aa, unknown, or other
  misc_feature (69)..(69): Xaa is any aa, unknown, or other
  misc_feature (74)..(74): Xaa is any aa, unknown, or other
  misc_feature (75)..(75): Xaa is any aa, unknown, or other
  misc_feature (76)..(76): Xaa is any aa, unknown, or other
  misc_feature (78)..(78): Xaa is any aa, unknown, or other
  misc_feature (79)..(79): Xaa is any aa, unknown, or other
  misc_feature (80)..(80): Xaa is any aa, unknown, or other
  misc_feature (104)..(104): Xaa is any aa, unknown, or other
  misc_feature (153)..(153): Xaa is any aa, unknown, or other
  misc_feature (172)..(172): Xaa is any aa, unknown, or other
  misc_feature (173)..(173): Xaa is any aa, unknown, or other
MALLRLLALISLLFAVATPVRDIAHDACSSEVKDFQHLXHSSGLHLTLHHPQSPCSPGAXPATLFSRGXPPRRXXXIXXXSPGAWPRSRPSRPTLVDKSRRGVXLLLPRKRTPRGPGPFGPRKVRWGGEKYFPPRGPRTRRQKLNFWGWKQGXPLPRGSRAPPGGGGGHTPXXARV

SEQ ID NO: 29175 - DNA, 701 bp, Zea mays
  misc_feature: Ceres CLONE 1403719-F
  misc_feature: Encodes the peptide sequence at SEQ ID NO. 29176
  misc_feature (621)..(621): n is a, c, t, g, unknown, or other
aaagctggagctccccgcggtggcggccgctctagaactagtggatcccccgggctgcaggaattcgcacgagaccattacctagaacatcctaatcgaaaaaaaaaacgcaactgaaaaacctcgtctacattcgcatctaggcgcccctccacctcgttccgatccagctcgccggcgcccggcggccatgtcgcagcccacggcggcggtggccgcggaggcgcagccgcagggtcgcggcctcgcggggcgccagggcggcggtggcggccttgggcagagcatctctggcatcgtgcggatggcggtgttctggtacttcgcggtcaagttcttcgggcccaagcgcccgcccgcggaccccgggattctcatgtccaacctcttccagaagggcgagccaatggatatgtggatgtatttatcagagagtgacaagttcaacgattttgctaatgaggacgcacttatttggcatgaggcaaacataccatatgcagtatggcgacctaccagtactagaacacggtcattaacatactacccttcagaggctctcaagcataatggatctttgtatgctcatgtttactttgcccgctcgggttaccctggtgnacccacagatcctgaatatgagcagaaatctgcatttgggaggacgcaccttgttgtggcattcttgccaaatcaaaagt

SEQ ID NO: 29176 - protein, 170 aa, Zea mays
  misc_feature: Ceres CLONE 1403719-F
  misc_feature (144)..(144): Xaa is any aa, unknown, or other
MSQPTAAVAAEAQPQGRGLAGRQGGGGGLGQSISGIVRMAVFWYFAVKFFGPKRPPADPGILMSNLFQKGEPMDMWMYLSESDKFNDFANEDALIWHEANIPYAVWRPTSTRTRSLTYYPSEALKHNGSLYAHVYFARSGYPGXPTDPEYEQKSAFGRTHLVVAFLPNQK

SEQ ID NO: 29177 - DNA, 679 bp, Zea mays
  misc_feature: Ceres CLONE 1403720-F
  misc_feature: Encodes the peptide sequence at SEQ ID NO. 29178
  misc_feature (392)..(392): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
caaagctggagctccccgcggtggcggccgctctagaactagtggatcccccgggctgcaggaattcgcacgagaccattacctagaacatcctaatcgaaaaagttaagtctcgttcactgcctgtgctgctcagtgctctgctcacacatcctcgtcgccaatggcggctcccgtccgggccatcccgctcccgtcgcccgtcctgtacccccgcatgtccttatggggccgcagcagctgcagccggcgacgtgcccccggagttcgcgcagcagtggaggcggcggagggtgcttcgcgagcgacggagcccgtgcaggtggtcggcgtaggcagccggaaggacgccgtcatcgacttctgcctgagctcacgcacgctgtcctccnaccccatccgcttctggacagtacatgtgatggataattctaaaagtcagctaatacaaaaggtcatggaactgatgcagcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29178 - protein, 104 aa, Zea mays
  misc_feature: Ceres CLONE 1403720-F
  misc_feature (77)..(77): Xaa is any aa, unknown, or other
MAAPVRAIPLPSPVLYPRMSLWGRSSCSRRRAPGVRAAVEAAEGASRATEPVQVVGVGSRKDAVIDFCLSSRTLSSXPIRFWTVHVMDNSKSQLIQKVMELMQR

SEQ ID NO: 29179 - DNA, 705 bp, Zea mays
  misc_feature: Ceres CLONE 1403721-F
  misc_feature: Translation starting site: 178
  misc_feature: SWISSPROT Homolog: EC 2.5.1.18 Glutathione transferase
  misc_feature (463)..(463): n is a, c, t, g, unknown, or other
  misc_feature (464)..(464): n is a, c, t, g, unknown, or other
  misc_feature (475)..(475): n is a, c, t, g, unknown, or other
  misc_feature (477)..(477): n is a, c, t, g, unknown, or other
  misc_feature (482)..(482): n is a, c, t, g, unknown, or other
  misc_feature (493)..(493): n is a, c, t, g, unknown, or other
  misc_feature (517)..(517): n is a, c, t, g, unknown, or other
  misc_feature (545)..(545): n is a, c, t, g, unknown, or other
  misc_feature (572)..(572): n is a, c, t, g, unknown, or other
aaagctggagctccccgcggtggcggccgctctagaactagtggatcccccgggctgcaggaattcgcacgagaccattacctagaacatcctaatcaaaaaaaaactcgctctcactttactcctatccactgcggcctggacgcgtgcgagagacttgacaaagcagcagcagggatggcgcctctgaagctgtacgggatgccgctgtcccccaacgtggtgcgcgtggccaccgtgctcaacgagaagggcctcgacttcgagatcgtccccgtcgacctcaccaccggcgcccacaagcagcccgacttcctcaccctcaaccctttcggccagatcccggctctcgtcgacggagacgaagtcctcttcgagtcccgcgcgatcaaccggtacatcgccagcaaagtacgcgtcggagggcacggacctgctccccgcgacggcgtcggcggcgaannctggaggtgtngnctggnaggtggagtcncaccacttccacccgacgcgtcgnccgctggtgttccagctgctcgtgaggncgctcctgggcggcgccccgacgcggnggtgggtgaaaagcacgcggagcagctcgccagggggctcgacgtgtacgaggcgcaactgcccccgcacaggaccctcgcccggggacgagttcacgctcgccgacgccaaccacgcgtcctacctgctcta

SEQ ID NO: 29180 - DNA, 677 bp, Zea mays
  misc_feature: Ceres CLONE 1403722-R
cagattgggtaccgggccccccctcgaggtcgacggtatcgataagcttttttttttttttttttcaattttttgtttatctttttttaacgatctggagctgaacaactggagggattccactcgacaagcaatcccctggtactaatacaagataaccttagaaattttacatgtgattgatggaagatactcatcaacgacattactgaataggcccggacaaggtttctgtgcatgcctcgttaacctgacgtccctatggaccatatctcaagattgtgccgcagcccttgcgccccaaagttcttgctcctttcagtttggtcccatccctccagacacgaaccgacttaagagtagagcctcccacccctggtgattaaactgcggcacaatgggcacgtcgataatgttgggccacattccttacatgtcaaataaccactctgaaaagccatgtcctttggattggttagacatatgggggatacctgctcgaccgcagcacttttgccaataccagttgatttccagcttgcagtttgaggagggtgcaaagcatccgcggcggcattatcattttcaagaactttatttggaggaggaagaatcctaggagagccaatcctttgtgcttgcttttctggaggccggaggccttgcgttgctttata

SEQ ID NO: 29181 - DNA, 705 bp, Zea mays
  misc_feature: Ceres CLONE 1403725-F
  misc_feature: Translation starting site: 258
  misc_feature: Pfam Name: DUF647 Pfam Description: Protein of unknown function, DUF647
  misc_feature (438)..(438): n is a, c, t, g, unknown, or other
  misc_feature (446)..(446): n is a, c, t, g, unknown, or other
  misc_feature (447)..(447): n is a, c, t, g, unknown, or other
  misc_feature (457)..(457): n is a, c, t, g, unknown, or other
  misc_feature (470)..(470): n is a, c, t, g, unknown, or other
  misc_feature (473)..(473): n is a, c, t, g, unknown, or other
  misc_feature (474)..(474): n is a, c, t, g, unknown, or other
  misc_feature (480)..(480): n is a, c, t, g, unknown, or other
  misc_feature (481)..(481): n is a, c, t, g, unknown, or other
  misc_feature (503)..(503): n is a, c, t, g, unknown, or other
  misc_feature (504)..(504): n is a, c, t, g, unknown, or other
  misc_feature (527)..(527): n is a, c, t, g, unknown, or other
  misc_feature (624)..(624): n is a, c, t, g, unknown, or other
  misc_feature (625)..(625): n is a, c, t, g, unknown, or other
  misc_feature (645)..(645): n is a, c, t, g, unknown, or other
  misc_feature (679)..(679): n is a, c, t, g, unknown, or other
  misc_feature (680)..(680): n is a, c, t, g, unknown, or other
  misc_feature (692)..(692): n is a, c, t, g, unknown, or other
aaagctggagctccccgcggtggcggccgctctagaactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggcgtccacggagaggcaggcgcccgccgcggcgttgcaggggttcctgtgcctgnaggagtgnnacggaggcgntggagctacgtgntgnnacgtgnngccgcaaaggggaagagcaggnncggggccgtccccgctggggccngcgtcagggccgtgccgctgcagtcgccgcttccgccctgcgaagaaatatggcattcataagatcatatgtgggtgctgaaagggttccagacagnngtactccttcatatgtaccntacatgacctggagggctctgaagcatttctttnngtgagcgatggnagtgtttaccaca

SEQ ID NO: 29182 - DNA, 687 bp, Zea mays
  misc_feature: Ceres CLONE 1403726-F
  misc_feature: Encodes the peptide sequence at SEQ ID NO. 29183
  misc_feature (507)..(507): n is a, c, t, g, unknown, or other
  misc_feature (591)..(591): n is a, c, t, g, unknown, or other
tggagctccccgcggtggcggccgctctagaactagtggatcccccgggctgcaggaattcgcacgagaccattacctagaacatcctaatcgaaaaaggtcgacgcatcttcgcctccgctcaacgctcgcccacgcccgccgcccccccaccgatccacgagaaaccttctcgcctccgcgggacgattcgccagggagagcaaaggtagcagaggcgccatggacgctgccaagtcggtgacgccgggcgccgtgtcctacatcctggcgcacccgtctacgggctccaatggcgccgtgtcggatctcgtcgttcaggtcctcgatctcaagtccatcggcatgggcagccggttcagtttcacggcaaccgatgggaacgacaaaatcaaggcgatgctccccacttactttgcgtcggaggtccactccggcaatctgaagaatttcggtctcatccgcatcctcgactacacttgcaactccgtcaaaggcaacgctgancaagtcctgattgtcgtcaaatgcgagactgtgtgcgaagcgctcgacgccgagatcaacggcgaggcccagaaagaggatccntccattgtgctgaaagctaaagacgaaggctcagtcgtggctgaagaaacaaatctcccccactcgtgatgaagctaagcaagagtgaagtccgcg

SEQ ID NO: 29183 - protein, 145 aa, Zea mays
  misc_feature: Ceres CLONE 1403726-F
  misc_feature (6)..(108): Pfam Name: Rep-A_N Pfam Description: Replication factor-A protein 1, N-terminal domain
  misc_feature (95)..(95): Xaa is any aa, unknown, or other
MDAAKSVTPGAVSYILAHPSTGSNGAVSDLVVQVLDLKSIGMGSRFSFTATDGNDKIKAMLPTYFASEVHSGNLKNFGLIRILDYTCNSVKGNAXQVLIVVKCETVCEALDAEINGEAQKEDPSIVLKAKDEGSVVAEETNLPHS

SEQ ID NO: 29184 - DNA, 711 bp, Zea mays
  misc_feature: Ceres CLONE 1403729-F
  misc_feature (361)..(361): n is a, c, t, g, unknown, or other
  misc_feature (365)..(365): n is a, c, t, g, unknown, or other
  misc_feature (366)..(366): n is a, c, t, g, unknown, or other
  misc_feature (444)..(444): n is a, c, t, g, unknown, or other
  misc_feature (445)..(445): n is a, c, t, g, unknown, or other
  misc_feature (503)..(503): n is a, c, t, g, unknown, or other
aagctggagctccccgcggtggcggccgctctagaactagtggatcccccgggctgcaggaattcgcacgagaccattacctaaacatcctaatcgaaaaaccaacccttgtagtctcagtcaatctgtagattgagactacgatgagcctgtcaccgctcgactcctcctccccgccggccgcggctgcggctgctgctacggaggtgcccctcgccccgggcttccgcttccaccccaccgacgaggagctcgtctcctactacctccgccgccgcgtcctcggccgccgcctccgcgtcgacgccatcgccgagatcgacctctaccgcctcgagccctgggacctcccctccctctnccgnnatcgcagccgcgacgcccagtggtacttcttcgcccgtctcgacccgcaggtcgccggcgctggcgcccgggggccgnngcggtcccggcaacaggaccaaccgcgctacgccgagggggtactggaagaccacggncagggaccgcgaggtgcaccaccgcggcaagcccgtcgggatgaagaagacgctcgtcttccacggccgggagggcgcctagaggcgagaggaccaactgggtcatgcacgagtaccggcttctccgatgcagacggacctcaggattctggaggggggtttgaaaaatcttcaaaaagcatggggtctggaccccagaacggggggg

SEQ ID NO: 29185 - DNA, 689 bp, Zea mays
  misc_feature: Ceres CLONE 1403730-F
  misc_feature: Translation starting site: 226
  misc_feature (350)..(350): n is a, c, t, g, unknown, or other
  misc_feature (480)..(480): n is a, c, t, g, unknown, or other
  misc_feature (529)..(529): n is a, c, t, g, unknown, or other
  misc_feature (549)..(549): n is a, c, t, g, unknown, or other
  misc_feature (557)..(557): n is a, c, t, g, unknown, or other
tggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgcccgggcctccgggttggccggtggntgggaacctgttccaggtgatcctgcagcgacggcccttcatgtacgtggtgcgcgacctccgggagaagtacgggcccatcttcaccatgcggatggggcagccaccctcatcgtggtcacctcggcgnagctcatccacgaggcgctggtgaagcagggccccatgttcgcgagccngcccgaggacagccccaccngctcctcntcagcgtcggaagtgcaccgtcactcggcgcctacggccccctgtgggtgctctgcgcgcacttcgtcgcaagatcggtcccgcaccgcgcaggctctctggaatccgggagggggcggggacccacttgcc

SEQ ID NO: 29186 - DNA, 702 bp, Zea mays
  misc_feature: Ceres CLONE 1403734-F
  misc_feature (402)..(402): n is a, c, t, g, unknown, or other
aagctggagctccccgcggtggcggccgctctagaactagtggatcccccgggctgcaggaattcgcacgagaccattacctagaacatcctaatcaaaaagctgcttcgctgagtttccatgacgccctttacacatctgaatctcaaccacccacccccgcaacccccgccaaacatggaaccaatgatgccgctgaatcttgctgtgcttgctggccctgctccccgcagccgccgaagcagcatcgcagtatcccacacagacggagacgctcttccgcgacatggagggcgcgtcctcgaaccatgactagggcatagacagccccgacaggtgcgcgggaccgtggcagcgcctgcagagatagctagccgcgacgtgtgtgcctgaagcatgccnatcacgagcctggaattctacagtgtagaccaacccgacgtgcaaggacacgccaacgctacgtcgccagtcgtcactctctcgaaagggtcgagcgcctcattctccgctactgcttcacgagcacaagacgcactatagtagatcgtactgtcgccgcgcagcgatctcacgtacagcgacctgttcaaattcagcatacgtgacatgcagacgatgtacgatttctgtcgtcgacgatggccagtcttcagacgataaagttgctcacatcttctgaaatgccctggtcagggatga

SEQ ID NO: 29187 - DNA, 728 bp, Zea mays
  misc_feature: Ceres CLONE 1403736-F
  misc_feature: Encodes the peptide sequence at SEQ ID NO. 29188
  misc_feature (327)..(327): n is a, c, t, g, unknown, or other
  misc_feature (328)..(328): n is a, c, t, g, unknown, or other
  misc_feature (369)..(369): n is a, c, t, g, unknown, or other
aaagctggagctccccgcggtggcggccgctctagaactagtggatcccccgggctgcaggaattcgcacgagaccattacctagaacatcctaatcgaaaaagccagcaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggcgggatctcccgggacgcctctccgtccgcgcctccgnngacgtggtagcggcaccgctggcggagacggatcccagaangcggctgtgatcacgggagatggggctggtctccgttttcgggaacgatgtagacgcttactacaacgcctgctagtcggggagagcgggatcgggcccaatcgacgcttcgacgtttttaagtccccacccgtttggccggcaaaaccggggcttttcctccgagggaaacctctaacggaaaaaaccccgcccccctggaggatgcccccaaaaacggcacccccggggaaaaaagggtttcgagggcctcggtttcccccggggttcctcacccttggaaaaattgaaaaaaccccgccccgggggttttgggaacactggaaagggggcgccccccgggttttcaaaagggggca

SEQ ID NO: 29188 - protein, 49 aa, Zea mays
  misc_feature: Ceres CLONE 1403736-F
  misc_feature (33)..(33): Xaa is any aa, unknown, or other
  misc_feature (47)..(47): Xaa is any aa, unknown, or other
MQSLLLPTAAVAPVAPPCGRRDLPGRLSVRASXDVVAAPLAETDPRXRL

SEQ ID NO: 29189 - DNA, 702 bp, Zea mays
  misc_feature: Ceres CLONE 1403737-F
  misc_feature: Encodes the peptide sequence at SEQ ID NO. 29190
  misc_feature (217)..(217): n is a, c, t, g, unknown, or other
  misc_feature (646)..(646): n is a, c, t, g, unknown, or other
  misc_feature (652)..(652): n is a, c, t, g, unknown, or other
acaagctggagctccccgcggtggcggccgctctagaactagtggatcccccgggctgcaggaattcgcacgagaccattacctagaacatcctaatgaaaactgctctagcgaaggcacagccgccgctgtttcttcatcttcctcgcagcgccggcgctccatcttactctccctcccttactagcgcttgacacgcaggtgacggcggcagcgnacggcgctcaggctcgggctcttagtgacggcatcagcggcttcccctcccgcctcttgccagtcccatcgcgccctcgcctcgggtcctctgcacaccgtccagtgaccttgcgtgatggactggataaagttttgcagcgattttactgcaagtgatgggaaacagcatgcattgcttgataatcttaatcaggaattgtcccagaagtctgtactattgggtgatggttttaaactgtcagctgctgataatgatgtgtttgcaactgttcatccttttgtgatccgtgttagtgacagcgagttgcagaaatatccacatgtactgcggtggatggactacattcagaacactgttggtgctggtacaactttgcaaaagataatgtggccagtctgactttgatccaccttctcatccaggaangctgantaaaagatgctgaaatcaggtcaagaaagccatttccgacagagactgct

SEQ ID NO: 29190 - protein, 94 aa, Zea mays
  misc_feature: Ceres CLONE 1403737-F
  misc_feature: SWISSPROT Homolog: EC 2.5.1.18 Glutathione transferase
MDWIKFCSDFTASDGKQHALLDNLNQELSQKSVLLGDGFKLSAADNDVFATVHPFVIRVSDSELQKYPHVLRWMDYIQNTVGAGTTLQKIMWPV

SEQ ID NO: 29191 - DNA, 714 bp, Zea mays
  misc_feature: Ceres CLONE 1403739-F
  misc_feature: Encodes the peptide sequence at SEQ ID NO. 29192
  misc_feature (489)..(489): n is a, c, t, g, unknown, or other
  misc_feature (521)..(521): n is a, c, t, g, unknown, or other
  misc_feature (543)..(543): n is a, c, t, g, unknown, or other
  misc_feature (686)..(686): n is a, c, t, g, unknown, or other
tggagctccccgcggtggcggccgctctagaactagtggatcccccgggctgcaggaattcgcacgagaccattacctagaacatcctaatcgaaaaaccacgctccggtcagcctcgcctcccttctccgtctcattcccccaatcccacgccactcccgcaggaatccccacccaaattcccgtctccccgatcgccgcccttctcggtgcccgtaaaccctacccccggagtcgcccgtgcgctgtcgtgcccgcgttgccaccgtcggtggtccgcggcgcccgtaaccaaaacctaaccgcagcctgcagatcccgattccgcagggaggcgggagaggtgaaggccgcctcgccgcagatggagcccgcgggcgcgcgcaaggagtggcgcgccgtccccggctcctcgctccgctccaatggcgccgaggatgccgcggagcacgggaaactggggcagtcggaggaccgagctatctacgnagaaaggggcggtggactggaggacttctgcngcatcaccattgatgggagcgnagggctcagcgaggacatcctgcagcagcgcctgcagagcgttgtgcggcaaaggagcagctgcagcaagtcgagatggagctgcgtgcgcaggccattgcacaccgcagatcatccaggcgcacaaagcttccagctacttncagggacatgccgcagctgtggccagaa

SEQ ID NO: 29192 - protein, 116 aa, Zea mays
  misc_feature: Ceres CLONE 1403739-F
  misc_feature (42)..(42): Xaa is any aa, unknown, or other
  misc_feature (53)..(53): Xaa is any aa, unknown, or other
  misc_feature (60)..(60): Xaa is any aa, unknown, or other
  misc_feature (108)..(108): Xaa is any aa, unknown, or other
MEPAGARKEWRAVPGSSLRSNGAEDAAEHGKLGQSEDRAIYXERGGGLEDFCXITIDGSXGLSEDILQQRLQSVVRQRSSCSKSRWSCVRRPLHTADHPGAQSFQLLXGTCRSCGQ

SEQ ID NO: 29193 - DNA, 713 bp, Zea mays
  misc_feature: Ceres CLONE 1403742-F
  misc_feature: Encodes the peptide sequence at SEQ ID NO. 29194
  misc_feature (492)..(492): n is a, c, t, g, unknown, or other
  misc_feature (493)..(493): n is a, c, t, g, unknown, or other
  misc_feature (542)..(542): n is a, c, t, g, unknown, or other
  misc_feature (543)..(543): n is a, c, t, g, unknown, or other
  misc_feature (560)..(560): n is a, c, t, g, unknown, or other
  misc_feature (576)..(576): n is a, c, t, g, unknown, or other
  misc_feature (581)..(581): n is a, c, t, g, unknown, or other
  misc_feature (595)..(595): n is a, c, t, g, unknown, or other
  misc_feature (654)..(654): n is a, c, t, g, unknown, or other
  misc_feature (656)..(656): n is a, c, t, g, unknown, or other
  misc_feature (657)..(657): n is a, c, t, g, unknown, or other
tggagctccccgcggtggcggccgctctagaactagtggatcccccgggctgcaggaattcgcacgagaccattacctagaacatcctaatcgaaaagtactcccgtgcgctagtgcgctcggcgctgcccccgtccgcccgcagtccgtccccgctcgccgcccatgcgctcgccggccgcccctcggcgctcccccatctcctcccgctccgcccccgccctccgtctggtagtccgtcgccgctcctcccgcacgccagcacgacctagtagacggctcgaagcgaagacggtcccatttccagtctccgtggtcaagatggatttagaggtatccgagggttcaggtactaatgccacctcggatgaccaatcggtgcaaacgctgcctagaagggcaaagcttttggagtattttcaaccggagttagttgaggtcaatggcgtgatgaaggctatttgcaaatattgcggggcgatgttgaggagnntcagcacaaatagccttagaaacccacgtgcggatacatgtcctaaaannttcagtgaggaccgcangctattcattgctacnatggnaaaaaggacagcgnaagctttcatttgtgttgactctcaaaggctcgtgaggggatggggtagttggtgattnanntgccgagtcgcattcaacaagtttgacgatccttctttgctcaaggggataagtca

SEQ ID NO: 29194 - protein, 109 aa, Zea mays
  misc_feature: Ceres CLONE 1403742-F
  misc_feature (57)..(57): Xaa is any aa, unknown, or other
  misc_feature (58)..(58): Xaa is any aa, unknown, or other
  misc_feature (74)..(74): Xaa is any aa, unknown, or other
  misc_feature (80)..(80): Xaa is any aa, unknown, or other
  misc_feature (87)..(87): Xaa is any aa, unknown, or other
  misc_feature (92)..(92): Xaa is any aa, unknown, or other
MDLEVSEGSGTNATSDDQSVQTLPRRAKLLEYFQPELVEVNGVMKAICKYCGAMLRXXSTNSLRNPRADTCPKXFSEDRXLFIATMXKRTAXAFICVDSQRLVRGWGSW

SEQ ID NO: 29195 - DNA, 753 bp, Zea mays
  misc_feature: Ceres CLONE 1403744-F
  misc_feature: Encodes the peptide sequence at SEQ ID NO. 29196
  misc_feature (448)..(448): n is a, c, t, g, unknown, or other
tggagctccccgcggtggcggccgctctagaactagtggatcccccgggctgcaggaattcgcacgagaccattacctagaacatcctaatcgaaaagcatcttcgcctccgctcaacgctcgcccagcccgccgcccccccaccgatccacgagaaaccttctcgcctccgcgggacgattcgccagggagagcaaaggtagcagaggcgccatggacgctgccaagtcggtgacgccgggcgccgtgtcctacatcctggcgcacccgtctacgggctccgatggcgccgtgtcggatctcgtcgttcaggtcctcgatctcaagtcatcgggatgggcagccggttcagtttcacggcacccgatggaaacgacaaaatcagggcgatgctccccacttacttttgcgtcggaggtccactccggcaatctggaggaattccggnctcatccgaatccccgactaccttggcactccgtcaaagggaaacgctgacaaagtcctgatgtggcccaaatgcaaaatgtggtggcaaacgttccaaacccaaaatacaggggggggcaaaaaaaagagatccccccatggggggtgaaacaaaaaaaaaagggttccactggggggggggaaaaaaaattctccccccttttggggaagaccaaaaaagaggggggggcccgcccccccaaatatttggtgtggaaggggggaaattgtctccccccccccccctctcttaggaaggggggg

SEQ ID NO: 29196 - protein, 94 aa, Zea mays
  misc_feature: Ceres CLONE 1403744-F
  misc_feature (79)..(79): Xaa is any aa, unknown, or other
MDAAKSVTPGAVSYILAHPSTGSDGAVSDLVVQVLDLKSSGWAAGSVSRHPMETTKSGRCSPLTFASEVHSGNLEEFRXHPNPRLPWHSVKGKR

SEQ ID NO: 29197 - DNA, 694 bp, Zea mays
  misc_feature: Ceres CLONE 1403745-F
  misc_feature: Encodes the peptide sequence at SEQ ID NO. 29198
  misc_feature (442)..(442): n is a, c, t, g, unknown, or other
  misc_feature (626)..(626): n is a, c, t, g, unknown, or other
  misc_feature (630)..(630): n is a, c, t, g, unknown, or other
  misc_feature (680)..(680): n is a, c, t, g, unknown, or other
tggagctccccgcggtggcggccgctctagaactagtggatcccccgggctgcaggaattcgcacgagaccattacctagaacatcctaatcaaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcnaacacctcggtaccatcgccaggggtcggacgaagggagtcatggaagccctttgctgccgcgctgatgtgtcatgattggccagttcggcgtcggtttctactctgcctacctcgtcgccgatagagttgtcgtgaccaccagcacacgatgacgagcagtacggtgtggagtcccagcgggncggntcgttcactgtactcgtgacactcaggggagcagcttggcaggggactangatcccctgtccct

SEQ ID NO: 29198 - protein, 117 aa, Zea mays
  misc_feature: Ceres CLONE 1403745-F
  misc_feature (93)..(93): Xaa is any aa, unknown, or other
MASETETFAFQAEINQLLSLIINTFYSNKEIFLRELISNSSDALDKIRFESLTDKSKLDAQPELFIHLVPDKATNTLSIIDSGIGMTKSDLVXHLGTIARGRTKGVMEALCCRADVS

SEQ ID NO: 29199 - DNA, 741 bp, Zea mays
  misc_feature: Ceres CLONE 1403747-F
  misc_feature: Encodes the peptide sequence at SEQ ID NO. 29200
  misc_feature (227)..(227): n is a, c, t, g, unknown, or other
  misc_feature (228)..(228): n is a, c, t, g, unknown, or other
  misc_feature (317)..(317): n is a, c, t, g, unknown, or other
  misc_feature (331)..(331): n is a, c, t, g, unknown, or other
  misc_feature (335)..(335): n is a, c, t, g, unknown, or other
  misc_feature (337)..(337): n is a, c, t, g, unknown, or other
  misc_feature (338)..(338): n is a, c, t, g, unknown, or other
  misc_feature (348)..(348): n is a, c, t, g, unknown, or other
  misc_feature (358)..(358): n is a, c, t, g, unknown, or other
aaagctggagctccccgcggtggcggccgctctagaactagtggatcccccgggctgcaggaattcgcacgagaccattacctagaacatcctaatcgaaaaatcgatccgccaccacgccacaaaatcctctcctactccggcagttctgctcgccgccgcctccacgatgacggaagacgtgcagatgaacgactcggagccccagcctggcggctcagctcccnngcgtcggggcgccggcgctctccacactacaccatctgaaggagatcgcgtccgtgatcgaggcccggtctctgtccaaggaggtccgncggatctcccgggncttncnngctaacgttngggtttcgtngccgcctcggcggggggggaaggtttcggcttcccttgccttgggggtaaaccgggggcttcgaaacctaagggagcctcacttggcctggggggccacaggaaaaaggaacccggaaatgggtgttttttgttttaaattctcccgaaatctaaaattttcactcaaaaagggggctccccggggaatagaaaaaaatattgggcccttgggccccggacgggtgttttccttattttgggccaaaaaaaaaaatttttggggggttaaaagcgtgggccaaaggtggggagatttttttccccttctgaaaaaattaaaaccgcggaaaaaagtgggggggttttttttgggaacaccccagggggtgttttttttttttt

SEQ ID NO: 29200 - protein, 55 aa, Zea mays
  misc_feature: Ceres CLONE 1403747-F
  misc_feature (20)..(20): Xaa is any aa, unknown, or other
  misc_feature (50)..(50): Xaa is any aa, unknown, or other
MTEDVQMNDSEPQPGGSAPXRRGAGALHTTPSEGDRVRDRGPVSVQGGPXDLPGL

SEQ ID NO: 29201 - DNA, 690 bp, Zea mays
  misc_feature: Ceres CLONE 1403748-F
  misc_feature: Translation starting site: 427
ggagctccccgcggtggcggccgctctagaactagtggatcccccgggctgcaggaattcgcacgagaccattacctagaacatcctaatcgaaaaaaaaccgaaaaggaggacaaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgatctccggcgaggtgccggacgagccggtcgtgtcgaagaagtcggggctactcttcgagcggcggctcatcgagcgctacattgaggaccatggcaagtgtcccgccaccaaggagacctcaccatggatgatatcgtgccggtcaagaccaacacgatcgtgaagcccaggcctttgcaggctgcaagcattccaggactctttgggatttttcagaacgagtgggatgctctcatggcttctaattttgctttgaagcagcagcttcacacagcaagacaagaacttagtcatgcactctaccagcatgacgctgcctggccgtgtatagccagattaagaaggaaagagatgacgctagagcactttttgctcaggctgagagaa

SEQ ID NO: 29202 - DNA, 703 bp, Zea mays
  misc_feature: Ceres CLONE 1403749-F
  misc_feature (293)..(293): n is a, c, t, g, unknown, or other
tggagctccccgcggtggcggccgctctagaactagtggatcccccgggctgcaggaattcgcacgagaccattacctagaacatcctaatcgaaaaacactacaatactgctgcgcgctagcggtagcgctcgcgctcccactcgcaccacagcacgccaccgctgctgccggctcctccccgcgctcgcattgcgatttgcgacctagcgcgagggtaccgggggtggtgcgcgtgctccgtgatcccggaagcgccccgagatggcgggggcggaaggcgcggtgccccncccaagaacgacgacttccgcccgaaccccgtaaggaccaggtccctggggcttctactggatcaccaaccctcccccggggccgggaacccgtctttctgggggtcccaaataaacctgggcaaggctgggaaccccgggggaacaacccaaatgggccttggtccccaaaaggggggggaaaaaatgggggcaaaacccgggggttttcccaaaaattgtggtgtcttttttaaggaaaaaaaacccccccgcggaagagttttttttggacccaatttgtcccccaaggaaaccgggggacaaaaacaccctttggttggcccccaaatatttaaaaaccccggtgggggggttttttgtttaagaaacccaacccccaataaaaattttcccccaaactgggggga

SEQ ID NO: 29203 - DNA, 695 bp, Zea mays
  misc_feature: Ceres CLONE 1403750-F
  misc_feature (349)..(349): n is a, c, t, g, unknown, or other
  misc_feature (350)..(350): n is a, c, t, g, unknown, or other
  misc_feature (403)..(403): n is a, c, t, g, unknown, or other
  misc_feature (472)..(472): n is a, c, t, g, unknown, or other
  misc_feature (532)..(532): n is a, c, t, g, unknown, or other
  misc_feature (618)..(618): n is a, c, t, g, unknown, or other
  misc_feature (634)..(634): n is a, c, t, g, unknown, or other
ggagctccccgcggtggcggccgctctagaactagtggatcccccgggctgcaggaattcgcacgagaccattacctagaacatcctaatcaaaaactcgcaatgtctacttgtctaccgtcgctgcgctagccctcctccctgcttcttgcttttgcctgagcctgcagcctgctgcaagcttttgctttggtttaggtgcttcttttccacccctttactgttccccccacttttgcttgctttgtcacgcacacgaaaagctcctgcctttaccttatctccgcacccgtagtgggatttggtgggagctgcgctgctcgcccctcgcgtttctttgctcaattgnnggtcacggtcacggcccgcgggtgctgcgcgtgctcgtgggcggcggaaatcngggtttcttgcgcggtccccggcccctcggcgattggcgacgctctctgcagatcttcgcgtaactccnggagcgcggcggagatgaactgcgggccgccgacagtttgccggccgggtcgggggcccntcgtgctttctcaacctgaactgggaacagtctattggcgccgaccagctcgacccgggttaaatttcgatgtctccctccccggngtccaatcgaggcggnccccccggggttaatgaaggccgggtcttccccggggatctctccgaggaaaaggtacggg

SEQ ID NO: 29204 - DNA, 690 bp, Zea mays
  misc_feature: Ceres CLONE 1403753-F
  misc_feature: Encodes the peptide sequence at SEQ ID NO. 29205
  misc_feature (595)..(595): n is a, c, t, g, unknown, or other
tggagctccccgcggtggcggccgctctagaactagtggatcccccgggctgcaggaattcgcacgagaccattacctagaacatcctaatcgaaaaatcgcgggctcacatagcaccgcacagctgaggtgcagtttctactagcagcaatatcatggattctgaggtagtgcatgtggtagagtcgtcgtttgtagtgccgagcgagccgacaccgtcggaggggctctcgctctctccgctggacctcgttctgcccagcagaggccacaccccaacagtctacctgtacagccccagcgatgttgccgccgccgatggtttcttcgacgtggccaggctcaaggaggctatggccaagaccttggtggccttctaccccctcgctggccgcctcggcgtcaacaacgatgggcagggtagagatcacctggcaccggcgagggcgcacttctttgtggtcgctcatgctgacctccagtgttggtgacatcgaggacgacttcaggccgtcgccgagctttaggaaggctggttggtccatgcattgagccagcatccatcatattggccatacaggtgactttctcaagnttccggaggtggtggtggctaagggacggctcttcaccatgccggcagcgatgccctcagcgcgtcactttctttccagacggggtcaggctttg

SEQ ID NO: 29205 - protein, 111 aa, Zea mays
  misc_feature: Ceres CLONE 1403753-F
MDSEVVHVVESSFVVPSEPTPSEGLSLSPLDLVLPSRGHTPTVYLYSPSDVAAADGFFDVARLKEAMAKTLVAFYPLAGRLGVNNDGQGRDHLAPARAHFFVVAHADLQCW

SEQ ID NO: 29206 - DNA, 691 bp, Zea mays
  misc_feature: Ceres CLONE 1403755-F
  misc_feature: Encodes the peptide sequence at SEQ ID NO. 29207
  misc_feature (147)..(147): n is a, c, t, g, unknown, or other
  misc_feature (403)..(403): n is a, c, t, g, unknown, or other
  misc_feature (404)..(404): n is a, c, t, g, unknown, or other
  misc_feature (437)..(437): n is a, c, t, g, unknown, or other
  misc_feature (578)..(578): n is a, c, t, g, unknown, or other
ggagctccccgcggtggcggccgctctagaactagtggatcccccgggctgcaggaattcgcacgagaccattacctagaacatcctaatcgaaaaacctcatggctcacgcgaataccacacccacaccacaccacacctcacggngtccattcattcccgtctcgtcttccgctgcttgcctccaactccccccgcgtcgtctcgtgcttcccaatcaccatagagccggttgatccccaaaggcccatggttttctccgacgccgcgtcgcctctcgtagccaccgccgctgactctgcttcctcctgcgtcgcccacctcccctgctgctgtcgcgttagttgttgccgttgttgttgacgacgcgtagctcgagggttcgtgatttctcgccgatcgnngtcggaactggtaagctatggatctctcgcggnccgcatcgtcagacctctcgctcgggctgcactctcatgcccacgcccacgctcgcgtgcatgcggcagccgcgccgctgcgcctggtcgacgacgcgaagccgagcgcctcgtggccgggaaggcgacgcggagaggacnacggggacgtggcaacagcactttctccctctgggcactccctctgcgtaagggcccggccgcgccgtaaaacggggggggggcggggttgaaaaaaacctcatcttgctcgc

SEQ ID NO: 29207 - protein, 82 aa, Zea mays
  misc_feature: Ceres CLONE 1403755-F
  misc_feature (6)..(6): Xaa is any aa, unknown, or other
  misc_feature (53)..(53): Xaa is any aa, unknown, or other
MDLSRXASSDLSLGLHSHAHAHARVHAAAAPLRLVDDAKPSASWPGRRRGEDXGDVATALSPSGHSLCVRARPRRKTGGGRG

SEQ ID NO: 29208 - DNA, 728 bp, Zea mays
  misc_feature: Ceres CLONE 1403756-F
  misc_feature: Encodes the peptide sequence at SEQ ID NO. 29209
  misc_feature (502)..(502): n is a, c, t, g, unknown, or other
  misc_feature (530)..(530): n is a, c, t, g, unknown, or other
  misc_feature (594)..(594): n is a, c, t, g, unknown, or other
  misc_feature (654)..(654): n is a, c, t, g, unknown, or other
  misc_feature (677)..(677): n is a, c, t, g, unknown, or other
  misc_feature (681)..(681): n is a, c, t, g, unknown, or other
  misc_feature (682)..(682): n is a, c, t, g, unknown, or other
aaagctggagctccccgcggtggcggccgctctagaactagtggatcccccgggctgcaggaattcgcacgagaccattacctagaacatcctaatcgaaaagtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatcaacgagcggnggtccccggagacgatccgcgacccgcngcgggttcgcccgtgaaagtctacacccgcgagggcaactggggacctgctgggcaacaacttnccccgtcttctccatccgcgacggatcagggttcccccgacgtggatccacgcgttcagncccaacccgcgtcgcacgtgagnaggnnaaatggggggggggtgttccaacttcctggtcgcacctccccgaga

SEQ ID NO: 29209 - protein, 124 aa, Zea mays
  misc_feature: Ceres CLONE 1403756-F
  misc_feature (18)..(125): Pfam Name: Catalase Pfam Description: Catalase
  misc_feature: SWISSPROT Homolog: EC 1.11.1.6 Catalase
  misc_feature (111)..(111): Xaa is any aa, unknown, or other
  misc_feature (120)..(120): Xaa is any aa, unknown, or other
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVINERXSPETIRDPXRVRP

SEQ ID NO: 29210 - DNA, 713 bp, Zea mays
  misc_feature: Ceres CLONE 1403759-F
tggagctccccgcggtggcggccgctctagaactagtggatcccccgggctgcaggaattcgcacgagaccattacctagaacatcctaatcgaaaaaccgtgtctactggtctgccctgctcgtgtatccgtattcacccactggctggagcgtctctctcaccgtcattgacacgccagtacgccatggtggactagccttagttcctactgctacctaaatattaagaggccttcccgcgcgcccgcctctcggcgtgctcttcggcccttccgtatgcgtcgcagctcgggcgtggctaccagacgaacaacagcgggccaccgacccacgatgatatccggttcgcgaatcagttcgagctctactactcttcacgaatctttcatgcctcagtagcataagtcgtcctagcgtcagagaagactgctatgatggtgatggcttcgtcgcaggtgtggacaacaatgatgaagaaggacgcatagacgcagaaggactcggtttctcgacctctgcaggaggtgggcaagcggcttctatcccacaattatcttctcagagcagcgcacctcagtactcctcttatggtgtatatcacggtacaagcaagaagattgaaattccagatggcaaggtgtggtgttatcattggaaaaagcgctgaaacaattaggtatatccaacttcaatcaggagcaaagatttcag

SEQ ID NO: 29211 - DNA, 727 bp, Zea mays
  misc_feature: Ceres CLONE 1403760-F
  misc_feature: Encodes the peptide sequence at SEQ ID NO. 29212
  misc_feature (560)..(560): n is a, c, t, g, unknown, or other
  misc_feature (585)..(585): n is a, c, t, g, unknown, or other
  misc_feature (674)..(674): n is a, c, t, g, unknown, or other
  misc_feature (675)..(675): n is a, c, t, g, unknown, or other
  misc_feature (677)..(677): n is a, c, t, g, unknown, or other
  misc_feature (678)..(678): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (698)..(698): n is a, c, t, g, unknown, or other
  misc_feature (699)..(699): n is a, c, t, g, unknown, or other
  misc_feature (701)..(701): n is a, c, t, g, unknown, or other
  misc_feature (702)..(702): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
tggagctccccgcggtggcggccgctctagaactagtggatcccccgggctgcaggaattcgcacgagaccattacctagaacatcctaatcgaaaaaccaaaagaaagaaaccaactaaaatcccaaaagagaggaaaggcataaacagacggtagaaggaagaaagggacgctcgtctcggctcgtcacgtgccgccgccatggctgctctgggccgtggcctgcccctcctcctgctcctcctcctcgccgtagcgggggccgccaacgccgcggcggcgcccggcggcatgtccatcatcacctacaacgaggagcacggcgcgcgggggctggagcggacggagccggaggtgcgggccatgtacgacctctggctcgcggagcacggccgcgcctacaacgcgctgggcgagggcgagggcgagcgcgaccgccgcttcctcgtcttctgggacaacctccgcttcgtcgacgcgcacaacgagcgcgcgggcgcccgcggttccggcctcgggatgaaccagttcgccgactcaccaacgacgagtcccgcgnccgcgtacctcggcgcctggtccgncgcccgccccgggggaaaccgtcctggggggggaaaagaagtaaccgcccacgacggcgcccgccgaggagctgccggaaagcgcactnntnntnnnnnnnnaaaaaaaaaanncnnccccnnnnccccccccataaaaaaa

SEQ ID NO: 29212 - protein, 175 aa, Zea mays
  misc_feature: Ceres CLONE 1403760-F
  misc_feature (56)..(112): Pfam Name: Inhibitor_I29 Pfam Description: Cathepsin propeptide inhibitor domain (I29)
  misc_feature: SWISSPROT Homolog: EC 3.4.22.14 Actinidain
  misc_feature (120)..(120): Xaa is any aa, unknown, or other
  misc_feature (128)..(128): Xaa is any aa, unknown, or other
  misc_feature (158)..(158): Xaa is any aa, unknown, or other
  misc_feature (159)..(159): Xaa is any aa, unknown, or other
  misc_feature (160)..(160): Xaa is any aa, unknown, or other
  misc_feature (161)..(161): Xaa is any aa, unknown, or other
  misc_feature (162)..(162): Xaa is any aa, unknown, or other
  misc_feature (166)..(166): Xaa is any aa, unknown, or other
  misc_feature (167)..(167): Xaa is any aa, unknown, or other
  misc_feature (169)..(169): Xaa is any aa, unknown, or other
  misc_feature (170)..(170): Xaa is any aa, unknown, or other
MAALGRGLPLLLLLLLAVAGAANAAAAPGGMSIITYNEEHGARGLERTEPEVRAMYDLWLAEHGRAYNALGEGEGERDRRFLVFWDNLRFVDAHNERAGARGSGLGMNQFADSPTTSPAXAYLGAWSXARPGGNRPGGGKEVTAHDGARRGAAGKRTXXXXXKKKXXPXXPPIKK

SEQ ID NO: 29213 - DNA, 708 bp, Zea mays
  misc_feature: Ceres CLONE 1403767-F
  misc_feature: Encodes the peptide sequence at SEQ ID NO. 29214
  misc_feature (525)..(525): n is a, c, t, g, unknown, or other
ggagctccccgcggtggcggccgctctagaactagtggatcccccgggctgcaggaattcgcacgagaccattacctagaacatcctaatcgaaaagtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgncgggttcgccgtgaaagtctacacccgcgagggcaactggggacctgctgggcaacaacttccccgtcttcttcatccgcgacggcatcagggtcccccgacgtgatccacgcgttcagccccaacccgcgtcgcacgtgcaggagaaaagtgggcgggtgttcgacttcctgtcgcacctcc

SEQ ID NO: 29214 - protein, 181 aa, Zea mays
  misc_feature: Ceres CLONE 1403767-F
  misc_feature (18)..(177): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRRVRRESLHPRGQLGTCWATTSPSSSSATASGSPDVIHAFSPNPRRTCRRKVGGCSTSCRTS

SEQ ID NO: 29215 - DNA, 749 bp, Zea mays
  misc_feature: Ceres CLONE 1403769-F
  misc_feature: Encodes the peptide sequence at SEQ ID NO. 29216
  misc_feature (232)..(232): n is a, c, t, g, unknown, or other
  misc_feature (250)..(250): n is a, c, t, g, unknown, or other
  misc_feature (253)..(253): n is a, c, t, g, unknown, or other
  misc_feature (256)..(256): n is a, c, t, g, unknown, or other
  misc_feature (259)..(259): n is a, c, t, g, unknown, or other
  misc_feature (262)..(262): n is a, c, t, g, unknown, or other
  misc_feature (265)..(265): n is a, c, t, g, unknown, or other
  misc_feature (326)..(326): n is a, c, t, g, unknown, or other
  misc_feature (351)..(351): n is a, c, t, g, unknown, or other
ggagctccccgcggtggcggccgctctagaactagtggatcccccgggctgcaggaattcgcacgagaccattacctagaacatcctaatcaaaaaaccaggcaagcaagcgggagccgccaactcgtgcctctcggcagcggcgtctgaactctgaaccgaccgaccgaccgaccgttccgttccgttcaccccaccatggaggcgccgccgggaacggggcccatggagntggacgccccacttccgncgncgncgncgnggngattcctccccgcggcagcgacaagcacaaggacggggaagggggaagacgctgtgacggnccatatcatctccaccacccatcgngggaagaaacggggagccccaagcggaccatcagttacattggagaacctgttcctgggcacagggttcattttggaacgcccttcacggttaaagggccgggaacacagggaaaacctttcccaatcaaaaaaagggctttaagaatcggcggttcaaaaaaccggggagcgtgcaacttatagggggggcatgggaggacccccaacagtgttttttggtgaagaagatggtttttttttttcccaaacaaggaagggagggaaaattgtttttaaaaaccttgttgagggaggaattttccccccgggaaactcttaaaccgaggcctcgagagaactaaccccaagtgggaaacaccaggggtggggcctttttttttacagggaaagggtttt

SEQ ID NO: 29216 - protein, 98 aa, Zea mays
  misc_feature: Ceres CLONE 1403769-F
  misc_feature (12)..(12): Xaa is any aa, unknown, or other
  misc_feature (18)..(18): Xaa is any aa, unknown, or other
  misc_feature (19)..(19): Xaa is any aa, unknown, or other
  misc_feature (20)..(20): Xaa is any aa, unknown, or other
  misc_feature (21)..(21): Xaa is any aa, unknown, or other
  misc_feature (22)..(22): Xaa is any aa, unknown, or other
  misc_feature (23)..(23): Xaa is any aa, unknown, or other
  misc_feature (43)..(43): Xaa is any aa, unknown, or other
MEAPPGTGPMEXDAPLPXXXXXXFLPAAATSTRTGKGEDAVTXHIISTTHRGKKRGAPSGPSVTLENLFLGTGFILERPSRLKGREHRENLSQSKKGL

SEQ ID NO: 29217 - DNA, 684 bp, Zea mays
  misc_feature: Ceres CLONE 1403772-F
  misc_feature (202)..(202): n is a, c, t, g, unknown, or other
  misc_feature (203)..(203): n is a, c, t, g, unknown, or other
  misc_feature (210)..(210): n is a, c, t, g, unknown, or other
  misc_feature (211)..(211): n is a, c, t, g, unknown, or other
aagctggagctccccgcggtggcggccgctctagaactagtggatcccccgggctgcaggaattcgcacgagaccattacctagaaacttccttagctaacttcccagccccgacaccttggccgccgctccgtgcgcacccagttgctgaggttgcaacgctgcagccggcgaggatcggatgaaccacaacccctctatnnatctaanncgagtctctgcttctgctctcatccatctgtagagtgcacatgcagtgccccatggacactgctgctagtggaacttcgcagtgatgcaatccataacaatgctgatgaggctatcgcccattcaattccattggcaacataaaacaagggttcacagggccttggtatggggatggatccccaggggattttccccttgggggggagcccccccctggggtccccaggggcccccactttgggggttaagggccaaaaaattcccccacattggagggtaaagggggtattttttcggaacccgtgaggttttggcccaaatttttttttttccctctcgggggtgtggggaatttttaatggccccaaaaaagaccttttttaaacctttggggccaaaaattcggggggggtttgaaaaaacaggggggggggcctttgaagaaaagttttttgggaaaattctgggagg

SEQ ID NO: 29218 - DNA, 732 bp, Zea mays
  misc_feature: Ceres CLONE 1403773-F
  misc_feature: Encodes the peptide sequence at SEQ ID NO. 29219
  misc_feature (542)..(542): n is a, c, t, g, unknown, or other
  misc_feature (583)..(583): n is a, c, t, g, unknown, or other
  misc_feature (616)..(616): n is a, c, t, g, unknown, or other
  misc_feature (657)..(657): n is a, c, t, g, unknown, or other
  misc_feature (671)..(671): n is a, c, t, g, unknown, or other
aaagctggagctccccgcggtggcggccgctctagaactagtggatcccccgggctgcaggaattcgcacgagaccattacctagaacatcctaatcgaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcatgttccgcgggccgtggctcgcccgcgcggacttcctgctgacgtgcgacccggcggccgtccagcactgcctggcgtccaaccacgggggctacgacaggggccgagactttgcggagatgttcgacctcctgggcgacgggctgctggttggacgcccccggntccgtgggcgcgccagcggcacgtcgccgccacgtctcggnaaccccggggggtcccgggtccttcgtcctggnaaccatggccgcaaaaaaagggccgggttgggtcggggccntttctggacgccgncgccgccgagataaagaaaaagggaccccgggggccttctttaaattctccgggggagggt

SEQ ID NO: 29219 - protein, 175 aa, Zea mays
  misc_feature: Ceres CLONE 1403773-F
  misc_feature (129)..(129): Xaa is any aa, unknown, or other
  misc_feature (167)..(167): Xaa is any aa, unknown, or other
  misc_feature (172)..(172): Xaa is any aa, unknown, or other
MGALRSLAISYPEFLVAGLCFVSLSALRHAMRERRQRAPLSWPVVGMLPFVLANLGRLYDAITDALHGSGCTLMFRGPWLARADFLLTCDPAAVQHCLASNHGGYDRGRDFAEMFDLLGDGLLVGRPRXRGRASGTSPPRLGNPGGSRVLRPGNHGRKKRAGLGRGXFWTPXPPR

SEQ ID NO: 29220 - DNA, 709 bp, Zea mays
  misc_feature: Ceres CLONE 1403777-F
  misc_feature: Translation starting site: 279
  misc_feature (324)..(324): n is a, c, t, g, unknown, or other
  misc_feature (398)..(398): n is a, c, t, g, unknown, or other
  misc_feature (435)..(435): n is a, c, t, g, unknown, or other
  misc_feature (453)..(453): n is a, c, t, g, unknown, or other
  misc_feature (615)..(615): n is a, c, t, g, unknown, or other
  misc_feature (616)..(616): n is a, c, t, g, unknown, or other
aagctggagctccccgcggtggcggccgctctagaactagtggatcccccgggctgcaggaattcgcacgagaccattacctagaacatcctaatcaaaaaccccgggccttgcgtggcgatcgagttgccaccagacaactcggctcggctcgtcgtccaccgaccctcctcctcgctccaagcttccctctcccctcctcctccgtcagctggggagctagctagggagcggcgccggcggctgatcgagcggacagacagctgaacgagccggaaatggcggcggggcgcgcgccgtggctcgccgccggcctcgtggcgntgctgatggtggtggccgcgcgcgcgcggttcgtggtggagagagcagcgtgcgggtgctgccgcccgacacantccgggcccacacgacgcccgcatcgggaacttcggngtgcccgactacgggggnacgctcaccggggtcgtcatctaccgggaaacaggcccaggggtgggacgactccgacgcccagttaaagcccagtcccggcggcccgttattctcttgtttcacggggaaaatggtacttccgcctcaaggggggaaccgccaaggcgggggccggggggnntttttaatccccaaaaggtggaaaaacaatttgtaaaaagggaacccccgggggctcccggggccggggaatattcaaaaaataaaatccccg

SEQ ID NO: 29221 - DNA, 665 bp, Zea mays
  misc_feature: Ceres CLONE 1403778-F
  misc_feature (243)..(243): n is a, c, t, g, unknown, or other
  misc_feature (254)..(254): n is a, c, t, g, unknown, or other
tggagctccccgcggtggcggccgctctagaactagtggatcccccgggctgcaggaattcgcacgagaccattacctagaacatcctaatcgaaaaaaaaataggaaacgagcaaaggtctggcgagctaccctaccataaactaccatctccacaaacaggctagcacgtagctatatgccagaactgacctagtagaggatcgatcgcagatggtgttcctggcatcctccccaggtggncgcacgatggntcttcacggtctaccgcggcgcccgaagctcaagggccacggcttcaggttaattacggaaaacggccgccaggcgtgttcggcggttccaaaaaaagggcgggggccccgcccatgttactgcggccgcccctttaaaacggggcccccttccctagccccggggcggaaccttttggggaaaatacccgggccctggtggttccacccggttttcccacttatgtgggctgggaaggaggggaaaccacctccccgcccaggggtgggtttcggcctccccccccccccggggggggcaaaaaaaaaaccccccccccccccccgcggaggagggaggtggccacctcccggggggaagcaaagaaagaagggggaattttggggcggcccccccctgcggaaaaaaaa

SEQ ID NO: 29222 - DNA, 719 bp, Zea mays
  misc_feature: Ceres CLONE 1403781-F
  misc_feature: Translation starting site: 223
  misc_feature: SWISSPROT Homolog: EC 1.4.1.2 Glutamate dehydrogenase
  misc_feature (600)..(600): n is a, c, t, g, unknown, or other
  misc_feature (631)..(631): n is a, c, t, g, unknown, or other
  misc_feature (636)..(636): n is a, c, t, g, unknown, or other
  misc_feature (650)..(650): n is a, c, t, g, unknown, or other
  misc_feature (704)..(704): n is a, c, t, g, unknown, or other
  misc_feature (705)..(705): n is a, c, t, g, unknown, or other
  misc_feature (714)..(714): n is a, c, t, g, unknown, or other
aaagctggagctccccgcggtggcggccgctctagaactagtggatcccccgggctgcaggaattcgcacgagaccatttacctagaacatcctaatcgaaaaaaccattcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgatccgtcagtgcagagtgacatgaagctatggccgttcaaggtcatcccagggcctggtgacaagcccatgattgtagtgaactacaagggcgaggagaagcagtttgcttgctgaggagatctcctccatggntctcatcaagattgaaggagattgctgaagnctacnttggctcacatcanaaacgcaagtggtgacagtgccgcctacttcaacgacttcgaaagcagccacanngggacgcgnttttt

SEQ ID NO: 29223 - DNA, 692 bp, Zea mays
  misc_feature: Ceres CLONE 1403782-F
  misc_feature: Encodes the peptide sequence at SEQ ID NO. 29224
  misc_feature (441)..(441): n is a, c, t, g, unknown, or other
  misc_feature (472)..(472): n is a, c, t, g, unknown, or other
  misc_feature (522)..(522): n is a, c, t, g, unknown, or other
  misc_feature (549)..(549): n is a, c, t, g, unknown, or other
  misc_feature (550)..(550): n is a, c, t, g, unknown, or other
  misc_feature (600)..(600): n is a, c, t, g, unknown, or other
  misc_feature (635)..(635): n is a, c, t, g, unknown, or other
  misc_feature (666)..(666): n is a, c, t, g, unknown, or other
aagctggagctccccgcggtggcggccgctctagaactagtggatcccccgggctgcaggaattcgcacgagaccattacctagaacatcctaatcgaaaagctggtgcttctacggggcctggcgatttgaattcgagtggtgcgtgtatagagcgtgagagagagaaaagagagtggctcttgcgctctgcagtccagttcttgaatccagagctgcgattcgtgctcgcctgacgccgatgggccggagcctgagcccgctgctacggcaggagctggacaacctggacaaggacgctgacagccgccgcgcccgcatgaaggcgctcaagtcgtacgccagacacctggactccaagtccatcccgcacttcctcgccgaggtctccgacaccaccgcggccggcgccggcgccggcagcggcatgcccaccggcgncgagttcacatctcgctctacgaggtgctgncgcgggtgcacggcccgcacatcgtgccgcagatcggcacatcatggccnacatcatgtgcacgctctcctccgcgnnggctccttccgctcccacaggctgctccagggtgtgccggcatcgcgcgnacggatcaaccctccgcgccgaggggagaagccgnatcatcgctcctctgcaggcgttgacggggntttatggggggagccaggacgcgccc

SEQ ID NO: 29224 - protein, 150 aa, Zea mays
  misc_feature: Ceres CLONE 1403782-F
  misc_feature (67)..(67): Xaa is any aa, unknown, or other
  misc_feature (77)..(77): Xaa is any aa, unknown, or other
  misc_feature (94)..(94): Xaa is any aa, unknown, or other
  misc_feature (103)..(103): Xaa is any aa, unknown, or other
  misc_feature (120)..(120): Xaa is any aa, unknown, or other
  misc_feature (132)..(132): Xaa is any aa, unknown, or other
  misc_feature (142)..(142): Xaa is any aa, unknown, or other
MGRSLSPLLRQELDNLDKDADSRRARMKALKSYARHLDSKSIPHFLAEVSDTTAAGAGAGSGMPTGXEFTSRSTRCXRGCTARTSCRRSAHHGXHHVHALLRXGSFRSHRLLQGVPASRXRINPPRRGEKPXHRSSAGVDGXLWGEPGRA

SEQ ID NO: 29225 - DNA, 673 bp, Zea mays
  misc_feature: Ceres CLONE 1403784-F
  misc_feature: Encodes the peptide sequence at SEQ ID NO. 29226
  misc_feature (510)..(510): n is a, c, t, g, unknown, or other
  misc_feature (563)..(563): n is a, c, t, g, unknown, or other
  misc_feature (564)..(564): n is a, c, t, g, unknown, or other
  misc_feature (599)..(599): n is a, c, t, g, unknown, or other
ggagctccccgcggtggcggccgctctagaactagtggatcccccgggctgcaggaattcgcacgagaccattacctagaacatcctaatcgaaaaacaccgccactcgcccacacgcgaaggcacctagcagccgccactcgccgaactgaggaacacgccgggcgacgggatacagcagcagcgcgcccctctatccccgacgcgacggcgccctgcagctgcagataaacctgttccaatggccaaacaaaaagagggtgtggacaaaagaactgctaggaagatgatccgatctacggaaggctgtgcaaagagcattactttcgagaggaacaacaaatcagacgctgtgcagcttcacgatctgccgaatgacatcctaggtagcatactatcacggttgacattcagagaatcctcacagatgggccttgtttctcatacctggcggcggctgtggagaagctgttgccggaaactggtcttcaccagtggcaccatgttccnacccggaaataggagcatcaaacatacaaggacccactttgccatgagagtcnnacagttcttgcgtcagctacacactcatcctactnctaataagtttgttataaagtttgggctgcgcaggaagcacactcgccatgtcaacagatggattcgcttctgc

SEQ ID NO: 29226 - protein, 144 aa, Zea mays
  misc_feature: Ceres CLONE 1403784-F
  misc_feature (38)..(85): Pfam Name: F-box Pfam Description: F-box domain
  misc_feature (90)..(90): Xaa is any aa, unknown, or other
  misc_feature (108)..(108): Xaa is any aa, unknown, or other
  misc_feature (120)..(120): Xaa is any aa, unknown, or other
MAKQKEGVDKRTARKMIRSTEGCAKSITFERNNKSDAVQLHDLPNDILGSILSRLTFRESSQMGLVSHTWRRLWRSCCRKLVFTSGTMFXPGNRSIKHTRTHFAMRVXQFLRQLHTHPTXNKFVIKFGLRRKHTRHVNRWIRFC

SEQ ID NO: 29227 - DNA, 654 bp, Zea mays
  misc_feature: Ceres CLONE 1403785-F
  misc_feature: Encodes the peptide sequence at SEQ ID NO. 29228
  misc_feature (435)..(435): n is a, c, t, g, unknown, or other
  misc_feature (438)..(438): n is a, c, t, g, unknown, or other
  misc_feature (634)..(634): n is a, c, t, g, unknown, or other
tccccgcggtggcggccgctctagaactagtggatcccccgggctgcaggaattcgcacgagaccattacctagaacatcctaatcgaaaaaacgcctccaccacgaggcacgcaacaattagaacacatcttgccgccgccgaggacgacggcgatgatgtggcgttcgcgagctcgtgcgctgctcctactccgctcgaccattacccggccaccgccaccacctccacaaccatatcccactcgaaccctaacccgagtcccacctccccgcttcctgtcctcctccccggatcccatccccgattcctcctccgccgccgccgcggatcccttccctgaagccttctcctccccgaccaaggcttctcaagatgccgctgaggccggagaggacaacctgagctcgatgtgggaggaagctggcgacgccnacnacatctttgcctccccggcagcgccgacgccgtaaccgacgatgaggaggtccctgcatctgcgccgccgtggagtccaccccggagacgagatcgcctccatcctcgctgacatgaccgtggacttcaacgagcactcctagccgcagccctccttgctgctgatcaaggctcctgaaagagctgatttccctgntcactatgccgggaagaata

SEQ ID NO: 29228 - protein, 105 aa, Zea mays
  misc_feature: Ceres CLONE 1403785-F
  misc_feature (94)..(94): Xaa is any aa, unknown, or other
  misc_feature (95)..(95): Xaa is any aa, unknown, or other
MMWRSRARALLLLRSTITRPPPPPPQPYPTRTLTRVPPPRFLSSSPDPIPDSSSAAAADPFPEAFSSPTKASQDAAEAGEDNLSSMWEEAGDAXXIFASPAAPTP

SEQ ID NO: 29229 - DNA, 674 bp, Zea mays
  misc_feature: Ceres CLONE 1403788-F
  misc_feature: Translation starting site: 315
  misc_feature (417)..(417): n is a, c, t, g, unknown, or other
  misc_feature (436)..(436): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
aaagctggagctccccgcggtggcggccgctctagaactagtggatcccccgggctgcaggaattcgcacgagaccattacctagaacatcctaatcgaaaaattaattaacaaagagaagacttcttccttcctcgtcgtctccagcccattccaattcttgattccatcgccccaccatccacaactcccctaatccttccaacctcctcgtcgtccagtccaccacctccacgcgcaatggccagcggctaggcggcaccaaccagatcacaaggattcgtttcatccggcagcgcagctctagagcctccatgggcagctacgcgtacaagtactgtatgtgcttcacgcgcaagttccgatccccggacgcccagccgccgccggacgtccgcgccgcccacctctccttcngctctgacgcccatgcccntccgcgcttcgtcgccggcgtccagggcgagtccccccgccgacgtcgaccgcatcctcgccatggctctccggggggccacaggccatgggaatcgcccccgcctcggtaacggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29230 - DNA, 708 bp, Zea mays
  misc_feature: Ceres CLONE 1403790-F
  misc_feature: SWISSPROT Homolog: EC 1.14.13.79 Ent-kaurenoic acid oxidase
aaagctggagctccccgcggtggcggccgctctagaactagtggatcccccgggctgcaggaattcgcacgagaccattacctagaacatcctaatcgaaaaacgacggcggaggcgtgcaagcaggtgctgatggacgaggacgcgttcgtgacggggtggcccaaggcgacggtggcgctggtcgggccgcggtcgttcgtggcgatgccgcacgacgagcaccggcgcctccgcaagctgacggccgcgcccatcaacggcttcaacgcgctcacagggtaccgagccgtaggtgctcttccccatgatttcggcggcgccgcacagcaggtcgtcggccgagaacgccagcgacccatcaaagtgcaccagcttgccgcccacatcgccaccggactccacctccgccgccgacgatcacgtaggggcggcgacaccgtttctgacggaagaatacacggcgcgcgcacggacagcgacggagcatgattaatgattctcctcaacgactaataacgattgtccttgttagaatggcgttcagaagcatgcgaataatgaggcttaaagatctgaatctttatgccgttgaattatatatacaccctgattctgcttgcaaaagagtgggtcccaagcatgctttgtattccagaagctgaatttgaaggattcacccatattcctaatgaagatcttttgagg

SEQ ID NO: 29231 - DNA, 685 bp, Zea mays
  misc_feature: Ceres CLONE 1403793-F
  misc_feature: Translation starting site: 145
  misc_feature (246)..(246): n is a, c, t, g, unknown, or other
  misc_feature (321)..(321): n is a, c, t, g, unknown, or other
  misc_feature (647)..(647): n is a, c, t, g, unknown, or other
ggagctccccgcggtggcggccgctctagaactagtggatcccccgggctgcaggaattcgcacgagaccattacctagaacatcctaatcgaaaaaacctaattaaagaatttgaggagagaaagaaagaaagagtgatcgtcatggagagcaggaggaagaatcaacagaagacgagctacattgtaatttccatccaactcctagcggccctcctactcttggagcttgtgtcgctagtgccnggggcgtcatgcgaggagttgcccttggatttttgggtgagtgcactacgggggggtcggggcaaaggacgtttncacagccgatggatgcaccaagaagaataaggacaccgtgctctgctctgcccaggctaacacggtaaccaatttcatcaaccctaccaactctgaggaacaaggctataggaccatcggggagtccatcgctaacatccctgatggatagcacaaaacggtacatcctcatcctcagcggtggcaccgtgtaccgagagaaagtattggtgagcaaaagcaagccatccgtcaccataagatcatatgaccccatcaaccctgccattattgttgggaaacgacactgcccgcccccctggggaaagataagcaagccccttggnaggtagatggtagtaccaccatggacgtaaaagtccca

SEQ ID NO: 29232 - DNA, 692 bp, Zea mays
  misc_feature: Ceres CLONE 1403794-F
  misc_feature: Encodes the peptide sequence at SEQ ID NO. 29233
  misc_feature (425)..(425): n is a, c, t, g, unknown, or other
  misc_feature (428)..(428): n is a, c, t, g, unknown, or other
  misc_feature (429)..(429): n is a, c, t, g, unknown, or other
  misc_feature (443)..(443): n is a, c, t, g, unknown, or other
  misc_feature (451)..(451): n is a, c, t, g, unknown, or other
  misc_feature (501)..(501): n is a, c, t, g, unknown, or other
  misc_feature (517)..(517): n is a, c, t, g, unknown, or other
tcaccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggccccggccacatccaagccgccgcctccggccccggccacacccaagccgccgcctccggccccggccacacccaagccgccgccagnggnnggagagaagggcgntggcgcgntggtgaagctcacgggcgtcccgcggagggttaacgtggaggcgcggcgnctgcgcacgaagcggngcacggaggtggtcgcgatgcacgtgcgccaggcgggggccaagctcacgctgctctactcccacggaaacgccgccgacctcgggcagatgtacgagctcttcgtcgagctcagcgccaacctcaacgtcaacctcatggggtatgactattctgggtatgggcaatctactgg

SEQ ID NO: 29233 - protein, 157 aa, Zea mays
  misc_feature: Ceres CLONE 1403794-F
  misc_feature (69)..(69): Xaa is any aa, unknown, or other
  misc_feature (70)..(70): Xaa is any aa, unknown, or other
  misc_feature (75)..(75): Xaa is any aa, unknown, or other
  misc_feature (78)..(78): Xaa is any aa, unknown, or other
  misc_feature (100)..(100): Xaa is any aa, unknown, or other
MGAVTSTVAARFAFFPPSPPSYGFEQPAPLPAPATPEPPAPATSKPPPPAPATPKPPPPAPATPKPPPXXGEKGXGAXVKLTGVPRRVNVEARRLRTKRXTEVVAMHVRQAGAKLTLLYSHGNAADLGQMYELFVELSANLNVNLMGYDYSGYGQST

SEQ ID NO: 29234 - DNA, 716 bp, Zea mays
  misc_feature: Ceres CLONE 1403798-F
  misc_feature: Encodes the peptide sequence at SEQ ID NO. 29235
  misc_feature (327)..(327): n is a, c, t, g, unknown, or other
  misc_feature (337)..(337): n is a, c, t, g, unknown, or other
  misc_feature (389)..(389): n is a, c, t, g, unknown, or other
  misc_feature (439)..(439): n is a, c, t, g, unknown, or other
  misc_feature (443)..(443): n is a, c, t, g, unknown, or other
  misc_feature (475)..(475): n is a, c, t, g, unknown, or other
  misc_feature (480)..(480): n is a, c, t, g, unknown, or other
  misc_feature (661)..(661): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
aaagctggagctccccgcggtggcggccgctctagaactagtggatcccccgggctgcaggaattcgcacgagaccattacctagaacatcctaatcaaaaaatcacacactaatcaacaagcaggaccagctagctagctcctctcactgctatcacccgcccagccatctcgctgaaagagaaaagcgcagccatgaagactactagctcgggcattgcagtcgtcctactggtggccatgctggcagtccattccgcgttggccgacatctcgtgctccgacgtgctcaacgacctgtcgccgtgcctgcccttcctgcagggncaggcagccnaacccagcgagagcaacaaccagtgctgcgacggcgtgagggccctgtacgncgcggcggacaccaggcccgacaggcaggccacgtgccggtgcctcaggncggncctacgtcaggtccacgctgtgctctccgcgncgcangagctgcccggcgactgcggcctctcgctgtcctaacacatcacccccgacatcgactgcgacaagatcgaatgaagggatactggtcccttaccagaatccatacgacggggatggtgatgttcagtgcccctgctagcagtaggctgcatctgcactgagtgactaaaataaagaattnggnnngatgttgtgctgaattaaggtgttcgcctggaaacggggtgatgccgcct

SEQ ID NO: 29235 - protein, 106 aa, Zea mays
  misc_feature: Ceres CLONE 1403798-F
  misc_feature (28)..(107): Pfam Name: Tryp_alpha_amyl Pfam Description: Protease inhibitor/seed storage/LTP family
  misc_feature (48)..(48): Xaa is any aa, unknown, or other
  misc_feature (65)..(65): Xaa is any aa, unknown, or other
  misc_feature (82)..(82): Xaa is any aa, unknown, or other
  misc_feature (83)..(83): Xaa is any aa, unknown, or other
  misc_feature (94)..(94): Xaa is any aa, unknown, or other
  misc_feature (95)..(95): Xaa is any aa, unknown, or other
MKTTSSGIAVVLLVAMLAVHSALADISCSDVLNDLSPCLPFLQGQAAXPSESNNQCCDGVRALYXAADTRPDRQATCRCLRXXLRQVHAVLSAXXELPGDCGLSLS

SEQ ID NO: 29236 - DNA, 687 bp, Zea mays
  misc_feature: Ceres CLONE 1403800-F
  misc_feature: Encodes the peptide sequence at SEQ ID NO. 29237
  misc_feature (529)..(529): n is a, c, t, g, unknown, or other
  misc_feature (530)..(530): n is a, c, t, g, unknown, or other
  misc_feature (537)..(537): n is a, c, t, g, unknown, or other
tccccgcggtggcggccgctctagaactagtggatcccccgggctgcaggaattcgcacgagaccattacctagaacatcctaatcgaaaacttcagtaatcagtgctcgctagcccaccacgccctgaacctagcccggacaccagccagaacaggccatgtccatgggctccccggtgcagctcaggcggctgaagcctctgtaccagttcgtggagaacaacatcctggccatcgtggccgtgccgctcgccaccgcggtcctgctcaaggcgtcgtcgctcgggcccgaggagatcctggcgctccggccggcgcacctgttcctggccgcgttcctgcctgccgcggccacggtgctgtacctgatgctccggccgcgcacggtgtacctggtggactacgcgtgcttccgcaccagccccaactgccgcgtcccgttcgcgacgttcctggagcactcccgcgtgtggcctggcttcgacgagcgcagcgtccgggtcatgacgcgcctgctgaagcgttcgnnggctcgnggaagagacgtgcctgccgtacgcgcagaactacatcccgccgtcgcgcgaactgtagtcctcccgccgcgaaggcgagctcgtcatcttctcggccatcgacgacctgctcagccaagactggggtctccccgcgggacatcaaattct

SEQ ID NO: 29237 - protein, 176 aa, Zea mays
  misc_feature: Ceres CLONE 1403800-F
  misc_feature: SWISSPROT Homolog: EC 2.3.1.119 Icosanoyl-CoA synthase
  misc_feature (124)..(124): Xaa is any aa, unknown, or other
MSMGSPVQLRRLKPLYQFVENNILAIVAVPLATAVLLKASSLGPEEILALRPAHLFLAAFLPAAATVLYLMLRPRTVYLVDYACFRTSPNCRVPFATFLEHSRVWPGFDERSVRVMTRLLKRSXARGRDVPAVRAELHPAVARTVVLPPRRRARHLLGHRRPAQPRLGSPRGTSNS

SEQ ID NO: 29238 - DNA, 713 bp, Zea mays
  misc_feature: Ceres CLONE 1403801-F
  misc_feature: Encodes the peptide sequence at SEQ ID NO. 29239
tggagctcaccgcggtggcggccgctctagaactagtggatcccccgggctgcaggaattcgcacgagaccattacctagaacatcctaatcgaaaaaccgcatcgcctcgccgctgttccccgcaacctatcgacccaatctcgtccgacccggcgcgtcgtcccctccagatctccgtcgccctctccaggcagcagaaactgttctgctgcattctgacaaagtggagggcttaggagcttctgcttcttttatgtctgaacaatctttgctttatttgggattgttgggagagtactctcgtgcaactaggaaaaggcacaaggttccgtcccactgcatgcgtcaagagacctgtctggttttcttgttctgatttgtcatttgctggcgctcaaagccggcttgttttcctcgaaggatcagcatcttactcttgattgcggactttggcgcctctgatatcaactccataaaacctttatccaagatggcgcctgcaaacattggtgcttcaaacagggatgatgccttctacaggtaccagatgcccagaatgattaccaagatagaaggccgtggaattggaatcaagaaaaatgttgtggacatgttgacatagcaaaagcacttgccaggccgctttcctaacaaccaagtactttggatgggaccttggggccccgtcccaaatttgatgaaaaaacaggg

SEQ ID NO: 29239 - protein, 43 aa, Zea mays
  misc_feature: Ceres CLONE 1403801-F
MAPANIGASNRDDAFYRYQMPRMITKIEGRGIGIKKNVVDMLT

SEQ ID NO: 29240 - DNA, 695 bp, Zea mays
  misc_feature: Ceres CLONE 1403804-F
  misc_feature: Encodes the peptide sequence at SEQ ID NO. 29241
  misc_feature (525)..(525): n is a, c, t, g, unknown, or other
  misc_feature (575)..(575): n is a, c, t, g, unknown, or other
  misc_feature (627)..(627): n is a, c, t, g, unknown, or other
  misc_feature (631)..(631): n is a, c, t, g, unknown, or other
  misc_feature (640)..(640): n is a, c, t, g, unknown, or other
tccccgcggtggcggccgctctagaactagtggatcccccgggctgcaggaattcgcacgagaccattacctagaacatcctaatcgaaaaaccagctttccccttctctacggtccgggaatcggaagctcacggcagaagccatggggcagacgcatcttttgttgctcgcttgtttctgggtcctgtcaacatgctccttgctacttgatgcttcctccgatggactgttaagaatcaacctgaacaagaagagactggacaaggaagctttgactgctgcgaaattggcgaagaaggagagcaaccttcgaaggtctgtgggtgctgaccagtatctcagtgcctcaactgatgacatagtccctttggacaactacctggacacccagtactttggacagatcagcatcggcacgccaccacagaacttcacagtgatattcgacactggaagctccaacttgtgggttccctcatccaagtgctacttttcgatagcatgctacttacaccacagatancagtcaacccagtcgaagacttacacaaagaatggagaatcttgtacgantacatatggttctgggcaatcgctggctttctcagtgaggacaatgtgtggnttgncaaccttgntgtgcaaatcagaatttattgagacactcgagaaccagcctacttcatcattggg

SEQ ID NO: 29241 - protein, 183 aa, Zea mays
  misc_feature: Ceres CLONE 1403804-F
  misc_feature: SWISSPROT Homolog: EC 3.4.23.40 Phytepsin
  misc_feature (127)..(127): Xaa is any aa, unknown, or other
  misc_feature (144)..(144): Xaa is any aa, unknown, or other
  misc_feature (163)..(163): Xaa is any aa, unknown, or other
  misc_feature (166)..(166): Xaa is any aa, unknown, or other
MGQTHLLLLACFWVLSTCSLLLDASSDGLLRINLNKKRLDKEALTAAKLAKKESNLRRSVGADQYLSASTDDIVPLDNYLDTQYFGQISIGTPPQNFTVIFDTGSSNLWVPSSKCYFSIACYLHHRXQSTQSKTYTKNGESCTXTYGSGQSLAFSVRTMCGLXTLXCKSEFIETLENQPTSSL

SEQ ID NO: 29242 - DNA, 650 bp, Zea mays
  misc_feature: Ceres CLONE 1403805-F
  misc_feature: Translation starting site: 120
  misc_feature: SWISSPROT Homolog: EC 3.4.16.5 Carboxypeptidase C
  misc_feature (421)..(421): n is a, c, t, g, unknown, or other
tggagctccccgcggtggcggccgctctagaactagtggatcccccgggctgcaggaattcgcacgagaccattacctagaacatcctaatcgaaaaatctctctcgctttctctagccatgacgctggtgaggatgccttgccgcctctgctgcttcctgctcgtcgtcgccgcctccgccgtctccgggcgggggcgggtggtcaccaccctcccgggctacgagggccgcctccccttcacctcgaaacaggtatgtggaggtggacgaggacgccggcgcgaagctcttctactacttcgtccgggccgagtccggcgccgacgacagcgacaccccgttcgtcctccggatcccccggcggccaacgctgctcctccttcagcggcctcgcctacgagatagtcccatcatggttngtcgtggagccctacaacgcaggctggccgcgctgcgctacacccaaactcgtggacaaaggggcgcataattctttttggggatcacaggttgggggcggggttttcttcctcagagatggcaaggttacaaggttggaggggagtcacccacatgcactttggggaattccccaccaagggggtaaagggccatccgaagacaggaaaatccttttcacctcggaga

SEQ ID NO: 29243 - DNA, 640 bp, Zea mays
  misc_feature: Ceres CLONE 1403806-F
  misc_feature: Translation starting site: 446
  misc_feature (530)..(530): n is a, c, t, g, unknown, or other
  misc_feature (594)..(594): n is a, c, t, g, unknown, or other
aaagctggagctccccgcggtggcggccgctctagaactagtggatcccccgggctgcaggaattcgcacgagaccattacctagaacatcctaatcaaaaaatattttggttccaaatcgaataacccaatgccgccgtagccgtctgcctcctcgctttcctttcgtccgtacgccgccggctcgcaccgccgacagtcctcagtccagaactccagatcgagcctctctcttcccagatcgggtcctaggctacagcagccgccgcatccgtcaccttcacaccgcgtgcgtgctctctctcccccctccccctctccgtgcgacgactgggtgggctaccgccgccttacgcaaggtgccgagaacttcgccaaaatctgcgccggagaagagcgcccaccagatcaggagctgagaaggcgcgctggtcggtggatgacgatggcgggtggcgggggactgaaccggtcttcatcgagggggcagctgccgccgcaagagctgcttgacgatctctgcagccggntccttctgaatgtgcccagggaggactggagtccgtcgagaggatcctgttcttgctgaagcangcgcactggttctatggagaccactcccgtgagcacaaccccaacc

SEQ ID NO: 29244 - DNA, 694 bp, Zea mays
  misc_feature: Ceres CLONE 1403807-F
  misc_feature: Translation starting site: 168
  misc_feature: SWISSPROT Homolog: EC 2.7.10.2 Non-specific protein-tyrosine kinase
  misc_feature (152)..(152): n is a, c, t, g, unknown, or other
  misc_feature (418)..(418): n is a, c, t, g, unknown, or other
  misc_feature (562)..(562): n is a, c, t, g, unknown, or other
tccccgcggtggcggccgctctagaactagtggatcccccgggctgcaggaattcgcacgagaccattacctagaacatcctaatcgaaaagaaccccaactgcccaagggcgagcgatccgaacccctcggcggcttcgtcaacgacgccnagaacactttgaggaatggctgaagaggatgtccagccccttgtgtgtgacaatggcactggaatggtcaaggcgggtttcgctggtgacgacgcaccgagagctgtctttcctagcattgtaggcaggccacgccacactggtgtgatggtgggcatgggccaaaaggatgcatatgtgggcgatgaagctcagtccaaaagaggtattctgacactgaagtacccaattgagcacggcattgtcggcaactgggatgacatggnagaagatctggcaccacaccttctacaatgagcttcgtgtggcacctgaggagcaccctatactgctgaccgaggctcctctgaaccccaagcaaacagggagaagatgacccagattatgttcgagacattcactgcccagcnatgtatgtggccatccaggcgttctttcctgtaacgccgtgtcgaaaaaacgggtatgtgtcactccctggggggagggggggagcacacgtccttaatttacgaaggtacacgcttctctgttaattcttg

SEQ ID NO: 29245 - DNA, 652 bp, Zea mays
  misc_feature: Ceres CLONE 1403809-F
  misc_feature: Encodes the peptide sequence at SEQ ID NO. 29246
  misc_feature (450)..(450): n is a, c, t, g, unknown, or other
  misc_feature (526)..(526): n is a, c, t, g, unknown, or other
  misc_feature (527)..(527): n is a, c, t, g, unknown, or other
  misc_feature (557)..(557): n is a, c, t, g, unknown, or other
  misc_feature (618)..(618): n is a, c, t, g, unknown, or other
  misc_feature (652)..(652): n is a, c, t, g, unknown, or other
gctctagaactagtggatcccccgggctgcaggaattcgcacgagaccattacctagaacatcctaatcgaaaagctggtgcttctacggggcctggcgatttgaattcgagtggtgcgtgtatagagcgtgagagagagaaaagagagtggctcttgcgctctgcagtccagttcttgaatccagagctgcgattcgtgctcgcctgacgccgatgggccggagcctgagcccgctgctacggcaggagctggacaacctggacaaggacgctgacagccgccgcgccgccatgaaggcgctcaagtcgtacgccagacacctggactccaagtccatcccgcacttcctcgccgaggtctccgacaccaccgcggccggcgccggcgccggcagcggcatgcccaccggcggcgagttcaccatctcgctctacgaggtgctggcgcnggtgcacggccgcaacatcgtgccgcagatcggcaacatcatggcccacatcatgtgcacgctctccctccagcgnnggctccttcccgctcccacagcctgctccnagggtgtgcccggcatcgcgcgggacgggatcgaccctccgcgcccgacggggagaggccngcatcatcgcctccctctgcaggcgtctgagggn

SEQ ID NO: 29246 - protein, 146 aa, Zea mays
  misc_feature: Ceres CLONE 1403809-F
  misc_feature (79)..(79): Xaa is any aa, unknown, or other
  misc_feature (105)..(105): Xaa is any aa, unknown, or other
  misc_feature (115)..(115): Xaa is any aa, unknown, or other
  misc_feature (135)..(135): Xaa is any aa, unknown, or other
MGRSLSPLLRQELDNLDKDADSRRAAMKALKSYARHLDSKSIPHFLAEVSDTTAAGAGAGSGMPTGGEFTISLYEVLAXVHGRNIVPQIGNIMAHIMCTLSLQRXLLPAPTACSXGVPGIARDGIDPPRPTGRGXHHRLPLQASEG

SEQ ID NO: 29247 - DNA, 711 bp, Zea mays
  misc_feature: Ceres CLONE 1403810-F
  misc_feature: Encodes the peptide sequence at SEQ ID NO. 29248
  misc_feature (12)..(12): n is a, c, t, g, unknown, or other
  misc_feature (250)..(250): n is a, c, t, g, unknown, or other
  misc_feature (325)..(325): n is a, c, t, g, unknown, or other
  misc_feature (370)..(370): n is a, c, t, g, unknown, or other
gctctagaactngtggatcccccgggctgcaggaattcgcagagaccattacctagaacatcctaattgaaaagctgtcttatcccttcgtccacgctccgtgcagccgccgcccaaaccctagcaatccgtcctccgccatggccgacgaccactactcctctaagaggaagtacgacgacccctcgccgccgccgcggagcacggggttctcttcgggccgccgcctgcctcgccgctcgcgggtggngcctcgtcgaacacagcgtgccaccgccccccgatgagatccagctcgcgaagcagcgcgcgcaggagatcgcgncgcgtatcttaaacgccgcagaggccaagcgtcctcgcgtcgacnacggtgacgatgacagcgggcggcttcggtgtaggcctgggcagcactgggtgggcggtggccgcatccgggggaggaggactcggcttctccgtctcttgcgggggggggggacggggctttcatcccacaattatctttttcaaagaggggaactcagaacttccccttaagggggggatccccggggaccaggcaagaggatgggaattccaaaggggggggggtggtgtgttttttttggaaaagccggggaaacatttaaggaatcccccttctcccccggggggaaagtttccgggcccaagagaccctggacgtttaacctgggggactagaaa

SEQ ID NO: 29248 - protein, 110 aa, Zea mays
  misc_feature: Ceres CLONE 1403810-F
MTAGGFGVGLGSTGWAVAASGGGGLGFSVSCGGGGRGFHPTIIFFKEGNSELPLKGGIPGDQARGWEFQRGGGGVFFLEKPGKHLRNPPSPPGGKFPGPRDPGRLTWGTR

SEQ ID NO: 29249 - DNA, 695 bp, Zea mays
  misc_feature: Ceres CLONE 1403813-F
  misc_feature: Translation starting site: 354
  misc_feature (521)..(521): n is a, c, t, g, unknown, or other
  misc_feature (620)..(620): n is a, c, t, g, unknown, or other
  misc_feature (626)..(626): n is a, c, t, g, unknown, or other
  misc_feature (649)..(649): n is a, c, t, g, unknown, or other
  misc_feature (686)..(686): n is a, c, t, g, unknown, or other
  misc_feature (695)..(695): n is a, c, t, g, unknown, or other
tccccgcggtggcggccgctctagaactagtggatcccccgggctgcaggaattcgcacgagaccattacctagaacatcctaatcgaaaaatctcctttctctctctacacatactcagacgagcagaagcagctagggacaccataggcaaactacttcagcaagaaattaaactatctcctacgcaagatcagaagaaactgtgtatggagcaagaagaggttggcctcgccctgggcctctccctcggctccggccaccaccaccaggagctcaagccccaacatccgtcgcatccgtgtgcggcgttgttggagccttctctgtcgctcagcggcccggcgaccaaggatgatggcccgaccgcaccgggtgaggaggttcgctgccgtgaagagggagctgcagacgatggaggggaacgacgacgaggccaccggcagggacttgcactcccccggggggggcccgccggggggtgggtactggcccgacgacgacgaagggtgcaacagcagnccggaagaagctgaggctgtcccaggagcagtcggcgctgctggaggaccacttcagggagcacagcaccctcaaccctaagcagaaagctgctttggncagacnactgaacctgagcccagggaagntgggaggttgggttccaaaacagaagaagcagaaccnagctgaagn

SEQ ID NO: 29250 - DNA, 689 bp, Zea mays
  misc_feature: Ceres CLONE 1403815-F
  misc_feature (241)..(241): n is a, c, t, g, unknown, or other
  misc_feature (244)..(244): n is a, c, t, g, unknown, or other
  misc_feature (312)..(312): n is a, c, t, g, unknown, or other
  misc_feature (400)..(400): n is a, c, t, g, unknown, or other
  misc_feature (583)..(583): n is a, c, t, g, unknown, or other
tccccgcggtggcggccgctctagaatagtggatcccccgggctgcaggattcgcacgagaccttacctagaactcctaatcgaaaaaaaaaaaaactgagcctgcccgcccgcccgcccgcgcgctccgctccgtgaactatatctatctatcacctgctgctccaaggaggcggacagaggcaggcaggaaggcactcacttctccaggagctcggagtcggcagcaagagagaatggncgncgacgccgccgccgccgccacccttcgtactgctctctcccaaggtctggtgctgtggcatgtttagngcaatcttcattgcttgctgtcttgctgcatttaacacagcacgagcttcagagatagtccaagcctatctgtgttggcaagagatcntcatccaagggtttacggcaatgaaccatttctaaagcacaaaagacgtgatggcttttatcatttcctcaggagagcaaatggcggtcacaggaggtcacccgacgagcgggtcctcgacataacccaggagggccatccacgggaacaaaattctggcgccccaacccccctgattcaggnccaggaaggctgaaaaagctgctccgcacccccggcaagatctactaccagtaccaggggacccgcccccgggggggtccacaagccccaacacgcccggggcgga

SEQ ID NO: 29251 - DNA, 731 bp, Zea mays
  misc_feature: Ceres CLONE 1403817-F
  misc_feature: Encodes the peptide sequence at SEQ ID NO. 29252
  misc_feature (731)..(731): n is a, c, t, g, unknown, or other
agagctggagctccccgcggtggcggccgctctagaactagtggatcccccgggctgcaggaattcgcacgagaccattacctagaacatcctaatcgaaaaaaaacccggtttcacactagttctgtattcgtgtcctctggtctctcgcaggccaaacaaaagcgccgctgccgccggcaatgttccgccgcctcctcccccaccgtcgctacatctccacctcgcccgcctccaactccaacccgaccctctactctgacggaaccatcccattctctatcctctcgtggggccgtggcgcttccggacagctcggcggtggcaaggaggagcgccgcctctacccatcccccgtcgcccacctacttctccccgaatcagacccacgccttgctcccacccccggacgccttccctctgcagaggagacgtctggagtggagggtgggatctcttgtgggctcttccactcctcgctcctcgtcgaaggaggcgcctgggtgtgtggcaagggcgacggaggcccgctcggcctcggggacgagtcttccggctttcgtgccccgctctaaccccaatctccgcgaatctccgcctcccttgccgcggggggggcatccaactcccgcggcgctgaaccacttccgggggaagttctttccacctgggagttatgggggaattttgggagcctctggcgtccaccaggttaataccattaggggagn

SEQ ID NO: 29252 - protein, 130 aa, Zea mays
  misc_feature: Ceres CLONE 1403817-F
MFRRLLPHRRYISTSPASNSNPTLYSDGTIPFSILSWGRGASGQLGGGKEERRLYPSPVAHLLLPESDPRLAPTPGRLPSAEETSGVEGGISCGLFHSSLLVEGGAWVCGKGDGGPLGLGDESSGFRAPL

SEQ ID NO: 29253 - DNA, 718 bp, Zea mays
  misc_feature: Ceres CLONE 1403822-F
  misc_feature: Encodes the peptide sequence at SEQ ID NO. 29254
  misc_feature (491)..(491): n is a, c, t, g, unknown, or other
  misc_feature (496)..(496): n is a, c, t, g, unknown, or other
  misc_feature (497)..(497): n is a, c, t, g, unknown, or other
  misc_feature (599)..(599): n is a, c, t, g, unknown, or other
  misc_feature (662)..(662): n is a, c, t, g, unknown, or other
  misc_feature (675)..(675): n is a, c, t, g, unknown, or other
  misc_feature (676)..(676): n is a, c, t, g, unknown, or other
tggagctccccgcggtggcggccgctctagaactagtggatcccccgggctgcaggaattcgcacgagaccattacctagaacatcctaatcgaaaaaattgtaaactgtgatcttccaggctgcaccaactccatctccaggtggaatggagttagcttgcctgcacactcagtcacggtggcgtccctataaggcgtaggcctgacgtcacccacgccctcgcctcgcacggggcggcgcggcggccggcggagggaatggcgaggcgaagcagaggcagcggcagcgtcacggacgcggcgtcgaaggcggacgcggcggcgatgcggatggtgtcccgcaggggcgccgtgcggctggtgctcgtgtcggccaccgcctgggccatgctcgggctcgtcgcgctcgccttccacctccggccatgcagctcccgcgtcgcattcctctcagctctttgcaaaagagacagtaaagttctcctctgtngttgnnactcgatggggctctcatccaaaccactccaccgctgcccgatacctggttgcggaatgatcaaaaaatggtgttgtcataccaaagaggactcccacacantttgggtgaagaagtggcatttatatactgttgacaaccaaggaaaagaccctcacccgctgntttggagacgcannactttggaaaaagaggggaaggagagctttaactgacttcta

SEQ ID NO: 29254 - protein, 150 aa, Zea mays
  misc_feature: Ceres CLONE 1403822-F
  misc_feature (78)..(78): Xaa is any aa, unknown, or other
  misc_feature (79)..(79): Xaa is any aa, unknown, or other
  misc_feature (80)..(80): Xaa is any aa, unknown, or other
  misc_feature (114)..(114): Xaa is any aa, unknown, or other
  misc_feature (135)..(135): Xaa is any aa, unknown, or other
  misc_feature (139)..(139): Xaa is any aa, unknown, or other
MARRSRGSGSVTDAASKADAAAMRMVSRRGAVRLVLVSATAWAMLGLVALAFHLRPCSSRVAFLSALCKRDSKVLLCXXXSMGLSSKPLHRCPIPGCGMIKKWCCHTKEDSHTXWVKKWHLYTVDNQGKDPHPLXWRRXTLEKEGKESFN

SEQ ID NO: 29255 - DNA, 675 bp, Zea mays
  misc_feature: Ceres CLONE 1403824-F
  misc_feature: Translation starting site: 105
  misc_feature (449)..(449): n is a, c, t, g, unknown, or other
  misc_feature (507)..(507): n is a, c, t, g, unknown, or other
  misc_feature (508)..(508): n is a, c, t, g, unknown, or other
  misc_feature (666)..(666): n is a, c, t, g, unknown, or other
  misc_feature (675)..(675): n is a, c, t, g, unknown, or other
tggagctccccgcggtggcggccgctctagaactagtggatcccccgggctgcaggaattcgcacgagaccattacctagaacatcctaatcgaaaataagaagatgatgcgctgcgctgcaacgggcggcgggtgcgtcgcttcgtggagcggcgattggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagttaaatcctcaggacatgttctgccatatgttggcgttgcttgtttgggggctattctgtttggttaccantcttggtgtggtcaatggcgcacttgaatatctcgcgaaggatcttgggattgctgannatgctgtcttgcagggggtgggtggttagcacatccttggctggtgcacactaggttcttttactgggggttctttggcagataaattttggcgggacagacattcatcctggatgcaggtccacttgctctaggtgcattcttgagggcacagctcnagatatcgn

SEQ ID NO: 29256 - DNA, 705 bp, Zea mays
  misc_feature: Ceres CLONE 1403825-F
  misc_feature: Encodes the peptide sequence at SEQ ID NO. 29257
  misc_feature (333)..(333): n is a, c, t, g, unknown, or other
  misc_feature (370)..(370): n is a, c, t, g, unknown, or other
  misc_feature (383)..(383): n is a, c, t, g, unknown, or other
  misc_feature (384)..(384): n is a, c, t, g, unknown, or other
aagagctggagctccccgcggtggcggccgctctagaactagtggatcccccgggctgcaggaattcgcacgagaccattacctagaacatcctaatcgaaaagaacacatacctaattatcacctgtaagccagctgaaccacatctcgtcgtgcacatccggagcccgggaacacacacacacattgccatggccatgcccatgcccaagcccgtcctgagcctgctcgtgcacctacacgccgccgtcctgttccttcccgccccggccggcggcgcggtctacaacgttctgcgctacggcgcgcgccccgaacgcgtgacggacgcgncgggccccttcctccgcgcgtggggggacgctgccgntcgcccctccggnncgcgtgtacgtgccgccagggaagtacctgtgcggagcgccaacgtcaccggcccgtgccacagccgcgccgggacgttcccgtcgccggcacggtcgtccgccccggggcctacggggggcggggttcgtcggggagggggaatccgttccaaaaaaatgaagggctctcttctcccccggggggggaacctttaacggcccccgaaagggctttttgggccctgaaaaaaaggggggaaggggaattgtcccaccccccacggccactttggggataccccaattccaagggcgggggggggggccccgttctgtccac

SEQ ID NO: 29257 - protein, 129 aa, Zea mays
  misc_feature: Ceres CLONE 1403825-F
  misc_feature (48)..(48): Xaa is any aa, unknown, or other
  misc_feature (60)..(60): Xaa is any aa, unknown, or other
  misc_feature (65)..(65): Xaa is any aa, unknown, or other
MAMPMPKPVLSLLVHLHAAVLFLPAPAGGAVYNVLRYGARPERVTDAXGPFLRAWGDAAXRPSGXRVRAAREVPVRSANVTGPCHSRAGTFPSPARSSAPGPTGGGVRRGGGIRSKKMKGSLLPRGGNL

SEQ ID NO: 29258 - DNA, 665 bp, Zea mays
  misc_feature: Ceres CLONE 1403826-F
  misc_feature: Encodes the peptide sequence at SEQ ID NO. 29259
tgagttctagtggatcccccgggctgcaggaatttgcacgagaccatacctagaacatcctaatcgaaaagcacaatagatcacctacctttctcacccttcatccaacggcgccagcacgcacgagcagtgcgccgccatccgttgcgccgtcgtacgcagccagctggagcgccgcttcccgccagccagccggagcgccgccgcccgcgagagtcccgcccccggcgtgtatcagaaccccccccctccccggcgccgcgcagcagagctccgtggcccccgccctcgccgagcagcagagggccgcctccagccagctcgccggctatggctgccgctggagatccaccacctcctatttatgctgagggtgctgcaaggacaagaggagaaatatctccacatttccagacatatgcaagcgacgacgatgcaaaacttgagaccacacgtgcaaggctgtcaaatatcctcaaaaggcatgaagatctgaaagagcgcctttcacgggattctgataagctcatttttgagcgcctacagaaagaatttgaggctgcacgggctgctcaaacggaagagatatcaataaatgatgatgagtgcaatgatggtttactgccaccatccgtgagaggttcatatggagggtgataggaggc

SEQ ID NO: 29259 - protein, 108 aa, Zea mays
  misc_feature: Ceres CLONE 1403826-F
MAAAGDPPPPIYAEGAARTRGEISPHFQTYASDDDAKLETTRARLSNILKRHEDLKERLSRDSDKLIFERLQKEFEAARAAQTEEISINDDECNDGLLPPSVRGSYGG

SEQ ID NO: 29260 - DNA, 716 bp, Zea mays
  misc_feature: Ceres CLONE 1403827-F
  misc_feature: Encodes the peptide sequence at SEQ ID NO. 29261
  misc_feature (489)..(489): n is a, c, t, g, unknown, or other
  misc_feature (571)..(571): n is a, c, t, g, unknown, or other
  misc_feature (606)..(606): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
aaagctggagctccccgcggtggcggccgctctagaactagtggatcccccgggctgcaggaattcgcacgagaccattacctagaacatcctaatcgaaaatcctttcccctcctccctcctcggctcgtctctgttcccctttccctcctgcgcacccgtcttctcctccccgcgtcaaaccccagcacaaaaagcaaccgcccgccgcctcctcgttcctctcccgaatcagccgtcgcggtgcctaatccggccgatcccccctccgatccgcgggtgcccgccgcagaggcggcgcctccgggcctcccccgatgtatagcaacttcaaggagcaggcgatcgagtacgtcaagcaggcggtccaggaggacaatgccggcaactacgtcaaggcgttccctctctacatgaacgcgctcgagtacttcaaaacccacctcaagtacgagaagaaccccaagatcaaggaggccatcaccgccnagttcaccgagtacctccgccgcgccgaggagatccgggcggtcctcgatgagggcggcgcagggcctggggccaaacgtgncgacgcagctgtcgccacgcgccccaagacaaggncaggnnnacgggacgaggcaacggagggatgactccgagcagtccagctggagggcggggttcaactccgccatcatcaccgagaagcccacattaggtggaacgacgtt

SEQ ID NO: 29261 - protein, 106 aa, Zea mays
  misc_feature: Ceres CLONE 1403827-F
  misc_feature (5)..(73): Pfam Name: MIT Pfam Description: MIT (microtubule interacting and transport) domain
  misc_feature: SWISSPROT Homolog: EC 2.7.11.1 Non-specific serine/threonine protein kinase
  misc_feature (58)..(58): Xaa is any aa, unknown, or other
  misc_feature (85)..(85): Xaa is any aa, unknown, or other
  misc_feature (97)..(97): Xaa is any aa, unknown, or other
  misc_feature (99)..(99): Xaa is any aa, unknown, or other
MYSNFKEQAIEYVKQAVQEDNAGNYVKAFPLYMNALEYFKTHLKYEKNPKIKEAITAXFTEYLRRAEEIRAVLDEGGAGPGAKRXDAAVATRPKTRXGXRDEATEG

SEQ ID NO: 29262 - DNA, 710 bp, Zea mays
  misc_feature: Ceres CLONE 1403828-F
  misc_feature: Encodes the peptide sequence at SEQ ID NO. 29263
  misc_feature (628)..(628): n is a, c, t, g, unknown, or other
  misc_feature (651)..(651): n is a, c, t, g, unknown, or other
  misc_feature (658)..(658): n is a, c, t, g, unknown, or other
  misc_feature (700)..(700): n is a, c, t, g, unknown, or other
  misc_feature (710)..(710): n is a, c, t, g, unknown, or other
ggagctccccgcggtggcggccgctctagaactagtggatcccccgggctgcaggaattcgcacgagaccattacctagaacatcctaatcgaaaaatactcccaccttctgctccctctcacggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaagggagttgataatgagactccatacactattatgtttggtccagataaatgtgggtcaaccaacaaggttcatttcatccttnaagcacagaatcctaagactggnaagtatngtgagcatcacctcaaattcccaccttctgtcccatacgacnagctctctcn

SEQ ID NO: 29263 - protein, 175 aa, Zea mays
  misc_feature: Ceres CLONE 1403828-F
  misc_feature (24)..(175): Pfam Name: Calreticulin Pfam Description: Calreticulin family
  misc_feature (149)..(149): Xaa is any aa, unknown, or other
  misc_feature (159)..(159): Xaa is any aa, unknown, or other
  misc_feature (173)..(173): Xaa is any aa, unknown, or other
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKGVDNETPYTIMFGPDKCGSTNKVHFILXAQNPKTGKYXEHHLKFPPSVPYDXLS

SEQ ID NO: 29264 - DNA, 678 bp, Zea mays
  misc_feature: Ceres CLONE 1403829-F
  misc_feature (225)..(225): n is a, c, t, g, unknown, or other
  misc_feature (463)..(463): n is a, c, t, g, unknown, or other
  misc_feature (464)..(464): n is a, c, t, g, unknown, or other
  misc_feature (466)..(466): n is a, c, t, g, unknown, or other
  misc_feature (480)..(480): n is a, c, t, g, unknown, or other
tccccgcggtggcggccgctctagaactagtggatcccccgggctgcaggaattcgcacgagaccattacctagaacatcctaatcgaaaagattcaaaccgtcgccgccgtcgccgagagagttgtgactcccccagcggcggcctgcgaccgcccgttccccagtcgtctcttctctccggaccgcatttgcgcccgtcccgtcccctcccctctccctcggngaggtccgagagcagagctgcctcgggagggtcgtagtccagtccacccgtccgctgcggcggcggttacgaggcggggaattccggcgcgggttgccgcgatccccgcagtgatgtgcggatcgggtcatgggtgtgacccagccgggaagtagtggaggctgctggaggactagggccgggactgggagctgcggccacgacgatgtacgtcgcccgggagtctaccaagctgtgnnangagggtgtgcgcgnagacaacagcggagctgcagcttctgttcgagaagtggcattgctccttgcagggggtggtgtttcagacatccatggattgctgctccaggagtgcattacttgcatcggcccggacactgcctcaggattggggattatggcccttccagagcttgcccaaagaagggttatcttagggagagtttttgctttctt

SEQ ID NO: 29265 - DNA, 694 bp, Zea mays
  misc_feature: Ceres CLONE 1403833-F
  misc_feature: Encodes the peptide sequence at SEQ ID NO. 29266
  misc_feature (497)..(497): n is a, c, t, g, unknown, or other
  misc_feature (498)..(498): n is a, c, t, g, unknown, or other
  misc_feature (537)..(537): n is a, c, t, g, unknown, or other
  misc_feature (559)..(559): n is a, c, t, g, unknown, or other
  misc_feature (600)..(600): n is a, c, t, g, unknown, or other
  misc_feature (601)..(601): n is a, c, t, g, unknown, or other
  misc_feature (608)..(608): n is a, c, t, g, unknown, or other
aaagctggagctccccgcggtggcggccgctctagaactagtggatcccccgggctgcaggaattcgcacgagaccattacctagaacatcctaatcgaaaatccatccccgcgacgacccaccacccacccctgcagtctgcagcatccccttccccactcccggctggtctgctgcggccacccctgcgccgatccacctccgctgcttcctgcctcaatatattcgcccgcctcgtcgcctccgaccccgccacagaaggccttccagaaccctccgacccctcacctccgctccgccccgctccactctcctcctcccgggccggccgactccgatggccgtcgtcgaggccgccgcagccgaccacgccgcgccgccgctccaggaggaggcaccgggcgcgggcgctggcgctggcgccgacgcccgggagcgcgagatgcgggatctggaggacctgctctccaagctcaaccccatggccgagggagtnngtccgccctcccctcgctcccccgcgccctcacgcccgngcgtttctcccccgcgctaagnttctacccggccggcgccggcttcgcggtcgcctcgcgganncacgcgngtcgtcggttcccgggcgtcgcgacgcccacgcgcacgaggcagagaaaggcggagctggaggaggttcagcgccacggtcccccc

SEQ ID NO: 29266 - protein, 72 aa, Zea mays
  misc_feature: Ceres CLONE 1403833-F
  misc_feature (54)..(54): Xaa is any aa, unknown, or other
  misc_feature (67)..(67): Xaa is any aa, unknown, or other
MAVVEAAAADHAAPPLQEEAPGAGAGAGADAREREMRDLEDLLSKLNPMAEGVXPPSPRSPAPSRPXVSPPR

SEQ ID NO: 29267 - DNA, 754 bp, Zea mays
  misc_feature: Ceres CLONE 1403836-F
  misc_feature: Encodes the peptide sequence at SEQ ID NO. 29268
  misc_feature (309)..(309): n is a, c, t, g, unknown, or other
  misc_feature (323)..(323): n is a, c, t, g, unknown, or other
  misc_feature (351)..(351): n is a, c, t, g, unknown, or other
  misc_feature (352)..(352): n is a, c, t, g, unknown, or other
ggagctccccgcggtggcggccgctctagaatagtggatcccccgggctgcaggaattcgcacgagaccattacctagaacatcctaatcgaaaagacgatatttcggatcacacttccgtctggccaccgcaaagcaccccctctccccccgtcgccatggcgagcgataaccgcgcgtcgctcctccccttcgccgccgccgtccttgtggtgctcctcgctggcggcgccgcggcggacgacgcttccagcgacgacgacgctgggacttcacggacacccggctgctccaacaagtccagctggntcaggtgaagaatngggtgatgggactgaaggtacacttttnngtggctaagtgcaaaaatttggagctcctttgccaagagatattcatgaagcaaaaaaaggcatttggctgccctatcaaatccaattggactggtgcgtcaactttgacctccaaggtaaccaggttccgttgctataccaaaccgggggggaaagggctttttcacgaaaaaaacaaaaaattgcctcaggcccgggggttccaccgcggttaacaagttatcaaggagaaagagaagagttttaccaaagggggtttggggggaaaaaaagaaccccccctttaaaggggaccaaaacccggggggtctagaaaccccccccgcccgggggggaaaaagagctgaaaaaaacttttttttttataaggggaaaaggggggggggagggcggcccttttt

SEQ ID NO: 29268 - protein, 52 aa, Zea mays
  misc_feature: Ceres CLONE 1403836-F
  misc_feature (51)..(51): Xaa is any aa, unknown, or other
MASDNRASLLPFAAAVLVVLLAGGAAADDASSDDDAGTSRTPGCSNKSSWXR

SEQ ID NO: 29269 - DNA, 675 bp, Zea mays
  misc_feature: Ceres CLONE 1403838-F
  misc_feature: Encodes the peptide sequence at SEQ ID NO. 29270
  misc_feature (498)..(498): n is a, c, t, g, unknown, or other
  misc_feature (522)..(522): n is a, c, t, g, unknown, or other
  misc_feature (524)..(524): n is a, c, t, g, unknown, or other
  misc_feature (552)..(552): n is a, c, t, g, unknown, or other
  misc_feature (612)..(612): n is a, c, t, g, unknown, or other
  misc_feature (619)..(619): n is a, c, t, g, unknown, or other
aagctggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctggcgcagagctaaacgcgccactccgcggcaagctgctctgctgctcccaccagccaccgcaccgagtggccatggcgactgcagcgagttcgacgccggcggcgcggcagcctactctggtctgcgcgtcactgaccgcgcgggtgccccgggagatgccagcggaggttgccgccgctgncgcgctcgggtgccgacgtggcgnancttcaggtcggctggctcgacagcttcnaggcatgcagggacctgccggtgttctcgcccagcccggttcgttcccgtatctcacaangggggcnaaatgggaagggagccaatacccaggcaagatgagcccggtttgggcgctctactg

SEQ ID NO: 29270 - protein, 95 aa, Zea mays
  misc_feature: Ceres CLONE 1403838-F
  misc_feature (37)..(37): Xaa is any aa, unknown, or other
  misc_feature (45)..(45): Xaa is any aa, unknown, or other
  misc_feature (46)..(46): Xaa is any aa, unknown, or other
  misc_feature (55)..(55): Xaa is any aa, unknown, or other
  misc_feature (75)..(75): Xaa is any aa, unknown, or other
MATAASSTPAARQPTLVCASLTARVPREMPAEVAAAXALGCRRGXXSGRLARQLXGMQGPAGVLAQPGSFPYLTXGAKWEGSQYPGKMSPVWALY

SEQ ID NO: 29271 - DNA, 767 bp, Zea mays
  misc_feature: Ceres CLONE 1403842-F
  misc_feature: Encodes the peptide sequence at SEQ ID NO. 29272
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (38)..(38): n is a, c, t, g, unknown, or other
  misc_feature (46)..(46): n is a, c, t, g, unknown, or other
  misc_feature (77)..(77): n is a, c, t, g, unknown, or other
nnnccccccaccccccccttccccccgcgggggggaancagagtgntgtacaaactgggactccccgcggtggcggncgctcttcacctagcggatcccccgggctgcaggatttcgcacgagaccattacctagaacatcctaatcgaaaaaaagcaccacgcacgatcgccttcgccaaccgcgccgctctctctctctttctctctcgcacgagccgcgccggcgccgccaccacgcgcgcgggagacagagaccacagccgcagccaccgacgggcggaataggaatggtggcgccggggggaggagcaggaggaggtccgttgcggtggccggcggcggaggagcttgacactgtacggaagaaggcggtggagattagtggaagggatgaacaagaggttatggttgctgcttgcccctacaggaggtggcctttgggggctcatattgatcatcagggtggagtagtcacagctatgaccataaattatggagtactccttggtttcggtccctctaatgggtctgagcaaacctttatttttcttgcagggcctacttcattctggggcagcttgaaggcgctataaaattcacagttgatgaccttgcaaaagccctattcgataaccctggaggaacataacctgggggagaggtatgcgaaaagggggcctggtaagtgcgactggcgggaaataggtggagtatgaattcccaagggaaggtggttatccatgagggactataagtgtgcggggg

SEQ ID NO: 29272 - protein, 101 aa, Zea mays
  misc_feature: Ceres CLONE 1403842-F
MVAPGGGAGGGPLRWPAAEELDTVRKKAVEISGRDEQEVMVAACPYRRWPLGAHIDHQGGVVTAMTINYGVLLGFGPSNGSEQTFIFLAGPTSFWGSLKAL

SEQ ID NO: 29273 - DNA, 678 bp, Zea mays
  misc_feature: Ceres CLONE 1403843-F
  misc_feature (598)..(598): n is a, c, t, g, unknown, or other
  misc_feature (600)..(600): n is a, c, t, g, unknown, or other
  misc_feature (635)..(635): n is a, c, t, g, unknown, or other
  misc_feature (654)..(654): n is a, c, t, g, unknown, or other
caagctggagctccccgcggtggcggccgctctagaactagtggatcccccgggctgcaggaattcgcacgagaccattacctagaacatcctaatcaaaaaacacgcgcgcacgtaaaaacgaaaaaaggtccccggccgagaccgagagccgcggtccagagcggggggcggccggcaaggacgaaacggcccaacgccaccacctccaccacctcgtcctcgatcgacacctcccccgtcgccgtcccgtgactccccgtccagccgtccaggcccagctgcccccgcgacccagacgaccacgtccgcctcggcctgcgcctccccgctacaagagtccgtccgcccgccagcgctgcggtgccagcgagcccctccctcctccactctctgcggggcggagatcccgtccctttctctgggggcccccggggaaaaggggggggagcctttggagggcccccctttttttaaacggccctgaggggggccccccgccttttccggggggggggggtttttttgtttggttttacaacagggggggggggcggccctctttttcttttgggggccccccttggtttggggcagnantccttttttttatataaaaaccacaagacccgccncggaggaggctgcaccaanttcctgtcaccccaaccgcgggtg

SEQ ID NO: 29274 - DNA, 685 bp, Zea mays
  misc_feature: Ceres CLONE 1403844-F
  misc_feature: Encodes the peptide sequence at SEQ ID NO. 29275
aaagctggagctccccgcggtggcggccgctctagaactagtggatcccccgggctgcaggaattcgcacgagaccattacctagaacatcctaatcgaaaaatgaccgactaggccatggtctctctccgctccgacgcgcccgacccaccaccacatccctcgtggatgtcctcgccgacatccactcctcggcacttccgccgttcgagtcatcccaaggcaaggcgaagatgcacaatgaggaggaggacgaggctaatgctgcgcagaagatgtgcggcatctgctatctcgacggtcggggtagcatccgcgctgagatcgactgctgcgcccatttcttttgctttgtctgaatcatggcttgtcgccgcggagaggcccgctgtcccttctggagggcccgtttccacaccatccgccgcccgaccgtcgccggacggttccccgacgagcgaatcgtactcgatccaagagcgacaaccgggtacaccatcctcaggtgaacggtagcagcatagtgggcggatatccttacgcgaacaccatatgcaccgattgcaagagctccagcgatgactaactgctgctactctgcgagatctgctactcagctgcacacacttagtgagtcgctctgatgaccaccgcgacttagggagactggatctgcgaagactgc

SEQ ID NO: 29275 - protein, 41 aa, Zea mays
  misc_feature: Ceres CLONE 1403844-F
MHNEEEDEANAAQKMCGICYLDGRGSIRAEIDCCAHFFCFV

SEQ ID NO: 29276 - DNA, 678 bp, Zea mays
  misc_feature: Ceres CLONE 1403847-F
agagctggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgccccgggagatggcagcggaggttgccgccgctgcggcgctcggtgccgacgtggcggagctccaggtcggctgccctcgacagcttcgagccatgcacggacctgcccgtgcttctcgcccagccccggtcgctccccgtcatcgtcacctacagggcgaattgggagggaggccagtacgcaggcgaaaatgagccacggtttgaggcgctt

SEQ ID NO: 29277 - DNA, 830 bp, Zea mays
  misc_feature: Ceres CLONE 1403856-F
  misc_feature: Encodes the peptide sequence at SEQ ID NO. 29278
  misc_feature (1)..(1): n is a, c, t, g, unknown, or other
  misc_feature (40)..(40): n is a, c, t, g, unknown, or other
  misc_feature (72)..(72): n is a, c, t, g, unknown, or other
nttcgtcctccccgctccaggccggccccctggggggcgngcatcaaagtggcactccaccgcggggggggncgcactacaacagaggatcccccgggctgcaggtatccgcacgagaccattacctagaacatcctaatcaaaaaaactttagcagcaaaattcacccgaaagaaactcctgataaatagaaacaggagggaaaaagaaaaacacttgcagcggcatccaccaccgaagctcccatcatcggtctatccctccgtgtcaaccccctcctcagaaggtctaattgcagttcagcccctggccggtccgccgggccaccggaaggagccgctcgccggaggaagccccccatctccttgccctgcggcgggtttatggggttctcgctgtaccccatgaagacgtccacgcggttgctctggagcactagcttcttccgccataagcccaccctcctcctccttgcttcctctgaggccggacccacccgcggtcaatcaccctcgggcggcggcccccatgtagactgcgcggtcctagcaaccgcctccagtggggtggcgctaggggcctcattgcacgcctcacgactggagttttggttgccataatttcgggaaaaagaaatgcaataacaggcgtcagtgaagcggaccacaaacccagcatgggaaatccgaaacgggcggcacaattttcaacactctgggccgccaccaccgactgacgccgccgggccgagcacaaatagctggctccctcccccagagccgcaaccctaactctccccccttggaaagcgcgcttctctctccgaggag

SEQ ID NO: 29278 - protein, 78 aa, Zea mays
  misc_feature: Ceres CLONE 1403856-F
MGFSLYPMKTSTRLLWSTSFFRHKPTLLLLASSEAGPTRGQSPSGGGPHVDCAVLATASSGVALGASLHASRLEFWLP

SEQ ID NO: 29279 - DNA, 872 bp, Zea mays
  misc_feature: Ceres CLONE 1403859-F
  misc_feature (66)..(66): n is a, c, t, g, unknown, or other
  misc_feature (101)..(101): n is a, c, t, g, unknown, or other
gccggccgaccctcccccccacgtaggtaacacagcggcgcgcccaaagctgcagctccccgcggnggcggccgcccaatcaataatcgaccccccgggcngcaggatttcacacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaaggtataggatagggagagatgaagcaatcaatttcttcgtccgccttcgccccctgcttacggccccgctactaaccctaggatcattctggcctctcctcgattcctatcccgactccttcttcgcttgtatgccccatcaggtaatgcagggtcgaactgccttcacgaagccttctcctactaagaactaagcggccagtaacccacactttgtttccaacgtcttaatcttggcctggaaaaaaatacacccctccccggggcccggtgggtttattacctcggcaaccgaactaaaggggcttggggatggaacacggagagggaacttgcggccggaaggcgggaatgcaacctaacaaaaaggcctccaaaaataaaaatggggcaaaaccccccgccgccaaaaggcattgctggggaaattcctggcccgcgctcgaattagatcgagcaaaccggaaaagggaggccggggggctagggcccccccctcggaaaaaggaccggacacgtcgacaatccggctggcc

SEQ ID NO: 29280 - DNA, 785 bp, Zea mays
  misc_feature: Ceres CLONE 1403861-F
  misc_feature (629)..(629): n is a, c, t, g, unknown, or other
  misc_feature (675)..(675): n is a, c, t, g, unknown, or other
atagctggagctccccgcggtggcggccgctcttttcactagtggatcccccgggctgcaggatttcgcacgagaccattacctagaacatcctaatccaaaaagaggctggcgcacctgcgtcactcgctccgcgctgccgcgatctcctctgacgtcgaagtcgcccgggggatgacacagggggaaggggtggtgtgggaggggtgaacaggagctcggtgacttttgtgaggggcgcctgatggaggagcgccggctcgacacgccggcgatgaggagaatcagcgagtggtatatacgttcctagcttctcctaccttccctcctgcgtctccttgctctacttttcattaattggcatgtcgctgctgctgtttcgcatttgattcgacgagttcgtgtccgtaaccggcgccgctgatagctttgttcagtccgattttgaactgaaaacaaacagctatcctcattaacctaaccaacacgtgacctgcgctttcagatcttcacggcttttacccgtttaaccgctcgatctagccaaaccctgccaataaagctttcgaggaatacgaaggcgggccccttttgcttcgcttgatttgttgcgaggatcctttcaccanaggtcccaacggattttaccctacctgatcgggggacgcgaccttntaactttgcacaaaactctcccgtgggccttcggagtggcgcgctcaccaaaggcagcgggtgggccggcgaatcaatgggcctccaaggtatcccaaaattaaaatatg

SEQ ID NO: 29281 - DNA, 670 bp, Zea mays
  misc_feature: Ceres CLONE 1403864-F
gctctagaactagtggatcccccgggctgcaggaattcgcacgagaccattacctagaacatcctaaaaaaaaaaataggccgcaccgcatttcgaaagggcacgccaccgccacctccacctcctcgaagccgccgcgaccgatcgagcggaacgtcccttcccgcggcgacggcgaaaccctagctcctcttacggcatgggccaccgtgtccctacatccgcaggggggtcttcttcaccgaaggccggggggggcccttggtttttggccccattcctccggtttcccggcaaatttttagagccgggttcgggacccagggggcagaggcaacttgtggaacatctccggggggggggggggggggggccccccccgggggggtccaaaatggcctcctgggccccccccccccccggggggggggggggtcacgccaatatcccaaaccctaggggtggggccaccccccccccccccccttatgggggggaaaggaaaaatggggttggggttctaaaggaagggcctcgtgccgttcccccgggggggagaaggggggggaaaaaaagaaataccccccggtgtttttcccccccccgcgggggggggaaaaaaccccgcccccggtggggggcaaaacacgcccagaagggatattcttcg

SEQ ID NO: 29282 - DNA, 726 bp, Zea mays
  misc_feature: Ceres CLONE 1403865-F
  misc_feature: Encodes the peptide sequence at SEQ ID NO. 29283
  misc_feature (425)..(425): n is a, c, t, g, unknown, or other
  misc_feature (547)..(547): n is a, c, t, g, unknown, or other
  misc_feature (552)..(552): n is a, c, t, g, unknown, or other
  misc_feature (634)..(634): n is a, c, t, g, unknown, or other
  misc_feature (684)..(684): n is a, c, t, g, unknown, or other
agagctggagctccccgcggtggcggccgctctataactagtggatcccccgggctgcaggaattcgcacgagaccattacctagaacatcctaatcgaaaaatgtgtttgtgactttgtgctcgtcctcatacccccaccccccagctcccgtctcctcgtgctctccactgctgcatgcgcctcttgtcctgtccccctccccaccttgttcctcccatcccgcgccgtctctgcacgaagcagagcgccggtccaccgacaaggacagctacaactacgacgcgcaggcagagccatcgctcatctggggctgccctcggttactcctcccctccgccgctgcccctgccttgtccacagctgttgttaattccttcatgagttggcgtcggcgccagcggggcggaggggaaggaggcggngcttcagcttccccggcgccggccgccgcctgaagatcccttcttctcctgtagtcctgtcgtcgggcgggcgaggtccaagcatcatggggctcttaggtatgatgggcgactcttttggntgctncgcgactggggagcgacttgtgtctgctgcaagagatggagacatccaggaggccagggctctcttagaaactcatccccgnctttgctcgtactccacgttcgggatccggaattcgctctccattactcngcagcaagggggcaccatgagattgtctccctcctaatcgaa

SEQ ID NO: 29283 - protein, 69 aa, Zea mays
  misc_feature: Ceres CLONE 1403865-F
  misc_feature (14)..(14): Xaa is any aa, unknown, or other
  misc_feature (58)..(58): Xaa is any aa, unknown, or other
MGLLGMMGDSFGCXATGERLVSAARDGDIQEARALLETHPRLCSYSTFGIRNSLSITXQQGGTMRLSPS

SEQ ID NO: 29284 - DNA, 738 bp, Zea mays
  misc_feature: Ceres CLONE 1403866-F
  misc_feature: Encodes the peptide sequence at SEQ ID NO. 29285
cagaagtggagctcaccgcggtggcggccgctctagaaataacgcatcccccgcgcgctgaagggatccctccgaaaccattacctacaatgtcctaatggattaattcatgtggacatgctctgcagagaagagttgagcaactccacctggctagctttcctctactccggtggacggaaaggaatcggcgaccgtttccgccttctaaaatcctactatgtcttacattccatccccgggtgctacatggccaacatcgggagctatgaaaggtacttgcatgtcgacaagatctaggacaacgtgaagcaggatttgtaatccggcgctgagaggtacctggtgcaaggctccctgctcaagcaatctgacatcgtatccaaatgcaatgatttctgccccatatagtaccttacatcactaaataaggtatacaaacttcggataaatgaaactgacattaagcagaccattctggttgaggcctctatcaccattactttatctcctgtgaactctgcaggaatgacataatataatggttgatgtttctatattggcagacctcaaaataacgatgactttctctgagctgaaactcctgctgctgttcaagttcgagaatctacattatatgaaactcagttagtcttacaagatcatagagagactcatcattgtttagcaggcaatggatctccagctacactacgagcagttgctactgcacttgca

SEQ ID NO: 29285 - protein, 60 aa, Zea mays
  misc_feature: Ceres CLONE 1403866-F
MLCREELSNSTWLAFLYSGGRKGIGDRFRLLKSYYVLHSIPGCYMANIGSYERYLHVDKI

SEQ ID NO: 29286 - DNA, 643 bp, Zea mays
  misc_feature: Ceres CLONE 1403870-F
  misc_feature: Encodes the peptide sequence at SEQ ID NO. 29287
  misc_feature (524)..(524): n is a, c, t, g, unknown, or other
aaagctggagctccccgcggtggcggccgctctagaactagtggatcccccgggctgcaggaattcgcacgagaccattacctagaacatcctaatcgaaaagtctttctccccttcctgctttccctctccagctctcatacacaaacacacggagctagcagcacggatcgagagaacaatggaggaaacaagcaggatccctgggtacttcaagaacaagggcatcctgatcacgggcgcaacaggcttccttggaaagatcctcgtggagaagatactgagggtccagccggacgtaaagaggatctacctccccgtgcgtgcgccggatgctgcatcagccaagaaacgggtggagactgaggtgatcgggaaggagctgtttgggcttctccgagagacgcacggcaagaggttccactccttcatcgaggagaaggtggtcccgttggccggcgacatcatccacgagaacctggggcggtgggaggggccccagcctgaggggggatgactccggnaggctcaaccgtcatccgacaatgggaggctggcccaaaaaaacttttttaacaagagagggaccaacgggggcccctccggaaatgaaaaaagttgggggggggggaggagaaaatta

SEQ ID NO: 29287 - protein, 111 aa, Zea mays
  misc_feature: Ceres CLONE 1403870-F
MEETSRIPGYFKNKGILITGATGFLGKILVEKILRVQPDVKRIYLPVRAPDAASAKKRVETEVIGKELFGLLRETHGKRFHSFIEEKVVPLAGDIIHENLGRWEGPQPEGG

SEQ ID NO: 29288 - DNA, 665 bp, Zea mays
  misc_feature: Ceres CLONE 1403881-F
  misc_feature: Encodes the peptide sequence at SEQ ID NO. 29289
aaagctggagctccccgcggtggcggccgctctagaactagtggatcccccgggctgcaggaattcgcacgagaccattacctagaacatcctaatcgaaaaccccaaataacaccaaggcaccaagcccagcgaggccaccagctgtccagctccacctcgtcgactcctccccgcacaagacaaaaaaaccctcgccttggagggtggaggcgcgtgagcccgacacccagagcgaaaaaagcaaggggtctgaccgccggcgatggcgtccatctccggagcggcggcggcgccatcttccgctgcgtgccggctgcggctgcgtaggcacatcctgctgcggccctcgcacctccgcctccgcgcgccccactccatcgccgacctctcccgctcctccagctcctctagttccgccccgacccgggcccagccgctgggctccaggccggagaacggcggcggcgtccgcgcggtggagaaggacccgatcaagctgtgggagcgctacgtcgagtggctctaccagcacaaggagctcggcctcttcgtcgacgtcagccggatggggttcacggaggacttcctgcgccagatggagccgcggatgcagcgggccttcgccgccatgcgggagctcgagaagggcgccatcgccaacc

SEQ ID NO: 29289 - protein, 133 aa, Zea mays
  misc_feature: Ceres CLONE 1403881-F
  misc_feature: SWISSPROT Homolog: EC 5.3.1.9 Glucose-6-phosphate isomerase
MASISGAAAAPSSAACRLRLRRHILLRPSHLRLRAPHSIADLSRSSSSSSSAPTRAQPLGSRPENGGGVRAVEKDPIKLWERYVEWLYQHKELGLFVDVSRMGFTEDFLRQMEPRMQRAFAAMRELEKGAIAN

SEQ ID NO: 29290 - DNA, 863 bp, Zea mays
  misc_feature: Ceres CLONE 1403882-F
  misc_feature (19)..(19): n is a, c, t, g, unknown, or other
  misc_feature (20)..(20): n is a, c, t, g, unknown, or other
  misc_feature (37)..(37): n is a, c, t, g, unknown, or other
ccccccttctctctcctcnntcgctttttttggggcncccacagagctggcgctccccgcggtggcggccgctctttaatagtggatcccccggggtggaggatttcgcacgagaccattacctagaacatcctaatcgaaaacacttcccagattggcttctccctcgccgtcatgtcctcacatgcaagccctgcgtgctccgtgaagcagtcgagaggaacggcccccggttgcattcatccggcccttggccctgcgccgaaccgcgttgtcgcggagcccgatctcgcgcgcccccttctcctcccgccggggtcgtcgcgattggctcctgatcccgcttggttgctctggctccgctacggccggatctgtcggggggccggggagctcctgagcacgggttcaggtctctagcatgtcgcgggctgtggcaagactaagaacgagcagggccccgctgccggcaggggcgaacctgcgtcttacatgcagcgaaccaccgtaccgcgtcaaggtagctggacccaccagcaaatggtattgaggaagcgccatcttctctacgcgtgaccgggaaaatctcgggagggtgggcgggtaactgtcgggcgtgggccccaatggacgagcggatgtgccgctctttaccgacaacgcagggggggccacaacagacaaaagtccaggacttcgggagaaaccttcggtttccaaggcatcctcggcaatgtgttggtgggtgcgctcggcccctcggccctaggcgactaccgtcgggcactcccggcatgggagtggattgcgcgcttacagacgcggcagaccggcggcactatgaggaggcggcggtctttcgg

SEQ ID NO: 29291 - DNA, 797 bp, Zea mays
  misc_feature: Ceres CLONE 1403884-F
  misc_feature: Encodes the peptide sequence at SEQ ID NO. 29292
  misc_feature (797)..(797): n is a, c, t, g, unknown, or other
aaagctggagctccccgcggtggcggccgctctataactagtggatcccccgggctgcaagaattcgcacgagaccattacctagaacatcctaatcgaaaaaccttctataatatcaggatcgacagcgccgacgcatcgagtggacctgtggcccatggacaagctccgcgtccaccggagcaccggcgacgcgatcgagtggtccccctctcccatcgtcgcgctcgccgactctccctgcgcctcccatgtcgccgccgcgcgtgaagacgggtcgctcgagctctggatcgcctccccggggtccgtcgggtggaacaaccagctcactatacaagcgaacgccgcgtccagggacacatctcatggtgtgcccggcgtgaaagtggactcacccggcggctgctctcgcacagcattgatgggtctcgagcccgaaggcgacctctttcacctggaaggaaaagaatgttctacacacgcgtcggaactccactctgggcaaaagttccttcgacccctttggcatgatggctaaagattgcgggaaaaataaaacctccagaatttcgctgtccatgggtcatacaaaacccaacagcgctcccacggcattcctcgagtttagaaacagtgggttgaggggaaaacacctctggaagattcaagaagtgtttttcccaccaccacgaccctccatattcagcgagaatgaattaccacccaacaaacctcttccaatggaaaaaatgcgatcaagaagaaaataataaaccccgccccaactcttgggn

SEQ ID NO: 29292 - protein, 127 aa, Zea mays
  misc_feature: Ceres CLONE 1403884-F
MDKLRVHRSTGDAIEWSPSPIVALADSPCASHVAAAREDGSLELWIASPGSVGWNNQLTIQANAASRDTSHGVPGVKVDSPGGCSRTALMGLEPEGDLFHLEGKECSTHASELHSGQKFLRPLWHDG

SEQ ID NO: 29293 - DNA, 730 bp, Zea mays
  misc_feature: Ceres CLONE 1403887-F
  misc_feature: Encodes the peptide sequence at SEQ ID NO. 29294
  misc_feature (512)..(512): n is a, c, t, g, unknown, or other
  misc_feature (536)..(536): n is a, c, t, g, unknown, or other
  misc_feature (537)..(537): n is a, c, t, g, unknown, or other
  misc_feature (591)..(591): n is a, c, t, g, unknown, or other
  misc_feature (632)..(632): n is a, c, t, g, unknown, or other
  misc_feature (643)..(643): n is a, c, t, g, unknown, or other
  misc_feature (693)..(693): n is a, c, t, g, unknown, or other
caaagctggagctccccgcggtggcggccgctctagaactagtggatcccccgggctgcaggaattcgcacgagaccattacctagaacatcctaatcaaaaaggaaaaggggacaaaccaccaacaacaaccagaatatcgcatcgccgtcgcgtcgtcgtcgatctccccgccccgccccgcccgcgccgcggaatctgacacatctccctaatctctcctaggaccgggtgcccttacatccacgccgcaacgcaaatcgccgtccgagccctcgcggtctctcgtctccccgtgcgagaggacgccggcagcagcggcgtgccagtgcggtggcttggtgggggaagaccggaggcggcggcagagctcgcgcccagaggtgcacggcaggcctgttctcggcgtcggctgggggaaggcgagtagccccgggaaggacgagtgaataatcatgagctcgatctgccctttcgcgggagccaccactggtggtggtgtatgccctgtngaatctgataagagcaacactggnngtgtgccctgcaaaatctgacaagagcatcagtggtgtatgccctgtcactggncaggatcatggtagcaagctcaaggaagtggtgatcatggntgagaaaaggncaccgatcctcgtgtcgtacccagcaaatgcccattcggctatgactccnacacttttcagctgggtccgcttagctgcattgtctg

SEQ ID NO: 29294 - protein, 33 aa, Zea mays
  misc_feature: Ceres CLONE 1403887-F
  misc_feature (28)..(28): Xaa is any aa, unknown, or other
MSSICPFAGATTGGGVCPVESDKSNTGXVPCKI

SEQ ID NO: 29295 - DNA, 634 bp, Zea mays
  misc_feature: Ceres CLONE 1403894-F
  misc_feature: Encodes the peptide sequence at SEQ ID NO. 29296
gctctagaactagtggatcccccgggctgcaggaattcgcacgagaccattacctagaacatcctaatcgaaaagtccttcttccttctctcacacactccactccacgtccccctccttcaaatcctttcaacacccaagcacaaggagagagaagccgccgccgccgccatggacaatattgaggtgaggaggaggaagaagaaagggagaagcagcggacgccgccaggggggacgggtacaggcggtcctgcgcgccggcctcgtcgccatggccttcgccctcctctgcctctgctcctccacgccctccgccattgccctcaccccagacggcgaggcgttgctggagctcaagctggccttcaacgccaccgtgcagcggctcacccagctggcggtccagcgaccccaacccctgggggctgggagggcatctcctggctccgtccctgacctcagggtccaatccataaacctcccattcatgcaggtcggggggatcatttcggccagcatcgggaggctcgaccagctgcagagactagctctgcaccagaacagcttgcacgggccaatcccctgcagagatcaagaactgcaccgagctcaggggcatttacctgagagcg

SEQ ID NO: 29296 - protein, 154 aa, Zea mays
  misc_feature: Ceres CLONE 1403894-F
  misc_feature: SWISSPROT Homolog: EC 2.7.11.1 Non-specific serine/threonine protein kinase
MDNIEVRRRKKKGRSSGRRQGGRVQAVLRAGLVAMAFALLCLCSSTPSAIALTPDGEALLELKLAFNATVQRLTQLAVQRPQPLGAGRASPGSVPDLRVQSINLPFMQVGGIISASIGRLDQLQRLALHQNSLHGPIPCRDQELHRAQGHLPES

SEQ ID NO: 29297 - DNA, 758 bp, Zea mays
  misc_feature: Ceres CLONE 1403896-F
  misc_feature: Encodes the peptide sequence at SEQ ID NO. 29298
  misc_feature (692)..(692): n is a, c, t, g, unknown, or other
  misc_feature (701)..(701): n is a, c, t, g, unknown, or other
  misc_feature (713)..(713): n is a, c, t, g, unknown, or other
  misc_feature (737)..(737): n is a, c, t, g, unknown, or other
aaagctggagctccccgcggtggcggccgctctagaactagtggatcccccgggctgcaggaattcgcacgagaccattacctagaacatcctaatcgaaaaaagattattcctttcttctcagcgacaccgctcgataccttgcgatcccaagatggcatcgccgccgatacccacacagtaatcctctcctcgctcccctgtcccctctctccccgccgccgacgccgagcctactctgtccatttccggactcgccgtccctcgcgggccggttcggtccgagcctgcgccccagccgcgccgggatccgcgagagaaccgcttgccctccgtgctttgcgggcggtccggtgactggctttgagattcctgtgccggggggctcgtgagcgcaatggggctgtttgggtgaactagggcttgcttctgtgaagtctgtgagggtgagctgagctgtgggagggaggatgcaggggaaggcacagctctctgattccaaccggcggatcatggagctcgacgcgccgccacggcgggtgtaccaggcgtggaacggcagcaacttatttttccttggtgggagacttatctttggcccagatgtgaggtcactcgtgctcacagtatgtttgattgtagtcccagtgatcttctttgctgccaccgtttgtccacaacttggtcatgangtccacagnccaaatggaggntgggtggcatctgtggctgtcatncttacagcatatattcttatt

SEQ ID NO: 29298 - protein, 96 aa, Zea mays
  misc_feature: Ceres CLONE 1403896-F
  misc_feature (74)..(74): Xaa is any aa, unknown, or other
  misc_feature (77)..(77): Xaa is any aa, unknown, or other
  misc_feature (89)..(89): Xaa is any aa, unknown, or other
MQGKAQLSDSNRRIMELDAPPRRVYQAWNGSNLFFLGGRLIFGPDVRSLVLTVCLIVVPVIFFAATVCPQLGHXVHXPNGGWVASVAVXLTAYILI

SEQ ID NO: 29299 - DNA, 749 bp, Zea mays
  misc_feature: Ceres CLONE 1403899-F
  misc_feature: Encodes the peptide sequence at SEQ ID NO. 29300
aaagctggagctccccgcggtggcggccgctctagaactagtggatcccccgggctgcaggaattcgcacgagaccattacctagaacatcctaatcgaaaactgcctctttacaccttcctctaccgactgccatctagtctctcctttgtctgaagcaagagaccccccctcgatgcgatgatggacatggccgacagagcgtctacgacccgcacgcagcactcctgagcccgcgctcccagctggcggagtctgtctcctgctactgcggatccgacactgaccttatccctgttgtcgaggacatgacactccagccctgacgccgagcatggagctggtgctggaagagatcctcacccgcaacaagtcacaccgagtcacctcgacgagagggtgcggactcaacgaccatacttacctggccttcttcatgatcttggtgtcgacggccacatacgaggacctgcagtcgaacatcccgaacatcggctgcggtgaccgctctgccatcctgttttggcagccaatcaccgatactctctgcagctccaaatcgtacggcgacaagaatgagctcatgtccatatcaaggaccatctcaaccacatacccttgtttgactgtcatccaatccacctcatgaaccagtcactcgcctgagatgcacaagagtatatctatccattgcctgttcgtcagagccgatatcaatacaccctatctgctcttgtttgagcgccata

SEQ ID NO: 29300 - protein, 104 aa, Zea mays
  misc_feature: Ceres CLONE 1403899-F
MELVLEEILTRNKSHRVTSTRGCGLNDHTYLAFFMILVSTATYEDLQSNIPNIGCGDRSAILFWQPITDTLCSSKSYGDKNELMSISRTISTTYPCLTVIQSTS

SEQ ID NO: 29301 - DNA, 826 bp, Zea mays
  misc_feature: Ceres CLONE 1403899-R
  misc_feature (9)..(9): n is a, c, t, g, unknown, or other
  misc_feature (10)..(10): n is a, c, t, g, unknown, or other
ttttttttnncccgattgggtaccgggccccccctcgaggtcgacggtatcgataagctttttttttttttttcttatttgcttcaactgatcggttcaagcataagcagcctaactggcagcacgtttctctaaaatccaaagttaacaaatagtatttatgttttcacgggcattctacgtctgcgacacgcagcagatgattccacagtctaattaagcgcgcctagacactgacacgcctcgccgccctgccacttgtgtctagtcagaccagaccggagcctgccagcgtccatgggcagcacggggctcaagtggctggacacgaccccggtagtccaagaaactccaatgaatgggcgggtactttacaacaaccggggccaccttgttcttggttgaatgaacccccccccggaaaaaaagccgaaaccccattgaaccccccttcaaaagggggccccgggcccggaaccccccccgggaatctttcccaacgcggggccccccaatttggaaaagacccttttcgggggccccccacactggggcctttttgtttccccttgttttcccccccccccctttttttaaaacccccccccccctccccaatttttttttaagagggtttttttcccccccttttaccaccccccttttttttctcccggttcaacaaaaggggggttgttctccccacccccttttggccccctttggggggggaagccccccccccctttttataacaccccaaagaggggggccccccccggaaaaccccccctttggttgggggagaaccccccccccccaaaga

SEQ ID NO: 29302 - DNA, 736 bp, Zea mays
  misc_feature: Ceres CLONE 1403909-F
  misc_feature: Encodes the peptide sequence at SEQ ID NO. 29303
  misc_feature (5)..(5): n is a, c, t, g, unknown, or other
  misc_feature (7)..(7): n is a, c, t, g, unknown, or other
  misc_feature (29)..(29): n is a, c, t, g, unknown, or other
  misc_feature (30)..(30): n is a, c, t, g, unknown, or other
ggggncncaccctcacaggccacgggggnncgccccccggggggggggcagagctggagctccccgcggtggcggccgctctagaactagtggatcccccgggctgcaggaattcgcacgagaccattacctagaacatcctaatcgaaaaaccttgtctacaagggttttccgctgtcttatcccttcgtccacgctccctgcagccgccgcccaaaccctagcaacccgtcctccgccatggccgacgaccactactcctctaagaggaagtacgacgacccctcgccgccgccgcggggcacggggttctcttcgggcccgccgcctgcctcgccgctcgcgggcggcgccccgtcgtacaacagcgtgccaccgccccccgatggagatccagctcgcgaagcagcgcgcgcaggagatcgcggcgcggatctttaacgccgcagagggcaagcgtcctcgcgtcgaccacggcgacgatgacagcggcggcttcggcgtagggctgggcagcactggtggcggtggccgcatcggcggcggaggactcggcttctcatcctctgccggtggcgggcaccgggacttctatcccaccattatcttctcagagcagcgcacctcagtactcctcttatgggggaaatcaggggacaagcaaaaagattgaaattccaagtgggaaggggtgggggtattgattgggaaaagccgggggaaactattagggatg

SEQ ID NO: 29303 - protein, 95 aa, Zea mays
  misc_feature: Ceres CLONE 1403909-F
MEIQLAKQRAQEIAARIFNAAEGKRPRVDHGDDDSGGFGVGLGSTGGGGRIGGGGLGFSSSAGGGHRDFYPTIIFSEQRTSVLLLWGKSGDKQKD

SEQ ID NO: 29304 - DNA, 764 bp, Zea mays
  misc_feature: Ceres CLONE 1403911-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
nnnnnnnnnnnnnnnnnnnnnnnnnnnnttcaatcctttccccgcttccgtccccacagctggagctccccgcggtggcggccgctctagaactagtggatcccccgggctgcaggaattcgagacgagaccattacctagaacatcctaatcgaaaaatgtctacttgtctaccgtcgctgcgctagccctcctccctgcttcttgcttttgcctgagcctgcagcctgctgcaagcttttgctttggtttaggtgcttcttttccacccctttactgttccccccacttttgcttgctttgtcacgcacacgaaaagctcctgcctttaccttatctccgcacccgtagtgggatttggtgggagctgcgctgctcgcccctcgcgtttctttgctcaattggggggtcacggtcacggcccgcgggtgctgcgcgtgctcgtgggcgggcggaattcggggttcttgcgcggacccggtcccctcggcgattgcggacgctctctgcagatcttcgcgtaaactccgggagggcggcgggagatgaactgcggggcgcccgaccagtctgccgccggggggcgggggccgccgtggttcctcaaccggagactgggaccagtgtatgggcgtgcgaccaaggtcgacccggggggtcggcgggagggggctccccccgcggggggccaaactgggacggccggccgccggcgggtaacgggcggacccgggcctccacacggggaaacccctcccccagcg

SEQ ID NO: 29305 - DNA, 657 bp, Zea mays
  misc_feature: Ceres CLONE 1403914-F
  misc_feature: Encodes the peptide sequence at SEQ ID NO. 29306
  misc_feature (370)..(370): n is a, c, t, g, unknown, or other
aaagctggagctccccgcggtggcggccgctctagaactagtggatcccccgggctgcaggaattcgcacgagaccattacctagaacatcctaatcgaaaaagtaatacggcacgccgttcaatctaccgggacggcgagacggagaatagaagacgtcagcactcagcagttcagcactgacccgtcggccgtcgccctcccggctcgcaaccgcatctctctcggcttctggcctcttcctagttcctaactaccaccgccacctctaccactggcctcaatctgcaaaccctagccctcgtcgccggcggccatgggccgaagaccggtccgacggacaagggcaagctacttttcagggcccggnacccggggatttttcccaaaccgggactttggggggaaatccccccccgggaaaattggggaactggagttcgggggggtcccttttaccggaaccccttttgggcgcccgggtttgggcccccccccccccggggagccgggccccttccccctcctttggggggaaaaaaaggaaaaaaattggccccccccccccccccggtggggggggggggtggggcccccacaaaaaaaagggggataatccgggggaaagggggggggcccccccccccccccccccgg

SEQ ID NO: 29306 - protein, 99 aa, Zea mays
  misc_feature: Ceres CLONE 1403914-F
MGRRPVRRTRASYFSGPGTRGFFPNRDFGGKSPPGKIGELEFGGVPFTGTPFGRPGLGPPPPGEPGPFPLLWGEKKEKNWPPPPPRWGGGVGPPQKKGG

SEQ ID NO: 29307 - DNA, 751 bp, Zea mays
  misc_feature: Ceres CLONE 1403915-F
  misc_feature (399)..(399): n is a, c, t, g, unknown, or other
  misc_feature (427)..(427): n is a, c, t, g, unknown, or other
  misc_feature (448)..(448): n is a, c, t, g, unknown, or other
agagctggagctccccgcggtggcggccgctctagaactagtggatcccccgggctgcaggaattcgcacgagaccattacctagaacatcctaatcgaaaagtcatagagagccacaggccacaggcaagacaggcaggaggatcggacgagtcggcgaggaagctgcctgcttttcagatagagttattaagatggcgttgcttcggctgcttgccctgatctccctgctcttcgcagtggccactcctgtcagggacatcgcccacgatgcctgctcgtcagaagtgaaggatttccagcacctgaacaacagctcggggctccacctgacgctgcaccacccgcagagcccctgctccccggcgccgctgcccgccgacctccccttctccgcgntgctcgcccacgacggcgcgcgcatcgngtcgctcgccgcgcgcctcgncagacgccgtcctctcggcccacctttgctgacgagagccgggcggggtcgtcgtcgtcgtcccccgatgaccagtccctcccggtcgtgcccggtcgcccagggacgtccgtcgggggggggaactacgtcaccccgatggccctcggcacgccggcaagttgaacgtatgggcggggacccgggtccccccctcccggggtcaagggccccccctggggggggggggccccccccaaccggcccgggtttaaccccaaggggccacctccacccccccgggcgggccccccaaaaaaggca

SEQ ID NO: 29308 - DNA, 746 bp, Zea mays
  misc_feature: Ceres CLONE 1403919-F
  misc_feature: Encodes the peptide sequence at SEQ ID NO. 29309
atagctggagctccccgcggtggcggccgctctataactagtggatcccccgggctgcaggaattcgcacgagaccattacctagaacatcctaatcgaaaaattccgcaccacgcccagtcgcccacgcagccggcccaagcccaaaaacctttctccatcctctactctcatccccacgatggccgccgccgccaccacgccgcactccctcctcctccagcgcgccgcgatcccggccgcgccgtcgagggcgtccgccgccgccgtctcccgtccgcctcccggaccgcggcggcaggatctcgtgcgcgggggtgggggcgccgtccccggacgcagccgccgcggagaacgaggaggagcgcggcgtctactacttcgcggcgaggcccgcgacgctccctctctccgtgctcaagcgtccgcaggaggatctgatggactaccacatctccgggatgagcatcatggagatgagacaccgcgtgaaggagttcgactgcgacatcattaatgccgagtactacctgcacgcgctgctcgaggaagcctgacacccacagagagctcttgctccagggcgaaaccaccacggagagcgacgaccgtcccgttaaacttttgaaccgggccactcggaaccggacgaactccccgggtccggattctagaattcacaaggctttcaggtaggcaagaaaggtctccggccggctgcctacccctgattcggtaaagaaaaa

SEQ ID NO: 29309 - protein, 38 aa, Zea mays
  misc_feature: Ceres CLONE 1403919-F
  misc_feature: SWISSPROT Homolog: EC 2.6.1.52 Phosphoserine transaminase
MDYHISGMSIMEMRHRVKEFDCDIINAEYYLHALLEEA

SEQ ID NO: 29310 - DNA, 669 bp, Zea mays
  misc_feature: Ceres CLONE 1403925-F
  misc_feature: Encodes the peptide sequence at SEQ ID NO. 29311
aaagctggagctccccgcggtggcggccgctctagaactagtggatcccccgggctgcaggaattcgcacgagaccattacctagaacatcctaatcgaaaactctcgatcggtttgcctggtctcgttctccctctcccgtatctgagtctgtttatggcggcggcggcgtccgcggatggaaatgcagcaggaggagcgagggcattgcccggccccatcgccgtcgcgccgtcgccgtcgccgcgctgcaggtagaggaggacggcgccggccagcatgggcgggtacgagctcgtcaggagcgacgacgcggcgggcgccgcgtgagccgacctcgagtccggctccggcgtcagcaaggtcgccggcgccccgacgccctcgcagatcccgtcggcgtcgcccgccgcgcggcagcagcgtctcgtctcgctcgacgccttctgcggcataaccgtcctgcttatgatcatcgttgacgacgctggagtcttcctgacggcgatgaaccactctccctgggacgacgtctcagtaggtgatcttctcatgccgatcatccttttcatagaagactgctcactattactatggaactggtgactgcaggatatcgggtcggggactaggaaggcattgttatctggccctcaagctgataattcg

SEQ ID NO: 29311 - protein, 45 aa, Zea mays
  misc_feature: Ceres CLONE 1403925-F
MIIVDDAGVFLTAMNHSPWDDVSVGDLLMPIILFIEDCSLLLWNW

SEQ ID NO: 29312 - DNA, 657 bp, Zea mays
  misc_feature: Ceres CLONE 1403928-F
  misc_feature: Encodes the peptide sequence at SEQ ID NO. 29313
  misc_feature (27)..(27): n is a, c, t, g, unknown, or other
  misc_feature (403)..(403): n is a, c, t, g, unknown, or other
aaagctggagctccccgcggtggcggncgctctataactagtggatcccccgggctgcaggaattcgcacgaacccattacctagaacatcctaatcaaaaaaaaaaacatcactccctcgcgaaccccaagaactgcagcgacggcaatggcgatggcggcggagggcgcggcgagcgagccagagctggtgtcgatcccggagacgccgcacggtctgtcgacgccggagggcgcggccacaccgaccggagcgggcgggggcggcggcggcaggagcaagggctccgggaccccagggcgtcacgtggaggagggcctgcccgcgtacctggacgacgagggccacctcacgcgcctcgacccgcgcgacgcctggctgcccgtcaccgagagccgcggngggcaaggcccgctaggcccattccctccctcagggcgaccccgcttcaagaattcctctccggtccccttccggacctcggtcgagcgggggaacactcccttgcccatgggttattccgggaacctgcacccccgggggaaccccaagggagcctccatgggggggtggcccgggaagcggtttctccccccagattgggtcgaaggtggcccaacggccgggagttttgggaaaaaaaaagagggggaaag

SEQ ID NO: 29313 - protein, 169 aa, Zea mays
  misc_feature: Ceres CLONE 1403928-F
MAMAAEGAASEPELVSIPETPHGLSTPEGAATPTGAGGGGGGRSKGSGTPGRHVEEGLPAYLDDEGHLTRLDPRDAWLPVTESRGGQGPLGPFPPSGRPRFKNSSPVPFRTSVERGNTPLPMGYSGNLHPRGNPKGASMGGWPGKRFLPPDWVEGGPTAGSFGKKKEGE

SEQ ID NO: 29314 - DNA, 753 bp, Zea mays
  misc_feature: Ceres CLONE 1403929-F
  misc_feature: Encodes the peptide sequence at SEQ ID NO. 29315
aaagctggagctccccgcggtggcggccgctctataactagtggatcccccgggctgcaggaattcgcacgagaccattacctagaacatcctaatcgaaaaagcagagggccatcttctactcttctctcccagccaacccccttgtccaacggttcagcctgctcaattttagtgaccagttacggcaaatgcagccctcggcggacagcaggaagaagaagcggcggcggcggaggaggaggaggctggcggcatgctactcatcgagacctgctgccggcgccgctcaaggccagtgtcagtgcggctcctctagccccggtggcggcggcggaagcggcagcctcgtggcaagaacaccgcgcgcgttctcgagctgctccagctacgccgcctcgtctgcctgcgcgccggcggcggccgtccatctcggcacccagcacaagctgacggcgctcctcgtcgcgctcgcgctcctcctcgtcctccctcgccctcctctcgtggaaggggtcccggtggtgtcgccccgcatgatggcgaggatccgcagccacgtggagaggatcaacatgacccccgtgcgctccattgagagccaggacggcgacaccatcgactgcgtggaggcgcacgagcagcacggtctggaccacccgctcctcaggacgcacgccgaccagacggagccgcccgaagcgcccaggggcggcgtcacgctctcctttccggtgactctgccacgagagg

SEQ ID NO: 29315 - protein, 187 aa, Zea mays
  misc_feature: Ceres CLONE 1403929-F
MQPSADSRKKKRRRRRRRRLAACYSSRPAAGAAQGQCQCGSSSPGGGGGSGSLVARTPRAFSSCSSYAASSACAPAAAVHLGTQHKLTALLVALALLLVLPRPPLVEGVPVVSPRMMARIRSHVERINMTPVRSIESQDGDTIDCVEAHEQHGLDHPLLRTHADQTEPPEAPRGGVTLSFPVTLPRE

SEQ ID NO: 29316 - DNA, 675 bp, Zea mays
  misc_feature: Ceres CLONE 1403930-F
  misc_feature: Encodes the peptide sequence at SEQ ID NO. 29317
  misc_feature (464)..(464): n is a, c, t, g, unknown, or other
  misc_feature (465)..(465): n is a, c, t, g, unknown, or other
caaagctggagctccccgcggtggcggccgctctagaactagtggatcccccgggctgcaggaattcgcacgagaccattacctagaacatcctaatcgaaaagggaaaaaggctcccaacctgttccgagccagccggccatggcgattagggctggccgctcgccccttctccacctcctcgccctcgccttcctcatcctcgccttcctcatcctcgccgcctctccctgcctccaagctcgagtggaccatcacaaacagatatctcactggactgggcaacccaactttgacctgcagaatgtctcatcgggtcgaaaggatggccctcatctcctgggtagatcaaaggaaataacacacatgaaattaaggagagttgctgtaaggaagaaaatggaagtagtgcagcaggatgatgaagcgttagttaaacttgagaatgcaggtatcgaacgttnncaaagctgtgactctgctgtgctgggaaaatacagcatcctgggggccgtggaaaatgaaaatgaaaagccgattccagggctcgtttgatgcaaaatccatgacctgggccaaaaaaatctgtttttgcaatcgggggaaagttgtcccttacaaaattgtttgaagttcaaggaaacccccgatcctttgggaaaaccggggtggggg

SEQ ID NO: 29317 - protein, 137 aa, Zea mays
  misc_feature: Ceres CLONE 1403930-F
  misc_feature (108)..(108): Xaa is any aa, unknown, or other
MAIRAGRSPLLHLLALAFLILAFLILAASPCLQARVDHHKQISHWTGQPNFDLQNVSSGRKDGPHLLGRSKEITHMKLRRVAVRKKMEVVQQDDEALVKLENAGIERXQSCDSAVLGKYSILGAVENENEKPIPGLV

SEQ ID NO: 29318 - DNA, 744 bp, Zea mays
  misc_feature: Ceres CLONE 1403937-F
  misc_feature: Translation starting site: 301
  misc_feature: Pfam Name: SAM_decarbox Pfam Description: Adenosylmethionine decarboxylase
  misc_feature: SWISSPROT Homolog: EC 4.1.1.50 Adenosylmethionine decarboxylase
  misc_feature (606)..(606): n is a, c, t, g, unknown, or other
  misc_feature (715)..(715): n is a, c, t, g, unknown, or other
  misc_feature (724)..(724): n is a, c, t, g, unknown, or other
  misc_feature (744)..(744): n is a, c, t, g, unknown, or other
aaagctggagctccccgcggtggcggccgctctagaactagtggatcccccgggctgcaggaattcgcacgagaccattacctagaacatcctaatcgaaaaagagcagccgacaactctctaccgtccgagaccccaagcaccagcgcggcggcggcggcggcggcgaccatggctgtcgggaagaacaagaggatctccaagggaaagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgcgaagaagttccagtctgctgcttactccaactgcgcaaagaagccatcctgatatcccttttggcttcctcgttctagtagtttaggatttcttttctgacacttcgattcttaccaatccccctggcctgctgctttcctgacaatcgaccagttccccagtcttgctccctgcagtcctccctcctccatctccagcgttgtngtctgactcacctgcaccaatggctgttctttctgctgctggtgctccccccggctcagctatcgggtttgagggctatgagaagcgccttgagatcacattctctgangcacctgtnctttgtgacccccatggcan

SEQ ID NO: 29319 - DNA, 701 bp, Zea mays
  misc_feature: Ceres CLONE 1403938-F
  misc_feature (13)..(13): n is a, c, t, g, unknown, or other
  misc_feature (16)..(16): n is a, c, t, g, unknown, or other
  misc_feature (18)..(18): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (41)..(41): n is a, c, t, g, unknown, or other
  misc_feature (45)..(45): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (112)..(112): n is a, c, t, g, unknown, or other
  misc_feature (286)..(286): n is a, c, t, g, unknown, or other
  misc_feature (293)..(293): n is a, c, t, g, unknown, or other
  misc_feature (394)..(394): n is a, c, t, g, unknown, or other
  misc_feature (401)..(401): n is a, c, t, g, unknown, or other
  misc_feature (443)..(443): n is a, c, t, g, unknown, or other
  misc_feature (445)..(445): n is a, c, t, g, unknown, or other
ggggggggggggnggngnggggnnnnngnnnngnngggggngggngggggggggggggnnnnnnggnnnnngnnnnnnnnnnnnnnnnnnnnnnnnnnnnnnccaaactggngctccccgcggtggcggccgctctagaactagtggatcccccgggctgcaggaattcgcacgagaccattacctagaacatcctaatcgaaaaacttctcgttctcgccgatccagtgccactacactacaatactgctgcgcgctagcggtagcgctcgcgctcccactcgcnacacagnacgccaccgctgctggcggctccctcccgcgctcgcattgcgatttgcgacctagcgcgagggtaccgggggtggtgcgcgtgctccgtgattcgggaaancgccccnagaatggcccggggcgaaaggcggcggttcccggcccaaaananaaagactttcacggcgcgaccccgtttaaggaccagctcccccgggggggttcctaatttggattacccaggccctccccccgggggccctgaaacccggtccttccttgggttcccaaaatttatctggggcatgggctggggaccccccggggaaacctaaccccatggggcctttggttccccaaagtgggggggggaaaccatggggggccaaaaggggggggggttttcccaaaaattttggtgtgtgtcc

SEQ ID NO: 29320 - DNA, 760 bp, Zea mays
  misc_feature: Ceres CLONE 1403940-F
  misc_feature: Encodes the peptide sequence at SEQ ID NO. 29321
  misc_feature (475)..(475): n is a, c, t, g, unknown, or other
  misc_feature (547)..(547): n is a, c, t, g, unknown, or other
aaagctggagctccccgcggtggcggccgctctagaactagtggatcccccgggctgcaggaattcgcacgagaccattacctagaacatcctaatcgaaaagtcggaagctcccttcatttctttcacctccgattcgattccttgtcccctcttgatccgagccgccaccaaaccctaactatctaaaacccccgtctcgctgtccgatggccgccgcctcgccgccgccctccccaccccacgcaaagcgccccaagatgtcctcctcctccgacccggaagccgatgctgagcccacctcggcctccgccgccgttgagggcgccgatcctgcgcagcgtcgtcccaggtacaagcgccgcaaggtcgccatccttctcgggtactgcggcgcggggtatcagggcatgcagaagaatccgggcgcgcgcaccatcgagggggacctcgaggaggcgctctacccagcggncgcccgtgcccgaggcgaacggtccgcgccgcgccggtacgattgggcacgtgctgcgcgcaccgacaaggncgtcagccccccggcgcaggtggtgtcccggggcttttacgtcgacccggcgggttttcattaatcgcttgaaaggcaaattccggcccgaaaatccggggctacgggtacggggccggttaccaactctttcaacgcgaaaagtttttggaaaccgccggaggacccggaattggcttcccaatttgctctttgacccggggaaacccgaac

SEQ ID NO: 29321 - protein, 133 aa, Zea mays
  misc_feature: Ceres CLONE 1403940-F
  misc_feature: SWISSPROT Homolog: EC 5.4.99.12 tRNA-pseudouridine synthase I
  misc_feature (89)..(89): Xaa is any aa, unknown, or other
  misc_feature (113)..(113): Xaa is any aa, unknown, or other
MAAASPPPSPPHAKRPKMSSSSDPEADAEPTSASAAVEGADPAQRRPRYKRRKVAILLGYCGAGYQGMQKNPGARTIEGDLEEALYPAXARARGERSAPRRYDWARAARTDKXVSPPAQVVSRGFYVDPAGFH

SEQ ID NO: 29322 - DNA, 675 bp, Zea mays
  misc_feature: Ceres CLONE 1403941-F
  misc_feature: Encodes the peptide sequence at SEQ ID NO. 29323
aaagctggagctccccgcggtggcggccgctctagaactagtggatcccccgggctgcaggaattcgcacgagaccattacctagaacatcctaatcgaaaaacacagcccagcgacagccagcaccggcggcatccagccatgtgcggggccgccatcctgtcggacatcatcccgccgccgccgccgcggcgtgtcacggcgacccacctctggcccgagagcaagaagccgacgacggctgcagccggcaggaggagagcccccgcggagcaagaacaggaggaggatttcgaggccgacttcaagcagtccgaggcggagtccggcgagtcggagctcgagtccgaggacgagcccaagcccaagcccttcggggccgccaggagcgcgctcgccagaggtggactaaacactggtgcagctgctgtcgatggccctgctgcaaattctggtaaaagcaataggaacaaccagttcaggggtatccgccggcgcccgtgaggcaaatgggctgctgagatcatagatcctcgcaagggcgtgcgcgtctgcctcggtacattcaactctcccgaagactctggcatagcttacgacgcctaggcacgcaggatccgcggtcacgaagcctaaaggcaactccccggatgaggatcctacggcggtctctcg

SEQ ID NO: 29323 - protein, 120 aa, Zea mays
  misc_feature: Ceres CLONE 1403941-F
MCGAAILSDIIPPPPPRRVTATHLWPESKKPTTAAAGRRRAPAEQEQEEDFEADFKQSEAESGESELESEDEPKPKPFGAARSALARGGLNTGAAAVDGPAANSGKSNRNNQFRGIRRRP

SEQ ID NO: 29324 - DNA, 609 bp, Zea mays
  misc_feature: Ceres CLONE 1403942-R
  misc_feature: Encodes the peptide sequence at SEQ ID NO. 29325
  misc_feature (76)..(76): n is a, c, t, g, unknown, or other
tattttaatatagggtggcggctaaataccctcgctttccgatgaacacatgatatattcagtcatacaaattganctactgcggtctaataacctaatagtcaccacaaccgagatatccccagtccaaaagggggagggtttcatgattattgacaacaaaatagtagtacaagagtcctcaattgcttccatgaatacccaactctaagcaatgaacaaacgatttttcaagtcacttggaaacagttttacacttttattcaaacaaaatttcccacgtttttaaaccccccgatttttgggaaaacccccccccaaaaaaaaaaaatttttcccgggggggccacccccccccccagggggggcttttgccctttttttttaaaaattggtggggccccccaaaaaaattttttttttaaaaaaaattggtgggggggcttttttcttcaaaaaaaaaaaaaaaaaaaattttttttccccccccctcctcttttaataaaaaaaaaaagggggcgccccccccccccatttttttaaccccccctctggtgtttttttttttatataaatgctttttttttttaaaataaagaaacccccccg

SEQ ID NO: 29325 - protein, 53 aa, Zea mays
  misc_feature: Ceres CLONE 1403942-R
  misc_feature (9)..(9): Xaa is any aa, unknown, or other
MIYSVIQIXLLRSNNLIVTTTEISPVQKGEGFMIIDNKIVVQESSIASMNTQL

SEQ ID NO: 29326 - DNA, 825 bp, Zea mays
  misc_feature: Ceres CLONE 1403942-R2
  misc_feature (1)..(1): n is a, c, t, g, unknown, or other
ntcgaattgggtaccgggccccccctcgaggtcgacggtatcgataagcttttttttttttttttttggcggctcgcccgggcataaaaataaccctcagctttccagatgaacacatgagtatattcagtcatacaaattgatgctactgcggtctaataaccataatagtcaccacaaccgagatatccccagtccaaaaggtggagggtttcatgattattgacaacaaaatagtagtacaagagtcctcaattgcttccatgaatacccaattctaagcaatgaacaaacgaatatccagtcactggaacagtttacacttaatcgacgacttccacgtctaaccaccgattgagaaccaacaaaaaaaattcagtgcagcaccaaggctgcaatagaatggtcaaatatgaactggctgcagatgagttcgctcatagaggcacaatacctgatcagctacagcccacattatagcctgtccaggtgggatcctcatgagccggggaagcaagcctttccacagggctcgcagcccctcttcggcatatattattcgtatcgcatggaccatgactttgtacttggcgtcaccagttcgcccttgggccatcagcctagtcttcacgacatcgaagggtccggtgcagacagggcctgctgttcctgcaaggaacccagagaatattgactgccacagcaggagcaccttcccgtccccttcatgcttcttccacagaacaatatcaaacatgttcttggctgagaacatgccgcctggtttgtgccgttgcgcatgacggttggtagtgctccagaccg

SEQ ID NO: 29327 - DNA, 684 bp, Zea mays
  misc_feature: Ceres CLONE 1403947-F
  misc_feature: Encodes the peptide sequence at SEQ ID NO. 29328
  misc_feature (684)..(684): n is a, c, t, g, unknown, or other
agagctggagctccccgcggtggcggccgctctagaactagtggatcccccgggctgcaggaattcgcacgagaccattacctagaacatcctaatcgaaaaacggtctggttcttgttcctgagcagttgagctgcgcacaccgacttcttttgcacaaggtacagcagcgcaggcgcggcggcagcccgccgctggatctctcccgaggctccggcgatggagcggtcctgctacttcccgctgcggtgggagagcacgggcgaccagtggtggtacgcgtcgccgatagactgggcggcggccgacggccactacgacatcgtccgccagctgctgcacctcgaccccaacctgctcatcaagctcacctccctccgccggatccgccgcctcgaggcgctgtgggacgacgacgcccgcttcgccgacgcgggcgggaaccgcgcgtccgtcgcccgcagcctgctgctggagtgcgagtgcaaggaacaccgccccggcggccggggagaacacgctggctccgggccgggtaccgggggtgggtggctctacgcgggcggggttcgccggggaaccccccgttcctggggggacctgctggaaaaggaacccgttgttgctccaaccaccccagggcccccgaaggggtccaacgaagttggccgaaaacggaaaacn

SEQ ID NO: 29328 - protein, 155 aa, Zea mays
  misc_feature: Ceres CLONE 1403947-F
MERSCYFPLRWESTGDQWWYASPIDWAAADGHYDIVRQLLHLDPNLLIKLTSLRRIRRLEALWDDDARFADAGGNRASVARSLLLECECKEHRPGGRGEHAGSGPGTGGGWLYAGGVRRGTPRSWGDLLEKEPVVAPTTPGPPKGSNEVGRKRKT

SEQ ID NO: 29329 - DNA, 835 bp, Zea mays
  misc_feature: Ceres CLONE 1403952-F
  misc_feature: Encodes the peptide sequence at SEQ ID NO. 29330
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (25)..(25): n is a, c, t, g, unknown, or other
  misc_feature (30)..(30): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (46)..(46): n is a, c, t, g, unknown, or other
  misc_feature (47)..(47): n is a, c, t, g, unknown, or other
  misc_feature (50)..(50): n is a, c, t, g, unknown, or other
  misc_feature (550)..(550): n is a, c, t, g, unknown, or other
nnnccccccccnnnnnncnnnncnnccccncccccnnnntgggggnntgnacaaactggaactccccgcggtggcggccgctctagaactagtggatcccccgggctgcaggaattcgcacgagaccattacctagaacatcctaatcgaaaaaaaaggtacacatcatctcttccaaatcccaccagcaaatccccaattcctccgagttcgagcgaccatgtcggggcgtggcaagggcgggaagggtctgggcaaaggcggcgccaagcgtcaccgcaaggttctccgcgacaacatccagggcatcacgaagccggcgatccggaggctggcgaggagggccggcgtgaagcgcatctccgggctcatctacaaggagacccggcggggtgctcaagatctttcctcgagaacgtcatccggggaggggggggacctacaccggagcacgcccggccgcaaagacccgtcaccggccgatggaccgtcgttccaacgcccctcaagggggccagggggccgcaaccccctctaccggaatttccgncgcggctggaaaaagggagcctaaccggcccggctttggtgggcccggggggcaaaaaaggtcttttgggggcccgcggggtcccagaaaaactttcgaggaaggatatttcttgggaatggaccgggggccttaaaggtttccgcgaaaggaattttatttaatcccccttaggggggctttaatttaaattaaggcgggtcttcgttttggcggtttccaaacccactctcttagaggccgcacttgtggcgaaaaaggggaagaaaatggggggtccccccc

SEQ ID NO: 29330 - protein, 117 aa, Zea mays
  misc_feature: Ceres CLONE 1403952-F
MSGRGKGGKGLGKGGAKRHRKVLRDNIQGITKPAIRRLARRAGVKRISGLIYKETRRGAQDLSSRTSSGEGGDLHRSTPGRKDPSPADGPSFQRPSRGPGGRNPLYRNFRRGWKKGA

SEQ ID NO: 29331 - DNA, 657 bp, Zea mays
  misc_feature: Ceres CLONE 1403953-F
  misc_feature: Encodes the peptide sequence at SEQ ID NO. 29332
gctctagaactagtggatcccccgggctgcaggaattcgcacgagaccattacctagaacatcctaatcgaaaagcaaggatggttttcagcaactagtttctgaacagcgtgtccgctgtctggtctgtcaaaataatcttggtaaccagtgccaaaatgattgctgggggaggctattttgatggttctcatgaccatattctcatggaaggatcaatgatccatgattcttcacaatcttccatctatgacaatacagatgttgaacagcagaacttcagatttgcgccctttatcataaaagatcactccaatcccagccaaccttaccctctgaggctgcaggggtgatagaccaaattcaacaccagctggggattgacatcgagcaggaccatagtgatcacatggatgaagaagttccctcagcagaaactggaaaatttggtcctgctggctatggtgtttcagatcatatccttagccaccagatagagggtccgcataacataactggggaacaacaggccctgggctatgaccctgcatcatatcgaaatggcacttatgcagctggacatgatcttctaattctcaacctatcccaaggggcagtttgattcctgaatttccttccccaaaaaatatttttaag

SEQ ID NO: 29332 - protein, 64 aa, Zea mays
  misc_feature: Ceres CLONE 1403953-F
MIAGGGYFDGSHDHILMEGSMIHDSSQSSIYDNTDVEQQNFRFAPFIIKDHSNPSQPYPLRLQG

SEQ ID NO: 29333 - DNA, 677 bp, Zea mays
  misc_feature: Ceres CLONE 1403954-F
  misc_feature: Encodes the peptide sequence at SEQ ID NO. 29334
aagctggagctccccgcggtggcggccgctctagaactagtggatcccccgggctgcaggaattcgcacgagaccattacctagaacatcctaatcgaaaactttctcctccagcaagtaaaccccgtttccacaacgtcaccgcaccgccgtcatgccgaccgtaagcgtgaaatggcagaaggagctctttccaggcatagagattgacactagccagcctccgattgttttcaagactcagttgtacacactaactggtgtgccacctgaacgccaaaaaattatggtgaagggaggaatattgaaggacgatgccgattggtctactttgggagtgaaaaatggccaaaagttgatgatgataggcacggctgatgagattgtgaagcctccggagaaaggccagtgtttgttgaggatctaccagaagaagagcaagtgattggactgggtcacagtgttgggctttataaccttgggaatacatgctatatgattcccccattggaaagggttgctttttgtccaaaagttaaagccagggttgttaaattttttccaaaaccgggaaaaggaaatgggatttgaacccaactttcccaaaaattggaggggggggccaccccgcaaaaaccttttacggggatcttgggacaaaaggggttccccccccg

SEQ ID NO: 29334 - protein, 96 aa, Zea mays
  misc_feature: Ceres CLONE 1403954-F
  misc_feature: SWISSPROT Homolog: EC 3.1.2.15 Ubiquitin thiolesterase
MPTVSVKWQKELFPGIEIDTSQPPIVFKTQLYTLTGVPPERQKIMVKGGILKDDADWSTLGVKNGQKLMMIGTADEIVKPPEKGQCLLRIYQKKSK

SEQ ID NO: 29335 - DNA, 825 bp, Zea mays
  misc_feature: Ceres CLONE 1403959-F
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (39)..(39): n is a, c, t, g, unknown, or other
gggcccccccccccnnnccccccggcggggggggggatntggggttttggtcaaagctggcgctccaccgcggtggcggccgctctataactagtggatcccccgggctgcaggaattcgcacgagaccattacctagaacatcctaatcgaaaaatcggccaatcttgctctcgtctcctatgttcttcctcttagattctttcggcggcgcgccctcggtcgctctctccttcctgccttctgtctgtgggcggcccatgttggtggtgcccttcctggcctgcgaggtgcttccccgcgaaaaggttgctgagtgtggagagcccgctggtcacctggcgctcaacctgacgcgtttgtccggcagctagctcgggcgctgggtcgcggccggggaccggaagcggcgaggggggcggggccccggccgggggggggggggggttttcttgcggggtgggctccggccggggggggaggtggtcggcgggggcccggggtggggagggggccgggcgggggcgccggcgcgggtgccggggatggggcgcgttgcgcgccgggggggggggggtctggcggcccgggcggggggtcacggcggggggggggggggggtctagggttggcccccgtcgtgccctgggggggggcgatgcgtcttcccgtgggttgcgcggccccgggcgccgcaggggggtaggtttgtgcgccgggttggtagcgcacccctttctcgtcctgcgccggtgtcggggggctccgcgtgctagggggggatgtggaaagtgtgccgaaaaggggggcgacgggccgcggcccc

SEQ ID NO: 29336 - DNA, 804 bp, Zea mays
  misc_feature: Ceres CLONE 1403960-F
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (46)..(46): n is a, c, t, g, unknown, or other
  misc_feature (47)..(47): n is a, c, t, g, unknown, or other
aggccccccccccccnnanaccccccccgccccannnngggggntnnttccagactggagctccaccgcggtggcggccgctctagaatagtggatcccccgggctgcaggaattcgcacgagaccattacctagaacatcctaatcgaaaaacactacaagactgctgcgcgctagcggtagtgctcgcgctcccactcgcaccacaggacgccaccgctgctgccggctcctccccgcgctcgcattgcgatttgcgacctatcgcgaggttaccggtggtggtgcgcgtgctccgtgatccgggaagcaccgccagatgcccgcggtcgaaggcggcggtgccgactctgaagcacgacgacttaacgccgcaccccgtcaaggaccaccatccctggggtctcctactggataaccggccctccccggggggctgaagccgtctactcttgggggtccaacatctatctggccatggctcgtaatcactgtggaacataccaactgtcacttgttcccacaaactgggaggcaaacaatgacggacaaagccgtggggtatcccaaacatttgatggcaccattgcaggggattcaccacccctccctgcagaagctttctttggggaaccatggttggcctggcgaaagaatccgtgggactccaaaacacctgtgtggggctggcctaacccaattttcgaataaatcgcttgggctggcgacgctaaaatgcttagattgaacaccctaaaccccaccaataatccaaaatattctcctcgcgcggattgtagtggg

SEQ ID NO: 29337 - DNA, 749 bp, Zea mays
  misc_feature: Ceres CLONE 1403967-F
  misc_feature: Encodes the peptide sequence at SEQ ID NO. 29338
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (35)..(35): n is a, c, t, g, unknown, or other
  misc_feature (44)..(44): n is a, c, t, g, unknown, or other
  misc_feature (45)..(45): n is a, c, t, g, unknown, or other
gtggccccccccccccnnnnngnggggggcccttntttgggggnnggccagagctggagctccccgcggtggcggccgctctagaactagtggatcccccgggctgcaggaattcgcacgagaccattacctagaacatcctaatcgaaaagcgattttaccgtggacgactggagagggcgacggggacgaacgagacgaccgtacattcgttatcggactgggaagcagcggcggtacaaagtgtgggagagaaaggagaagagacttgatgtcctcgcagtttgtccaatagatctcctcgccgcctcacccgtctcctcctccgcagcttccccgcgatcccgaccatggagggcgacggtaccaaccttgatgcggcgatagagtcgctcctgaatgtccagaagcacatgacgctgggcggaggtgggcgccggcactcggaaggccgtcatcgacatcgtcgagctctgctaccaggccggcgcgtggaagacgctaaacgaccagatcggtctcctatctaagaggagagggcagcttaagcaggctattactggctatggttccaaaagcaatggaggatattaatttgaccccgggcattgacacaagcatgggaggtaataaaaaccctgaggcgtggcctcttgctggcaaaaatctatgtgtgggataaacgagaggcaaggattgatccaaaagggcttggtaaaaattaaaaggagggagcgagggaacaggag

SEQ ID NO: 29338 - protein, 59 aa, Zea mays
  misc_feature: Ceres CLONE 1403967-F
MEGDGTNLDAAIESLLNVQKHMTLGGGGRRHSEGRHRHRRALLPGRRVEDAKRPDRSPI

SEQ ID NO: 29339 - DNA, 765 bp, Zea mays
  misc_feature: Ceres CLONE 1403968-F
  misc_feature (9)..(9): n is a, c, t, g, unknown, or other
  misc_feature (10)..(10): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (30)..(30): n is a, c, t, g, unknown, or other
  misc_feature (31)..(31): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
ttccccccnnccncnnnncnncccgttctnngggggcattagatccnnnnccaatactggagctccaccgcggtggcggccgctctagaactagtggatcccccgggctgcaggaattcgcacgagaccattacctagaacatcctaatcgaaaaaaacaggcacaggctccctcctccactgtccagtgtccactcctcgtcccgagaagcagacaaagcgcggcgctgcagatttcggtacggttcccaatgcctcccatgcccgccgtcgtcccgtgctagcacccggcgccgctcctccacctgccgcgtcgcgccgcctggatccggcgggcacgtggctaggagcctcagatccgggcgaaacccagccttccgtgcggacgtcttcactctacctccagactggcggctgccatttccccccctcttcttgctgttttttttggtggagatggggggtgaaatctgcggcggagtcttgccgtcgctcgctgtaaacgtagagctctctctctctcttggcgagtaatcctgggtcttgctccatttccgagatcagcgctgcccggcgagtggcaaggtctaccctgtacgacgccgcaaacaggtcccgagggacgtggccccgggagggcggcgcctcccgggggtcatcctgaaccttgcaagctaggggcggccggcataaaaggggaaacgacgggaggatcacggcagccgccccctcccggatatccccccccgcacgcagacacgccag

SEQ ID NO: 29340 - DNA, 713 bp, Zea mays
  misc_feature: Ceres CLONE 1403981-F
  misc_feature: Encodes the peptide sequence at SEQ ID NO. 29341
  misc_feature (713)..(713): n is a, c, t, g, unknown, or other
aaagctggagctccccgcggtggcggccgctctagaactagtggatcccccgggctgcaggaattcgcacgagaccattacctagaacatcctaatcaaaaaacaacaacaacaaccatctccaacgcagcaagcagacacagggacaggcaggcagcgagtgcaaccgcgagagcgatcagcgatgggctccttcttctcgaccttagtgacgccccctccgcccgccgccgacgacccgaactgcgccgtggtggccgcgcactccaaggccacctacgacgagcagtgggcggcccacaagagcagcagcaagctgatggtgatcgacttctcggcgtcctggtgcgggccctgccgcttcatcgagccggccttcaaggagctggcctcccgcttcaccgatgccatcttcatcaaggtcgacgtcgacgagctcgcggaggtcgcaaggacatggaaggtagaggcgatgccaacgttcgtgctggtcaggatggaaaaggaaggtaccctcctcctctctctcccaccactcccgcccgtaccctcaaaataacccttgtggggaccctctgagaagcgctctcgccgcagtctttcgacgcaccccgggccggggtggccggacctggtggtagtcggggtggtcccttcccaacaatctccctaccagacccgcctcacacccgggaaaacaacaagacgcttgn

SEQ ID NO: 29341 - protein, 124 aa, Zea mays
  misc_feature: Ceres CLONE 1403981-F
  misc_feature (23)..(115): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MGSFFSTLVTPPPPAADDPNCAVVAAHSKATYDEQWAAHKSSSKLMVIDFSASWCGPCRFIEPAFKELASRFTDAIFIKVDVDELAEVARTWKVEAMPTFVLVRMEKEGTLLLSLPPLPPVPSK

SEQ ID NO: 29342 - DNA, 846 bp, Zea mays
  misc_feature: Ceres CLONE 1403984-F
  misc_feature (39)..(39): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (308)..(308): n is a, c, t, g, unknown, or other
  misc_feature (309)..(309): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (379)..(379): n is a, c, t, g, unknown, or other
  misc_feature (380)..(380): n is a, c, t, g, unknown, or other
  misc_feature (398)..(398): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (418)..(418): n is a, c, t, g, unknown, or other
  misc_feature (432)..(432): n is a, c, t, g, unknown, or other
  misc_feature (436)..(436): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
ggggggccccccacccccccatgcgcgaataacggggtntggggcgnnnntcaggctggagctccccgcggtggcggccgctctagaatagtggatcccccgggctgcaggaattcgcacgagaccattacctagaacatcctaatcgaaaaacagtcacacggtctcgagctggatctgtaccgttcgtccgttgcagcagacaggagtgggcgctctctctctccctcgtggcgactactgggcgaccgctggcgctgcccttgtgccccggtctccgtcggaccggtcccccggtctgctggggnntctttggcgtcccccagcttcccccggcgttggtggtnnnaactccaaggttggcacatggggttgggcnncaagatttcccaccccangacagtccccctnnnncggnggggggcccccccngctncnnncgccccgggggtggggggcgttcgtctgaccgggacgaccaaaacaaatcccggtcccaacattaggtcccgttttttcttcttccaccaaagagtccgccccttgttggaggcaaaaaaaccacactgtcttccctgggacacatcgcctaaaagcgggaattggaaagaaagggtgcgccttttgggcccttgggggtgtagtgcctctttttgttcgcgaaggcgcgagcccccacgtggccggcctggcggcggttctgggcgtggccccccctttctctggcccgcgggcctcgcgcggtgaagagaggtgtcccttgggagaggtccgcgaaaaaaacggccccaagggtcttcaggggatgaacctgggggggcaccctggaggcttcccaccccctgg

SEQ ID NO: 29343 - DNA, 679 bp, Zea mays
  misc_feature: Ceres CLONE 1403987-F
  misc_feature: Encodes the peptide sequence at SEQ ID NO. 29344
agagctggagctccccgcggtggcggccgctctataactagtggatcccccgggctgcaggaattcgcacgagaccattacctagaacatcctaatcgaaaaggggtcgcgacctaaaagagggtggccagccatcccgcgcgagccacttcctctctcctccccatcgtatccatcgccaagaggatccgcaaggtgatcaatggtatctacccaattggaagcggacgaggggggaccgggcccgcccgaggtgccgcaggggaaggaaaagggagagcaggacggatcgctgacgaggcagcggggctggctcttctgtggccgagaggacttagagaaatggatgcagtcactgtccaaggaggaggcagccgtgcacgcgagcatgcgccggcaaacacagttctcgcgccgcgccgtgcgcaacctcatcgtactctccgacctcgacgagatgttagctgtcgcttatgccatcgtgacgacaagagatgaggatctatcttgtgaaatgagggcaacacgagagctacctatgttcattcttccaggtggagtctctgtaatatatccaacagctgttaacttcacaaggaggtgtgagcagaaagaccagaggacccttgaaaaagtgatgggtgagaagaaagcgaaattgatgatcttaaggaaacaa

SEQ ID NO: 29344 - protein, 159 aa, Zea mays
  misc_feature: Ceres CLONE 1403987-F
MVSTQLEADEGGPGPPEVPQGKEKGEQDGSLTRQRGWLFCGREDLEKWMQSLSKEEAAVHASMRRQTQFSRRAVRNLIVLSDLDEMLAVAYAIVTTRDEDLSCEMRATRELPMFILPGGVSVIYPTAVNFTRRCEQKDQRTLEKVMGEKKAKLMILRKQ

SEQ ID NO: 29345 - DNA, 624 bp, Zea mays
  misc_feature: Ceres CLONE 1403987-R
ccgggccccccctcgaggtcgacggtatcgataagcttttttttttttttttttagcaacgccaaatgaaaagtacggtttcaacatcataaggaaactgtgtacgaaatgctgtaaggtggtaatgtaacaaacaacaaagaaaagaccgaaggtcaagacaaacgcaaaaaattctacatgtcgctgttctctgaacaagcaatgatcttatattatatcctgcaccaccatcttgtctgaacgtcatatagctttttgtctcgcaggaagaagacttcgcgctctatatgacaacaaaaaatcatccactcaaggatgtacaccatgtcccatttcttgtttttgcgtgctatgcttccgacgatcatatcactcactatttccaatttacaacagtgctaaatctccacttgttgcttgtctgtctttccttcctcgggtagctcctgcaatgtcgtcaggttactcaattcagtctcttgtactgagctggaagtagataatccatcagccagaacaacaggggtcgaccggcctgagttggagcctgagtattgccccatggactgctttgatgtgtttaatgcatgacaatgtgggcagtagtaagtaacatgtggg

SEQ ID NO: 29346 - DNA, 788 bp, Zea mays
  misc_feature: Ceres CLONE 1403992-F
  misc_feature: Encodes the peptide sequence at SEQ ID NO. 29347
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
gggccccccccgnnnccgggggggggcggggggnnntcccgcggnntnnccagagctggagctccccgcggtggcggccgctctagaactagtggatcccccgggctgcaggaattcgcacgagaccattacctagaacatcctaatcgaaaagtctgtccgctacccctccccgaccagatcgctacgagacgccgcgcgatccgacccaggccgacgccgacgacccctctcgccgccgggggccatggcgtacggcgaccgcgtcaccaccttcgaggactccgagaaggagagcgagtacggctatgtccgcaaggtctctggacctgtggttgtggctgatggaatgggtggtggtgccatgtatgaacttgttcgccgcggacatggataacctcattggggaaatatccgtcttgagggggagggaggtgacatccgaggttatgagggaaaccgctggacggaggcccaaggaccctggtattgagaacaagaaagccctcctttcaggttgaattggggacctggaaattcttggaaaaccttttttggcgggcacccaaggggccctcaaaaaaacccatcggctattaaagggggggagatggggtaatattccctcggggggggttataaggttgcctggccctttgaccaaaaaaaggtattggcggggaaaattcccagccaaaccaaaccctatgggcgctggggcggacgggccttcccgcggggggggggggaacccaatgccggctagccggggttttggaacaacaccg

SEQ ID NO: 29347 - protein, 49 aa, Zea mays
  misc_feature: Ceres CLONE 1403992-F
  misc_feature: SWISSPROT Homolog: EC 3.6.3.14 H(+)-transporting two-sector ATPase
MAYGDRVTTFEDSEKESEYGYVRKVSGPVVVADGMGGGAMYELVRRGHG

SEQ ID NO: 29348 - DNA, 796 bp, Zea mays
  misc_feature: Ceres CLONE 1403994-F
  misc_feature: Encodes the peptide sequence at SEQ ID NO. 29349
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (23)..(23): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
ggccccccccnnnnnnnnnnanncccccccggccggcggcgtnnnnnnnccaaaactgggactccccgcggtggcggccgctctataactagtggatcccccgggctgcaggaattcgcacgagaccattacctagaacatcctaatcgaaaaatgacacattgcctccaagccacagtgccacctttcgattcatgcacgctcagacatgggcgccctccggagtttagccatctcctacccggagttcctcgtggacgggctgtgcttcgtctccctctcggccctgcgccacgcgatgcgtgagcggcggcaacgcgcccccctgagctggcctgtggagggcatgctcccgttcgtgctcgcgaacctcgggcgcctctacgacgccatcaccgacgccctccacgggtccggttgcacgctcatgttccgcgggccgtgggtcgcccgggcggacctcttgctgacgggtgaaccaggaggacgtccagctctggcggagggacccccccgctgggctctcacaggaggccgggaatttggcttagattgtgggagcacccgcggaagcgtgccggccgacctgctcccggtcccggggtcggggggggaggctcggcggagagcgaggacccggcagggtggccgggtcgcacacccgttccccccccctgtgggtacgcgaggatacccctcccggtctacgcgtccacacgcgcgaacgcggggtggcggcaactgggtcggggcagaggaaggcggctccctcgaggcaatcttgcgggagcgcacc

SEQ ID NO: 29349 - protein, 196 aa, Zea mays
  misc_feature: Ceres CLONE 1403994-F
MGALRSLAISYPEFLVDGLCFVSLSALRHAMRERRQRAPLSWPVEGMLPFVLANLGRLYDAITDALHGSGCTLMFRGPWVARADLLLTGEPGGRPALAEGPPRWALTGGREFGLDCGSTRGSVPADLLPVPGSGGEARRRARTRQGGRVAHPFPPPVGTRGYPSRSTRPHARTRGGGNWVGAEEGGSLEAILRERT

SEQ ID NO: 29350 - DNA, 654 bp, Zea mays
  misc_feature: Ceres CLONE 1404025-F
  misc_feature: Encodes the peptide sequence at SEQ ID NO. 29351
  misc_feature (654)..(654): n is a, c, t, g, unknown, or other
aagctggagctccccgcggtggcggccgctctagaactagtggatcccccgggctgcaggaattcgcacgagaccattacctagaacatcctaatcgaaaaagcgacaccgcgtggttcgttaggaaaggaaatcgatccccatctgatctcttcggtgctaaagaaatataggccgccgccgcctcctcattcggtgaaaggtgggcggttagggttgggagatctcttgactcacgacacgagcagcagaatttgtcgagggccgctggttgctgcgagaggtccgtaccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagccatcctgatatctctgtcgtcatccccatcctagtagcgtagaaaccacctgcattttcattttgatctccctaatccctccggctagctgctttccagtgaccaaaagatatcagagaccacttcccgtcttcctcccgtggcctgtctgtcatctggctctgaaacgatggcagtcctgcan

SEQ ID NO: 29351 - protein, 51 aa, Zea mays; identical to SEQ ID NO: 13325
  misc_feature: Ceres CLONE 1404025-F
  misc_feature (1)..(51): Pfam Name: AdoMetDC_leader Pfam Description: S-adenosyl-l-methionine decarboxylase leader peptide

SEQ ID NO: 29352 - DNA, 603 bp, Zea mays
  misc_feature: Ceres CLONE 1404026-F
  misc_feature (162)..(162): n is a, c, t, g, unknown, or other
  misc_feature (180)..(180): n is a, c, t, g, unknown, or other
  misc_feature (182)..(182): n is a, c, t, g, unknown, or other
  misc_feature (189)..(189): n is a, c, t, g, unknown, or other
  misc_feature (427)..(427): n is a, c, t, g, unknown, or other
  misc_feature (428)..(428): n is a, c, t, g, unknown, or other
  misc_feature (488)..(488): n is a, c, t, g, unknown, or other
  misc_feature (566)..(566): n is a, c, t, g, unknown, or other
aaagctggagctccaccgcggtggcggccgctctagaactagtggatcccccgggctgcaggaattcgcacgagaccattacctagaacatcctaatcgaaaactctcctcccctccccttccctaatcatctcagcgaatccaatcgaggcgatggaccangcaggggtggcgggcggngnaacgcgnaggttgccggccggggcctggggtcttgacggggggggggaaaaaaaaaaaatttggggggtccaaggggggggaagccccccacccccgcgtaacacccgggggggggggggggggaaaaagggcccccccccgggggggtgggggaggagagaaaaacacacgcccccccccccggaagggcccctttgggggggcccccttccccccccccccttttttttttgtggggcgcggnnggggggggaaaaaaaaaaaaaatttttttttccggggggggggggggggggggggggggnaaaccccacaaaaaaaaaaaaaaaaaaagagggggggggggcccttttttttttttttttttctctccggcccgccgnttttttacgggggggggagggggagaagttttttcct

SEQ ID NO: 29353 - DNA, 677 bp, Zea mays
  misc_feature: Ceres CLONE 1404040-F
  misc_feature: Encodes the peptide sequence at SEQ ID NO. 29354
  misc_feature (362)..(362): n is a, c, t, g, unknown, or other
  misc_feature (394)..(394): n is a, c, t, g, unknown, or other
  misc_feature (427)..(427): n is a, c, t, g, unknown, or other
  misc_feature (443)..(443): n is a, c, t, g, unknown, or other
tggagctccccgcggtggcggccgctctagaactagtggatcccccgggctgcaggaattcgcacgagaccattacctagaacatcctaatcgaaaatcctcccccctcaacaaccgcgagatcttcagctaccgctctctccggtcgcgtttgcatccgcattcctcagatccagattcgagccccagccccgcttcgagatccagctagctctctatcaagcatccggcggagcgagcagcgggaggctcggcaagagagaagatgaagcggaagacgcggaacaagatcatcgtatggacgctggtcctggctgcagtggcgattctggtgggtggcacgattgcgctggtgctcacgncgggacgtgggagggctagaaaagaagtcgcnagacgagatctgtaaacagggtgggagtgctcngggaacaagtactggntgcacgaccccatcaccgacttcctcaaggggtacaggtcgaaaacctctttgccaagggaaaaccccccgtcgggaacgccgttgggtttttggaaataccaggtcttataaccgggcggggccttttttaagaccagggggtttttgccccccccggggaaaaaaaaggaaaaggaggggaatcttggccctttcccggggaagggggggccaaaattttttgggggggggg

SEQ ID NO: 29354 - protein, 47 aa, Zea mays
  misc_feature: Ceres CLONE 1404040-F
  misc_feature (33)..(33): Xaa is any aa, unknown, or other
MKRKTRNKIIVWTLVLAAVAILVGGTIALVLTXGRGRARKEVARRDL

SEQ ID NO: 29355 - DNA, 674 bp, Zea mays
  misc_feature: Ceres CLONE 1404046-F
  misc_feature: Encodes the peptide sequence at SEQ ID NO. 29356
  misc_feature (1)..(1): n is a, c, t, g, unknown, or other
  misc_feature (588)..(588): n is a, c, t, g, unknown, or other
  misc_feature (627)..(627): n is a, c, t, g, unknown, or other
ntccttctcgtactctcttaggtggcggccgctctattaactagtggatcccccgggctgcaggtaattcacacgagaccattacctagaacatcctaatcgaaaaaaaacgactggctgtcctaacggggacgtctggttcctctcattccccttccacctcgctctctctctctctcctcccactgctcgccctctctctcttacgcgcgcgtgacaacctccctccctccactgcgcgcggcgcgggagcagcagcggcagcacccaccgactgatcgccggtgggcggggcgggggcgatctgatgcgggcgcggcggtgatggcagcgccatccggcggtgggggcggcggtgcgggggagggctcctcctcggccgcggcagctgcgacgatcggggtccacggggtggaccaaggtgcagaggcgatggggcagaagaatttgggaaaaagccatggaaacggggggcatacccagagggggggtggggggggcgagaggggggggagttagggtggggggcggggggtagggggggggtgggggggggggccggtgagaggggaggttgagcgccccgcnaaaaggaagggaccctgaggtgttgtggctgctcgcgcnaagaaagtgaaggggagaagaataaaccctccaaaagaaattgtgtg

SEQ ID NO: 29356 - protein, 64 aa, Zea mays
  misc_feature: Ceres CLONE 1404046-F
MAAPSGGGGGGAGEGSSSAAAAATIGVHGVDQGAEAMGQKNLGKSHGNGGHTQRGGGGGERGGS

SEQ ID NO: 29357 - DNA, 655 bp, Zea mays
  misc_feature: Ceres CLONE 1404057-F
  misc_feature: Encodes the peptide sequence at SEQ ID NO. 29358
agagctggagctccccgcggtggcggccgctctagaactagtggatcccccgggctgcaggaattcgcacgagaccattacctagaacatcctaaccaaaaaaacgagaaggaagccaccgctccccaatcgcctgcttgccttcccatcctcctcgtagatctccggcaccgggcaccatgagctcctactccggcgaccgctcctcctcctcctccttgcgccccaccaacacctccttcgactcctacaagttcgacttcggcatcaactcctcccgctcctccggctctcgccccctccgcgaccagcggccgggcgcggctaccaaccctccaacgaggcccgccaccggcgccacgtggatgcaccagcccgccagcgccaagccgtcgtggacccaccagccttcccccgccgcggcgtcggcgcccaccatggcggggcctggatccgggccaaactccatggtcggcgacatctttggccggagttggtcctccggcgcgcccctcctctgggttcgggatccctcaagccaaacaaccccggccctcttcaaggaatcccctcggggtccggggcttgggttcctccccgttcccaagtccaacggcgccggttcaaaaccggccggcccgggcccaaaggaaat

SEQ ID NO: 29358 - protein, 72 aa, Zea mays
  misc_feature: Ceres CLONE 1404057-F
MAGPGSGPNSMVGDIFGRSWSSGAPLLWVRDPSSQTTPALFKESPRGPGLGFLPVPKSNGAGSKPAGPGPKE

SEQ ID NO: 29359 - DNA, 650 bp, Zea mays
  misc_feature: Ceres CLONE 1404064-F
  misc_feature: Encodes the peptide sequence at SEQ ID NO. 29360
  misc_feature (497)..(497): n is a, c, t, g, unknown, or other
  misc_feature (528)..(528): n is a, c, t, g, unknown, or other
  misc_feature (592)..(592): n is a, c, t, g, unknown, or other
  misc_feature (593)..(593): n is a, c, t, g, unknown, or other
  misc_feature (610)..(610): n is a, c, t, g, unknown, or other
aaagctggagctccccgcggtggcggccgctctagaactagtggatcccccgggctgcaggaattcgcacgagaccattacctagaacatcctaatcgaaaaacatcccagttggaagggcagccaataaggtaaggggtgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgtcgtcgccaccctccggcgccgccatcccggtggtggacctctcggtgacgcggcgcgaggacctagtcgagcaggtgaggcacgcggccgggacggtgggcttcttctggctggtgaccacggcgtggcggaggagctgatgggcggcatgctccgcggngtgcgccagttcacagggcccccgtggaagncgaagcagcgctctactcccaggacctggctcgcaacctgcgcttcgccctcaacttcgacctnncttcaggccgctgcggncgactggcgcgacacgtctttcttgtggaaggtggctccg

SEQ ID NO: 29360 - protein, 109 aa, Zea mays
  misc_feature: Ceres CLONE 1404064-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPSSPPSGAAIPVVDLSVTRREDLVEQVRHAAGTVGFFWLVTTAWRRS

SEQ ID NO: 29361 - DNA, 732 bp, Zea mays
  misc_feature: Ceres CLONE 1404072-F
  misc_feature: Encodes the peptide sequence at SEQ ID NO. 29362
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (49)..(49): n is a, c, t, g, unknown, or other
  misc_feature (57)..(57): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (87)..(87): n is a, c, t, g, unknown, or other
  misc_feature (90)..(90): n is a, c, t, g, unknown, or other
  misc_feature (91)..(91): n is a, c, t, g, unknown, or other
  misc_feature (101)..(101): n is a, c, t, g, unknown, or other
nggcccgggccnnnnnnnnnnnngggggnnnnaaanaaaaanncccccncaaggggnttttannnnnnnntaaaggggnnncccggnggnntcatactggnactccccgcggtggcggccgccctattacaacacatcccccgggctgcaggaatttgcacgagaccattacgtagaacatcctaatcgaaaagaaaagccggttcctcccccgaccccggcgccccaccgcagccgccggctcccaccgcccggcgcaccccggcacctctccaccaaccggatacccggacggatccgctcccacctggatcctgatccggggaagtcaaaggggagatcgaagcttgagcagagggagccaaaatggtgaaggacacgcggtactacgacgtgctgggcgtggacccgtccgccaccgagtccgagatcaagaaggcgtactacgtcaaggcgaggctggtccaccccgagaagaagccgaatgatccgcaggccgcggagaagttccaggaactaggagaagcataccaagttctcagtgaccctacacagcgccaagcttatgactcacatgggaaagatggcatctcaacggaggggattatggatcctgccacaatttttgcaattctgtttggtagtgagctttttgaggaatatattgggcaactgggcaatggcatcaagggctccacctgataatttttggggaagatgaacagattgatg

SEQ ID NO: 29362 - protein, 111 aa, Zea mays
  misc_feature: Ceres CLONE 1404072-F
  misc_feature (6)..(68): Pfam Name: DnaJ Pfam Description: DnaJ domain
MVKDTRYYDVLGVDPSATESEIKKAYYVKARLVHPEKKPNDPQAAEKFQELGEAYQVLSDPTQRQAYDSHGKDGISTEGIMDPATIFAILFGSELFEEYIGQLGNGIKGST

SEQ ID NO: 29363 - DNA, 632 bp, Zea mays
  misc_feature: Ceres CLONE 1404086-F
  misc_feature: Encodes the peptide sequence at SEQ ID NO. 29364
aaagctggagctccccgcggtggcggccgctctagaactagtggatcccccgggctgcaggaattcgcacgagaccattacctagaacatcctaatcgaaaatcgtcctcagtcgcacatatctactatactatactctaggaagcaaggacaccaccgccatggcagcccagatgcttgcattggtcgctctcctagctctttgtgcaagcgccactagtgcgacccatattccagggcacttgccaccagtcatgccattgggtaccatcaacccatgcatgcactactgcatgatgcaacacgggctcgtcagcttgatcgccgaggacgacctgatgctgcagcaactggtagccttaccgcttcagacgatggcagcgatgatctcacagatgatgacgccctacatgatgtccaccatgatgattgccagcatggatgccccaatggtcatgacgagcatgatggcccaatgatgatgccaccatgacactagcaccccgtctcgcagattatgctgcaacaacacgtaacattcatggtcaacctactggtctgactatcccccccataggtctacacgaccccttggtgggggtgcattctacaatgaaaatattgcggtgcat

SEQ ID NO: 29364 - protein, 105 aa, Zea mays
  misc_feature: Ceres CLONE 1404086-F
MAAQMLALVALLALCASATSATHIPGHLPPVMPLGTINPCMHYCMMQHGLVSLIAEDDLMLQQLVALPLQTMAAMISQMMTPYMMSTMMIASMDAPMVMTSMMAQ

SEQ ID NO: 29365 - DNA, 664 bp, Zea mays
  misc_feature: Ceres CLONE 1404095-F
  misc_feature (544)..(544): n is a, c, t, g, unknown, or other
  misc_feature (648)..(648): n is a, c, t, g, unknown, or other
tggagctccccgcggtggcggccgctctagaactagtggatcccccgggctgcaggaattcgcacgagaccattacctagaacatcctaatcgaaaaccatcctcaacttttctctttttgttcgctacgctcactacgcccggtgtccgatgtccgatcgccgatcccctcgtcgatgcgagatgcgaatcttcaggaagactctcactggaaagactatcaacctctgggcggagtcctctgcatctcattgacgacgggttggccgggatccatatagtaggaaggcattctccccggattcatgagcgctcatcttcgctgggaagcaactcgaggactgcccagaacgcttggcgaataccacctcctcaaggagagcatcctccagcttgttctccgcctcaggtgaggcatgccgatattctgcatgactctcactggaatgactatcaccctcaaggtgtagtcttctgacgccatcgagcacgagcttgatgctcatccacgacgaggagtccatgcctccggaccaactgcggntcagttttgctgatactcatgtcgaggatgggcgtagctctgcctgagtacgacattaacgaggagagcaccgctcacttgtcgtatgcgtctcatgcgtgganatgcagatcttcgaga

SEQ ID NO: 29366 - DNA, 616 bp, Zea mays
  misc_feature: Ceres CLONE 1404098-F
  misc_feature: Encodes the peptide sequence at SEQ ID NO. 29367
  misc_feature (609)..(609): n is a, c, t, g, unknown, or other
tggagctccccgcggtggcggccgctctagaactagtggatcccccgggctgcaggaattcgcacgagaccattacctagaacatcctaatcgaaaaatgaaatgaaaccctaatgagtaaagaccctggccggatcactgcgcgccgccaccatggcaccctccgctcaggcctcactcccggcgccgctccggtcactgcggctcaagacaaagcagcaggagctactgctccgcgtctcggcgctggcgctcatctacgaaatcgccttcgccgtccgcctcttctccgtcctccgctacgagtctatgatccacgagttcgacctctacttcaattaccgcaccacgctcttcctcaccgagaacggatttagcgagttctgacactgtgacgatatcgagagctgtgacccgctcggacgcgtgggcaaaagactctcttccgggtctcatggtgaccgccgcgctgatcagcatctccgcgcgctctcactcggtgtccagatcgcgaggtctagatcctcacggtgctttcttcgctggcacaccactctcgacgacaacgcctttggccgcgagatctgccactcggtgacgagctcggcntcgcgcg

SEQ ID NO: 29367 - protein, 77 aa, Zea mays
  misc_feature: Ceres CLONE 1404098-F
  misc_feature: SWISSPROT Homolog: EC 2.4.1.119 Dolichyl-diphosphooligosaccharide--protein glycotransferase
MAPSAQASLPAPLRSLRLKTKQQELLLRVSALALIYEIAFAVRLFSVLRYESMIHEFDLYFNYRTTLFLTENGFSEF

SEQ ID NO: 29368 - DNA, 651 bp, Zea mays
  misc_feature: Ceres CLONE 1404109-F
  misc_feature: Encodes the peptide sequence at SEQ ID NO. 29369
aagctggagctccccgcggtggcggccgctctagaactagtggatcccccgggctgcaggaattcgcacgagaccattacctagaacatcctaatcgaaaaaaaaaaccctcttctcctctgtccgagattcatacaaaaatgcttctcaaatccgcttctgctttctcgctcgtgaacatccatggaggagtcaacaaggacatctctcctctctcctcctcctcctcctcttcattgagtcttcccgtttcttcgggaaaatcaagaaacctctccttctctgtttctgcctccacgcaaaccctgagcggcgtcgttttcgagccgtttgaggaggtgaagaaggagctcgatctcgtcccttcgagtccacagctctctctcgctcgccatctatactctcccgagtgcgaagccgccgtgaacgaacagatcaatgtggagtacaacgtgtcgtatgtgtatcacgccttgtacgcttacttcgatcgtgacaacgttgctctcaaaggtcttgccaagtttttcaaggactcgagtgtggaagagcgagaccacgctgagatgttgatggagtatcagaacaaacgtggtgggagggttaagttacagcccatggtgatgcctcagtctgagtttgatcacgctg

SEQ ID NO: 29369 - protein, 170 aa, Zea mays
  misc_feature: Ceres CLONE 1404109-F
  misc_feature (92)..(170): Pfam Name: Ferritin Pfam Description: Ferritin-like domain
  misc_feature: SWISSPROT Homolog: EC 1.16.3.1 Ferroxidase
MLLKSASAFSLVNIHGGVNKDISPLSSSSSSSLSLPVSSGKSRNLSFSVSASTQTLSGVVFEPFEEVKKELDLVPSSPQLSLARHLYSPECEAAVNEQINVEYNVSYVYHALYAYFDRDNVALKGLAKFFKDSSVEERDHAEMLMEYQNKRGGRVKLQPMVMPQSEFDHA

SEQ ID NO: 29370 - DNA, 740 bp, Zea mays
  misc_feature: Ceres CLONE 1404112-F
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
  misc_feature (42)..(42): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (66)..(66): n is a, c, t, g, unknown, or other
  misc_feature (72)..(72): n is a, c, t, g, unknown, or other
  misc_feature (74)..(74): n is a, c, t, g, unknown, or other
  misc_feature (77)..(77): n is a, c, t, g, unknown, or other
  misc_feature (78)..(78): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (96)..(96): n is a, c, t, g, unknown, or other
  misc_feature (152)..(152): n is a, c, t, g, unknown, or other
  misc_feature (483)..(483): n is a, c, t, g, unknown, or other
  misc_feature (516)..(516): n is a, c, t, g, unknown, or other
  misc_feature (528)..(528): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (622)..(622): n is a, c, t, g, unknown, or other
  misc_feature (657)..(657): n is a, c, t, g, unknown, or other
  misc_feature (658)..(658): n is a, c, t, g, unknown, or other
  misc_feature (660)..(660): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (690)..(690): n is a, c, t, g, unknown, or other
  misc_feature (700)..(700): n is a, c, t, g, unknown, or other
  misc_feature (711)..(711): n is a, c, t, g, unknown, or other
ngggggggcnncccccccccccccccctccnnnnncnccccncagggcnnnnttannnnnnnnttnaggggncnttnnggnnnnnntcatgctggnactccaccgtagggggcggccgcggcgggttaaacgctatccccgcgggctgcagngaagtcacacgagaccattagggagaacatcctaatcaaaaggcccgcgcctcgctctctcttgtctcgcccgctagctcccatcccagcctcccaccgcgcccgcctggccgaacctcccccctcccctccccgctccgctccgctccacgcacggcgccagatctgctgctgctgcggcggccgctggactccgcgcctcgcgtgccggcgacggagaggagagcggagaatcctgcccgcccgtgtcatcccggcgacgaggacaacagaaacggacggcccaccaacacaccccccctctccctacccccgaggtcaggggggggcngatcgtcggccgaaactgcccctgttgttgcancccccccatggnatgtcaaaggaagggaaagttgactacactaacacggcggacccccgaatgagatcccacaccatgcacctggcggaacnnnnccctcccccanaagaagcttaccgaaaccggacggcccccgggggnnanccnnnncgcccaaagggaaaggtcgcgggnccgaaaacanaaccacacgcntttcaaaagcggggggggatggggggggg

SEQ ID NO: 29371 - DNA, 752 bp, Zea mays
  misc_feature: Ceres CLONE 1404133-F
  misc_feature: Encodes the peptide sequence at SEQ ID NO. 29372
  misc_feature (1)..(1): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (70)..(70): n is a, c, t, g, unknown, or other
  misc_feature (71)..(71): n is a, c, t, g, unknown, or other
  misc_feature (83)..(83): n is a, c, t, g, unknown, or other
  misc_feature (116)..(116): n is a, c, t, g, unknown, or other
  misc_feature (421)..(421): n is a, c, t, g, unknown, or other
  misc_feature (435)..(435): n is a, c, t, g, unknown, or other
  misc_feature (491)..(491): n is a, c, t, g, unknown, or other
  misc_feature (512)..(512): n is a, c, t, g, unknown, or other
  misc_feature (547)..(547): n is a, c, t, g, unknown, or other
  misc_feature (548)..(548): n is a, c, t, g, unknown, or other
  misc_feature (560)..(560): n is a, c, t, g, unknown, or other
  misc_feature (569)..(569): n is a, c, t, g, unknown, or other
  misc_feature (570)..(570): n is a, c, t, g, unknown, or other
  misc_feature (572)..(572): n is a, c, t, g, unknown, or other
  misc_feature (588)..(588): n is a, c, t, g, unknown, or other
  misc_feature (594)..(594): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (657)..(657): n is a, c, t, g, unknown, or other
  misc_feature (685)..(685): n is a, c, t, g, unknown, or other
  misc_feature (709)..(709): n is a, c, t, g, unknown, or other
naggagggggcccnncnccccccacccnnncannnaacccccncggcccnnatttnnnnnnntagaggtnngggggggggggnttcatactggaacgccccgcagtggcggccgcnctagttcaacgccacccccgggctgcaggaattttcacgagaccattacggagaacatcctaaaaaaaaaaataggacaagccccagcagtttgccactcccacgcgaaacagaagccccagcagggcggcactcccgacgcgacgcccctgcttgccggccgggaggggcactcgactctgcctccacttcctcgtctgtccgttggagcacggcgccgatggcggcggcgccagcgctcgcgcgggagctgctggacgcggcgcgggagccggagttcgcggagtggcaccgcggcgtgcggngccggatccaccancacccggagctggtctttcaggaacaccggggggggggggggggtgcgcgccgagntcgaggggaccgggggcccgnacgcccgggcccgccgcgcagacgggggggggggnncccatcaccggnccccacgcnngncccccggggtcgcggntccgcncccgacctgggacggggctccccctccccggaaaggggtaaaaaggggcaactcccnnnagcncgggaagacccggccaaaagagagggcnggggggccatggacgggccgaggnggggcggggggctccacgggaagcggcaaagggggcgcgggcg

SEQ ID NO: 29372 - protein, 138 aa, Zea mays
  misc_feature: Ceres CLONE 1404133-F
  misc_feature (29)..(29): Xaa is any aa, unknown, or other
  misc_feature (33)..(33): Xaa is any aa, unknown, or other
  misc_feature (52)..(52): Xaa is any aa, unknown, or other
  misc_feature (59)..(59): Xaa is any aa, unknown, or other
  misc_feature (71)..(71): Xaa is any aa, unknown, or other
  misc_feature (75)..(75): Xaa is any aa, unknown, or other
  misc_feature (78)..(78): Xaa is any aa, unknown, or other
  misc_feature (79)..(79): Xaa is any aa, unknown, or other
  misc_feature (106)..(106): Xaa is any aa, unknown, or other
  misc_feature (117)..(117): Xaa is any aa, unknown, or other
  misc_feature (125)..(125): Xaa is any aa, unknown, or other
MAAAPALARELLDAAREPEFAEWHRGVRXRIHXHPELVFQEHRGGGGGARRXRGDRGPXRPGPPRRRGGGXPSPXPTXXPRGRGSAPDLGRGSPSPERGKKGQLPXAREDPAKREGXGAMDGPRXGGGLHGKRQRGRG

SEQ ID NO: 29373 - DNA, 657 bp, Zea mays
  misc_feature: Ceres CLONE 1404148-F
  misc_feature: Encodes the peptide sequence at SEQ ID NO. 29374
aagctggagctccccgcggtggcggccgctctataatagtggatcccccgggctgcaggaattcgcacgagaccattacctagaacatcctaattgaaaaatcgcaccaacaccgtcaatcaacacagcacaggcaggtcgagagacagagagagagaaagtatgtctaggttcgggcaccaccaccacagaccagtcggctcccccggggtcggatcccaatcaggtgttcaagatcttctgccgtgccaactagtaactattgcctggacgtacgttacggcggcgtcgtgctggccccggtcaacccacgggacgaccaccagcactggtacaaagacatgcgcttcagctgccgggtctatgacgagaaaagcatgacggcgttcgcgctcgtcaacaaggccacgaggctcacaatcaaacactccctcggccagtccctaccggtaaagatcgcgcctttcagatcgtaccagaaccacgcctcgacgctgtgcacggacagaaagtgacggacccagggcttccgatgcatccgcatggtaaactgcacccgcctcaacttcaacgccttccacggcgacaaggaccacggctgagtgtactacagcaccgccctactgctctgaacatggagcaagggctgacacccga

SEQ ID NO: 29374 - protein, 57 aa, Zea mays
  misc_feature: Ceres CLONE 1404148-F
MRFSCRVYDEKSMTAFALVNKATRLTIKHSLGQSLPVKIAPFRSYQNHASTLCTDRK

SEQ ID NO: 29375 - DNA, 548 bp, Zea mays
  misc_feature: Ceres CLONE 1404157-F
  misc_feature (247)..(247): n is a, c, t, g, unknown, or other
aaagctggagctccccgcggtggcggccgctctagaactagtggatcccccgggctgcaggaattcgcacgagaccattacctagaacatcctaatcgaaaacgaaaaattcgaaagatccctccaggaaagatttttcttccctcctccgacgccccagcccaccaacacactctataaagcagccctcagtcacacacagaacgcacaagcgcaagccgggcaagaaaactccgtaggccagtcntggcgagttggatggcctttctttctggccctcgtgtgcatcctcatcttgctagccatcgcctccctacgtccaggaacactcgctggcaaaaagggaaaaggccggctttcggggggccatggggaggcctgctcccctggaagggggcctcccggggctcccaggggctgggccttaaccctgggggggggacccctcccaggttttatcctccccaggggacccccagggtttttttttttttggttttccaaaaaagaaaaaaagggggcccccgccggaaaaatcttttccaaaa

SEQ ID NO: 29376 - DNA, 646 bp, Zea mays
  misc_feature: Ceres CLONE 1404161-F
  misc_feature: Encodes the peptide sequence at SEQ ID NO. 29377
  misc_feature (515)..(515): n is a, c, t, g, unknown, or other
  misc_feature (569)..(569): n is a, c, t, g, unknown, or other
aaagtggagctccccgcggtggcggccgctctagaactagtggatcccccgggctgcaggaattcgcacgagaccattacctagaacatcctaatcgaaaaaaaaataggaaacgagcaaaggtctggcgagctacctaccaataaactaccatctccacaaacaggctagcacgtagctatatgccagaactgacctagtagaggatcgatcgcagatggtgtttcctgccatcctccccaaggtggccgcacgatggctcttcacgttctaccgcgccgccagaaagctcaggcgccacgccttccagctctactaccgcaacaccgccgccaagccgtcgtccgccgtctcgcagcagcaggccggggccgccgccactgtcactgccgccgccgccttcaagaccggcgccgccatccctgacgccggcggccggaccgttgtgtgcgacatgcacggcgccctgctgcgctccaccgcgctcttcccctacttcatgctcgtggcctgcngagggcggcagcctcgtccgcgccatgctgctgctctgcgctcccccccttcgntctgggcggctcgggaagcgccgcggcgccggcgtcccgggtgatgccgttcgtcaccttcgcggggcctcaggcca

SEQ ID NO: 29377 - protein, 131 aa, Zea mays
  misc_feature: Ceres CLONE 1404161-F
  misc_feature: SWISSPROT Homolog: EC 2.3.1.15 Glycerol-3-phosphate O-acyltransferase
  misc_feature (100)..(100): Xaa is any aa, unknown, or other
  misc_feature (118)..(118): Xaa is any aa, unknown, or other
MVFPAILPKVAARWLFTFYRAARKLRRHAFQLYYRNTAAKPSSAVSQQQAGAAATVTAAAAFKTGAAIPDAGGRTVVCDMHGALLRSTALFPYFMLVACXGRQPRPRHAAALRSPPSXWAAREAPRRRRPG

SEQ ID NO: 29378 - DNA, 638 bp, Zea mays
  misc_feature: Ceres CLONE 1404163-F
  misc_feature: Encodes the peptide sequence at SEQ ID NO. 29379
  misc_feature (638)..(638): n is a, c, t, g, unknown, or other
tggagctccccgcggtggcggccgctctataactagtggatcccccgggctgcaggaattcgcacgagaccattacctagaacatcctaatcgaaacagagaaagagagacgaacgcgcacgagctagctagctagctcgctcgatcggaagagtcatggcgcccaggttcgcccgctccatctccttcccactcagcccgtccaggtcatcaacgtcgacgtcgggcaccaagccccgcgcggcggcggcctccaccgccgcggcgaaccacgcgcgctccgtcagcctgccgtgccgctcgcacccgatcctcgcgcacctccacgcgcacatcgacgccgtgcgcgcctgggcgcaggacccgccggccacctccggcctcggcgccgccgcgggcctggcgcgcgtggacgcgctccacggagcgctcgccgacctgctcggcctccccgaggtacggggcgcggtgtcgctctccgccaccggcgaccgcctccgggacgccttcctcggcctgggcgacgcgcacggcagcttccaggaggccgtgtggaacctgaagcgccatgtggccaaagcgctggccgacgagcgccgccgcgacggtgagcgcctggcgtctgaggtcgggtgccn

SEQ ID NO: 29379 - protein, 160 aa, Zea mays
  misc_feature: Ceres CLONE 1404163-F
MAPRFARSISFPLSPSRSSTSTSGTKPRAAAASTAAANHARSVSLPCRSHPILAHLHAHIDAVRAWAQDPPATSGLGAAAGLARVDALHGALADLLGLPEVRGAVSLSATGDRLRDAFLGLGDAHGSFQEAVWNLKRHVAKALADERRRDGERLASEVGC

SEQ ID NO: 29380 - DNA, 686 bp, Zea mays
  misc_feature: Ceres CLONE 1404165-F
  misc_feature: Encodes the peptide sequence at SEQ ID NO. 29381
tcattctgtgactcttccttaggtggcggccgctctataactagtggatcccccgggctgcaggatttcgcacgagaccattacctagaacatcctaatcgaaaatcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctgggaccctgaccacttcatcaacgggcagaccaactaccccggggtgggccggaacggggcgacgttctacttcctggtggtcgccatcctggccggcgtggtggggcccggcgtccaagcttggggggcgtggccccacgtgggcgcctggggccaacgacaggcttgggccacaaaagcccgcggttgtcgttcattccccggggggcatttacggggggttcccctctttcgggttgggcctcgcaagga

SEQ ID NO: 29381 - protein, 112 aa, Zea mays
  misc_feature: Ceres CLONE 1404165-F
  misc_feature (14)..(111): Pfam Name: AWPM-19 Pfam Description: AWPM-19-like family
MAGIGRNMVAPLLVLNLIMYIIVIGFASWDPDHFINGQTNYPGVGRNGATFYFLVVAILAGVVGPGVQAWGAWPHVGAWGQRQAWATKARGCRSFPGGHLRGVPLFRVGPRK

SEQ ID NO: 29382 - DNA, 638 bp, Zea mays
  misc_feature: Ceres CLONE 1404167-F
  misc_feature (325)..(325): n is a, c, t, g, unknown, or other
  misc_feature (326)..(326): n is a, c, t, g, unknown, or other
  misc_feature (333)..(333): n is a, c, t, g, unknown, or other
aaagctggagctccccgcggtggcggccgctctagaactagtggatcccccgggctgcaggaattcgcacgagaccattacctagaacatcctaatcgaaaacccgggatcctcgttttgtttcccttcccccacccttcctcttcctccctatctatcagcactgctcgccggcgccgcctctgcaaaaggctcacttttgcctccggaacccagcggaatccgccggcggaccggaaacactcgctcgcccccctcaccccctgtctgcccggccgtcggagcgcgtcgcctcccggcgtgcagcaacagtccctggaggtgnnaccgggnaggaggaggaggaggaccaagaccaagcattatcctgcccaaaacggaacagaaggaggggcctgctcccctctccgttggagcccaagctacggattgccttggcccggcccccgaaaaaggggattcttttggaagaaaatcaaaggggttccggtttggcaaaaaaaaagcccccccccctttggaaatctttcccccaaaccctcttttgttccaatttttgagaaaaaaaaaaaggggataaacctttgggggggtgggccccccggggggggaaaaaaaaaaaacggggtttgtttttt

SEQ ID NO: 29383 - DNA, 693 bp, Zea mays
  misc_feature: Ceres CLONE 1404168-F
  misc_feature: Encodes the peptide sequence at SEQ ID NO. 29384
  misc_feature (530)..(530): n is a, c, t, g, unknown, or other
  misc_feature (578)..(578): n is a, c, t, g, unknown, or other
  misc_feature (640)..(640): n is a, c, t, g, unknown, or other
  misc_feature (693)..(693): n is a, c, t, g, unknown, or other
ggagctccccgcggtggcggccgctctagaactagtggatcccccgggctgcaggaattcgcacgagaccattacctagaacatcctaatcgaaaagcattttggctcctcactgccgcgccgccaccccctacaggtaaggaagaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacgaggctggcatgactcacattgtccgtgaggttgagaagccaggatccaaactccataagaaggaaacttgtgaggctgttaccatcattgaaacccctcctcttgtcattgttgggctcgtggcatatgtgaagactcctcgtggcctccgcacactcaactctgtttgggcccaacatcttagtgaagaagtgaggagaaggttctacaagaactggtgcaagancaagaagaaggctttcacaaagtatgctctcaaatatgaaaatgatgnctggcaagaaggaaattcagctgcagcttgagaagatgaagaaatatggcttctgttatccngtgtcattgctcatacccgaataggaaaaaaatttgaaggggtttgaaagcan

SEQ ID NO: 29384 - protein, 150 aa, Zea mays
  misc_feature: Ceres CLONE 1404168-F
  misc_feature (51)..(150): Pfam Name: Ribosomal_L3 Pfam Description: Ribosomal protein L3
  misc_feature (125)..(125): Xaa is any aa, unknown, or other
  misc_feature (141)..(141): Xaa is any aa, unknown, or other
MSHRKFEHPRHGSLGFLPRKRSSRHRGKVKSFPRDDPKKPCHLTAFLGYEAGMTHIVREVEKPGSKLHKKETCEAVTIIETPPLVIVGLVAYVKTPRGLRTLNSVWAQHLSEEVRRRFYKNWCKXKKKAFTKYALKYENDXWQEGNSAAA

SEQ ID NO: 29385 - DNA, 631 bp, Zea mays
  misc_feature: Ceres CLONE 1404169-F
  misc_feature: Encodes the peptide sequence at SEQ ID NO. 29386
aagctggagctccccgcggtggcggccgctctagaactagtggatcccccgggctgcaggaattcgcacgagaccattacctagaacatcctaatcgaaaatctcgattttcgtctcactcacatctcccatcgatccagctcgcccccgcccgttttctcctgaaaacaaaacgaaaggctccgccatccgaaaaaaaaaaccccacacaaaacccataccccctgcggcggcggcgatggacccgtcctcgtcgggctccggcggcaactccctcccgtccgttggccccgacggacagaagcggcgcgtgtgctactactacgacccggatgtgggcaactactactacgggcagggccatccgatgaagccgcaccgcatccggatgacgcactcgctgctggcgcgctacggcctcctcaaccagatgcatgtgtaccgccccagcctgggcagccaacgcgacctctgtcgcttccacgccgacgactacatcaaattcctgcgctccgtcacgcccgacacgcagcaggagcagacccgcctgctcaagcgcttcaacgtcggcgaggactgccccgtcttcgacggcctctacagcttctgccagacctactcgggcgcctca

SEQ ID NO: 29386 - protein, 131 aa, Zea mays
  misc_feature: Ceres CLONE 1404169-F
MDPSSSGSGGNSLPSVGPDGQKRRVCYYYDPDVGNYYYGQGHPMKPHRIRMTHSLLARYGLLNQMHVYRPSLGSQRDLCRFHADDYIKFLRSVTPDTQQEQTRLLKRFNVGEDCPVFDGLYSFCQTYSGAS

SEQ ID NO: 29387 - DNA, 671 bp, Zea mays
  misc_feature: Ceres CLONE 1404184-F
  misc_feature (452)..(452): n is a, c, t, g, unknown, or other
  misc_feature (647)..(647): n is a, c, t, g, unknown, or other
ggagctccccgcggtggcggccgctctagaactagtggatcccccgggctgcaggaattcgcacgagaccattacctagaacatcctaatcgaaaaatcacacatattattgaaactaactagcaacacagaaagcgcaatagtgtagcaaaactggcagtcaaaatattttgcctccttatgctccttgctctttctgcaagtgctgctaacgcgaccaattttctgcaatgctcacaagatccaattgcttcccttcttccctcatacctctcaccagcgacatcttcagtatgtgaaaacccaattcttcaaccctataggatccaacaggcaatcacagcaagcatcttacctttatcacccttgttcctccaacaaccgccagccctgttacaacaattacctttggtgcatttgttggaacaaagcatcaaggcacaacaactacnacaacctgtgctgacaaaccttgttgcctactctcagcaacaatagtttcttccattcaaccaactggctgcactgaactctgctgcttatttgcaacaacaacaacttccattcacccagctagatgctgcctacccccaacaatttcttccattcgactaactggctgcattgaactctgttgcttatttacnacagcaacaactaataccatgaac

SEQ ID NO: 29388 - DNA, 755 bp, Zea mays
  misc_feature: Ceres CLONE 1404195-F
  misc_feature: Encodes the peptide sequence at SEQ ID NO. 29389
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (31)..(31): n is a, c, t, g, unknown, or other
gaggccccacccnncnnnnactcaaatcccncgctcccccgcccccggcaaagatggggctcaccgcggtggcggccgctctagaactagtggatcccccgggctgcaggaattcgcacgagaccattacctagaacatcctaatcgaaaaaaaactgcattacaccacgatacactccactacaccctctcgagcaacaccaggaaccataccaaatcccaagtagagaagagcaagggctgcagctggcaagaagctttgctcagaaatggagttcctgtcgcagatgtggtcgctcctgggcctgctcaccatcctgcagaacgtcctccccacgcagctgctctccttgctgcactcgctgtggcagtcgctccaagactctctcacgccctactcctacttcgacgtggcccgagttcctcggctctgcggccgtcgagcccaacgcgctctaccgccacatccaggtctacctccaacgctccctcctcctctcctcgcctccgccgccacgcctcacgctctcgctgccgcgctcctccggcgggctcgggcggacacgccccacggagctgcgccatccccccgccggccggggcctgccctccccaaaaccactcgggacggaggagacccttacaaggggaaacccaagcgcggggtggggcaaactctcaccgcccgaccacgtcccccacgaaatctccctccgcggcgaggaccgcggggactcttataatacgactcagcg

SEQ ID NO: 29389 - protein, 157 aa, Zea mays
  misc_feature: Ceres CLONE 1404195-F
MEFLSQMWSLLGLLTILQNVLPTQLLSLLHSLWQSLQDSLTPYSYFDVARVPRLCGRRAQRALPPHPGLPPTLPPPLLASAATPHALAAALLRRARADTPHGAAPSPRRPGPALPKTTRDGGDPYKGKPKRGVGQTLTARPRPPRNLPPRRGPRGLL

SEQ ID NO: 29390 - DNA, 628 bp, Zea mays
  misc_feature: Ceres CLONE 1404198-F
  misc_feature: Translation starting site: 155
  misc_feature: SWISSPROT Homolog: EC 3.1.2.15 Ubiquitin thiolesterase
aagctggagctccccgcggtggcggccgctctagaactagtggatcccccgggctgcaggaattcgcacgagaccattacctagaacatcctaatcgaaaactttctcctccagcaagtaaaccccgtttccacaacgtcaccgcaccgccgtcatgccgaccgtaagcgtgaaatggcagaaggagctctttccaggcatagagattgacactagccagcctccgattgttttcaagactcagttgtacacactaactggtgtgccacctgaacgccaaaaaattatggtgaagggaggaatattgaaggacgatgcagattggtctactttgggagtgaaagatggccaaaagttgatgatgatacgcacggctgatgagattggaaagctcggaagaaagtccagtgtttgttgaggatctaccagaaaagagcaagtgatggcactgggtcacagtgctggcctttataccttgggaatacatgctatatgaattccacattgcaatgtctgcattctgttcccgagctgaagtcagcgctgctaaactaatcagatactggaagagggaatggcattgaccaagctttccctaaatttggctggtggctactccgaataacct

SEQ ID NO: 29391 - DNA, 685 bp, Zea mays
  misc_feature: Ceres CLONE 1404199-F
  misc_feature: Translation starting site: 162
  misc_feature (388)..(388): n is a, c, t, g, unknown, or other
  misc_feature (425)..(425): n is a, c, t, g, unknown, or other
  misc_feature (432)..(432): n is a, c, t, g, unknown, or other
  misc_feature (435)..(435): n is a, c, t, g, unknown, or other
  misc_feature (436)..(436): n is a, c, t, g, unknown, or other
aagctggagctccccgcggtggcggccgctctagaactagtggatcccccgggctgcaggaattcgcacgagaccattacctagaacatcctaatcgaaaaatttttcgcccgccgcccccagtcccgatccgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgggatccgnccctggggacggtgctgaccctcctcgcagggcgttncatgggnaannaggagtggtgtttctcaggcagctcaagtccggcctgctccttatctctgggcctttcagatcaatggagtaccgattcgccggggtgatcagacctatgtcattgctacatcaaccaaattgacatctctgggtgttgatgtcgccaagttggatgacaagtactttgccagggagaaaaagcagaagggtgaagaagaccgagggcgagctttttgagacagaaaaggaggcatccaagtcactgcc

SEQ ID NO: 29392 - DNA, 630 bp, Zea mays
  misc_feature: Ceres CLONE 1404200-F
  misc_feature: Encodes the peptide sequence at SEQ ID NO. 29393
agagctggagctccccgcggtggcggccgctctagaactagtggatcccccgggctgcaggaattcgcacgagaccattacctagaacatcctaatcgaaaaatttttaccgcacatctctccttcctcggcgtctcgcacaccccagcaccttcgtctcccctcccctcccctcccctcccccaacaatcggaaccggatagaaagttcggcttcctcccggacgactcggcgcaaggtcgcaggttttctctcgatttttcgcgcttccccgctttgacgcttgcttcgcatggagattctggagatctttggggcggatcgctgctgagatggttcgcctcatcacgcgctgctgtgactcccaacagatcttccgagccgaggagcccctgttatgaacggcatgccgatctctgcgtcctctgcggcaagcgtcgacagtggcgcgatggcggccgacacacccatgaagaatgcaacggcggcggacgctctcgccgagatgacgagacatcttaccgtcgacacggaagacaccttcgcgagcctgctggagctcgacgctgacgacgacgcagaggggctgcgcctcgcgctggagcgggcgccacctgccgccgaggacga

SEQ ID NO: 29393 - protein, 77 aa, Zea mays
  misc_feature: Ceres CLONE 1404200-F
MNGMPISASSAASVDSGAMAADTPMKNATAADALAEMTRHLTVDTEDTFASLLELDADDDAEGLRLALERAPPAAED

SEQ ID NO: 29394 - DNA, 846 bp, Zea mays
  misc_feature: Ceres CLONE 1404201-F
  misc_feature (19)..(19): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (73)..(73): n is a, c, t, g, unknown, or other
  misc_feature (74)..(74): n is a, c, t, g, unknown, or other
  misc_feature (749)..(749): n is a, c, t, g, unknown, or other
ttttttttttttttttctnccggccgcctcccacgcccccgcccgccgatccgtagattgggtgnnnnccccnncccccaaactgggactcaccgcggtggcggccgctctagtctagtggatcccccgggctgcaggaattcgcacgagaccattacctagaacatcctaatcgaaaaccctcccccaccgccattgctcagcagcagtagtaaagccacgcctgacagacagctggttcatttctggctgctgccttgctggcggtagccctcggcgcaggccgccaagaacagagagagcgagatggatgtgaacgacgtgctgctagtggtgcctggcggcggcgctggctgccatgtggtggcggccggcgctcccaggacccggcggtggcggacgctctccccgccgggagcctccggggctcggcccggcggcgggggaaaatggttcccctgtggaaccccggcgggggaccggcccccttcaggcaaaccggggggggggcgtcccccccggcgaagaaactaaccgcctcctcattccccccccccccggtccgccccggccgccgcccgcttccccccccaatccgtggtgccacccttgggcggcggcggccttaccccccccacaagcggcgccctggttgcaacgcccggggaccccccttgtgttccgccggaagggcccggattccacaaggtcccgcggcaccacacgtgggtccgttccctgattacgcngcgccatgacacagggcgcaaccgacctcacccccgcgtgcgcccgtctgccggcctgacactcgaagggcgccggacacattagtcgcgcccgccc

SEQ ID NO: 29395 - DNA, 688 bp, Zea mays
  misc_feature: Ceres CLONE 1404206-F
  misc_feature: Encodes the peptide sequence at SEQ ID NO. 29396
  misc_feature (389)..(389): n is a, c, t, g, unknown, or other
  misc_feature (573)..(573): n is a, c, t, g, unknown, or other
  misc_feature (688)..(688): n is a, c, t, g, unknown, or other
aaagctggagctccccgcggtggcggccgctctagaactagtggatcccccgggctgcaggaattcgcacgagaccattacctagaacatcctaatcgaaaatgcggtctgcctctgcccttaccgctacgctttcctcccggattccagcagcgaaacacgcgcggggcaaggacggagctggtaagccgatcgagccggcgagggtggacaagatgatgatggccgaggtggccgccaaccacagcaaaaggagccacaacgacggctacttcagtgccaaagccgccgccgccgccgccgcgagcccagaggagttgggaagcatgtccatgtcctcgaagaagccgaggaatagcaacagcccgagaaccgcgcccgtatcgccncaaggagaagaaggacaggatcggcgagagagtcgcggcgctccagcagtagagtgtcgcccgttcgggaagacagacacggcttccgttctgcagggggggggcgggggacacatcaggttcctgcaccagcagctccaggtcctcagctccctttacatggcgtgctcctcccggctgccgncggccgccgcctgaggataccgagcactacagcctccggagggcgcgggcttgggcccggggggccgggggaaccagacactgcagctgacccagagcaaccgggcccgacccgn

SEQ ID NO: 29396 - protein, 161 aa, Zea mays
  misc_feature: Ceres CLONE 1404206-F
  misc_feature (158)..(158): Xaa is any aa, unknown, or other
MRSASALTATLSSRIPAAKHARGKDGAGKPIEPARVDKMMMAEVAANHSKRSHNDGYFSAKAAAAAAASPEELGSMSMSSKKPRNSNSPRTAPVSPQGEEGQDRRESRGAPAVECRPFGKTDTASVLQGGGGGHIRFLHQQLQVLSSLYMACSSRLPXAAA

SEQ ID NO: 29397 - DNA, 692 bp, Zea mays
  misc_feature: Ceres CLONE 1404208-F
  misc_feature (376)..(376): n is a, c, t, g, unknown, or other
  misc_feature (412)..(412): n is a, c, t, g, unknown, or other
  misc_feature (488)..(488): n is a, c, t, g, unknown, or other
  misc_feature (489)..(489): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (541)..(541): n is a, c, t, g, unknown, or other
  misc_feature (542)..(542): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (553)..(553): n is a, c, t, g, unknown, or other
  misc_feature (554)..(554): n is a, c, t, g, unknown, or other
  misc_feature (556)..(556): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactaacagaagggcgtggcaagaatcaggagagagatagcaggggggctagctagctgagctcgtgcgacgaagaatggccgggaattggcaggaacatggtgacgnccgctcctggtgctcaacctcatcatgtacatcatncgtcatcggcttcgcgagctggaacctgaaccacttcatcaacgggcaaccactaaacccggggcgtggccggaannggggcgcgacgtctaacttttccctggtgtcgccacccggcccccccnnngnngnnnnnccccnncntccnnnncttnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29398 - DNA, 696 bp, Zea mays
  misc_feature: Ceres CLONE 1404209-F
  misc_feature: Encodes the peptide sequence at SEQ ID NO. 29399
  misc_feature (409)..(409): n is a, c, t, g, unknown, or other
  misc_feature (493)..(493): n is a, c, t, g, unknown, or other
  misc_feature (696)..(696): n is a, c, t, g, unknown, or other
tggagctccccgcggtggcggccgctctagaactagtggatcccccgggctgcaggaattcgcacgagaccattacctagaacatcctaatcgaaaaacccgaagcacatcccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccaacctggggtcgtccaaaaggtgtcaccccanagtacagcttgaagcctcttgttccacgcttgtctgagctcctttggggagttgaagtcgtgatgggcaatgattgcttggggnggagaaaagttgaaaaaagtggctgccgctttgcaaaaaaagggggagttctgctcctagagaaatgttagattctacaagggagggaagagaagaacgaaacctgagttttgctaagaagctagcatctggtgcttgacctttatggtcattgatgctttttgccacggcacacagagctcatgcttccaccggaggagttn

SEQ ID NO: 29399 - protein, 77 aa, Zea mays
  misc_feature: Ceres CLONE 1404209-F
  misc_feature: SWISSPROT Homolog: EC 2.7.2.3 Phosphoglycerate kinase
  misc_feature (74)..(74): Xaa is any aa, unknown, or other
MATKRSVGTLGEADLKGKKVFVRADLNVPLDDAQKITDDTRIRASVPTIKFLLEKGAKVILASQPGVVQKVSPXSTA

SEQ ID NO: 29400 - DNA, 678 bp, Zea mays
  misc_feature: Ceres CLONE 1404211-F
  misc_feature: Encodes the peptide sequence at SEQ ID NO. 29401
  misc_feature (537)..(537): n is a, c, t, g, unknown, or other
  misc_feature (556)..(556): n is a, c, t, g, unknown, or other
  misc_feature (572)..(572): n is a, c, t, g, unknown, or other
  misc_feature (575)..(575): n is a, c, t, g, unknown, or other
  misc_feature (630)..(630): n is a, c, t, g, unknown, or other
  misc_feature (639)..(639): n is a, c, t, g, unknown, or other
aaagctggagctccccgcggtggcggccgctctagaactagtggatcccccgggctgcaggaattcgcacgagaccattacctagaacatcctaatcgaaaactccaagaccaagaccaacaccactccgatccctccatttccctcacctcccgtagcagtaagacgccaggcaaaaaccgaagcaaacaacccacccacaggccacagcgagcgagaaaggcgtacaatggtaacgatggcggacgtgcagaaatagcagcagcagcagcgccgcgaagcggaggcggagctcaacctgcccccgatcttccggatgcacccgacggaagaggagctggtggagcactacactctgcgcgagcgccgcggggcgacggccgacggtgtcatcatcggcgagggcgacctgtaccgctgctacccctgggatctggcggagcgcgccctcttcgggcgccgaggatgcgacttcttcacggcgcggagacgcgagtaccacaaaggctcgcgtgcaaccgcgcccggcaggtcggncatactgcgatgccacggncgcggaaaggccgggnagnaaggcggacgagacggcggagatcgagaaggcgctagagctatacaagaagccgncgggagagnaaaagaagggggtgagcatgagtaaagccgacatggaat

SEQ ID NO: 29401 - protein, 115 aa, Zea mays
  misc_feature: Ceres CLONE 1404211-F
  misc_feature (2)..(101): Pfam Name: NAM Pfam Description: No apical meristem (NAM) protein
  misc_feature (74)..(74): Xaa is any aa, unknown, or other
  misc_feature (86)..(86): Xaa is any aa, unknown, or other
  misc_feature (87)..(87): Xaa is any aa, unknown, or other
  misc_feature (105)..(105): Xaa is any aa, unknown, or other
  misc_feature (108)..(108): Xaa is any aa, unknown, or other
MHPTEEELVEHYTLRERRGATADGVIIGEGDLYRCYPWDLAERALFGRRGCDFFTARRREYHKGSRATAPGRSXILRCHGRGKAGXXGGRDGGDREGARAIQEAXGRXKEGGEHE

SEQ ID NO: 29402 - DNA, 705 bp, Zea mays
  misc_feature: Ceres CLONE 1404212-F
  misc_feature: Encodes the peptide sequence at SEQ ID NO. 29403
  misc_feature (298)..(298): n is a, c, t, g, unknown, or other
  misc_feature (328)..(328): n is a, c, t, g, unknown, or other
  misc_feature (705)..(705): n is a, c, t, g, unknown, or other
aaagctggagctccccgcggtggcggccgctctagaactagtggatcccccgggctgcaggaattcgcacgagaccattacctagaacatcctaatcgaaatctataaatggctagctcccacatatgaactagtctctatcatcatccaatccagatcagcaaagcggcagtgcgtagagaggatcgtcgaacagaacagcatgaagatgggtcatcgttctcgtcgtgtgcctggctctgtcagctgccagcgcctctgcaatgcagatgccctgccccctgcgcgggcctgcagnggctggtacggcgctggcgccggcctgccnaacgatgatggggcgcccggcgggctgtaccccctacgcggagtacctgaggcagccgcagggcagcccgcctggcggcggcgccctactaacgcccgggtggtgggcagcccgagcgccatgttccaggccgctccgcgcacaggtgctgccagcagcagatggagaatgatggaccgtgcagtccgccgccgcagcagcgggcgatgaggatgcgccttgaagcgtgccgctgccggcagtagaagcctggacgagcccagtctggtggggcaggaggcgggggtgctggggggcccggggctctatccgttggcgccaagcaggggggcggacgtggcggcccaggggcggccgcccccacgtcccccccgccn

SEQ ID NO: 29403 - protein, 78 aa, Zea mays
  misc_feature: Ceres CLONE 1404212-F
  misc_feature (12)..(12): Xaa is any aa, unknown, or other
  misc_feature (22)..(22): Xaa is any aa, unknown, or other
MQMPCPLRGPAXAGTALAPACXTMMGRPAGCTPYAEYLRQPQGSPPGGGALLTPGWWAARAPCSRPLRAQVLPAADGE

SEQ ID NO: 29404 - DNA, 702 bp, Zea mays
  misc_feature: Ceres CLONE 1404214-F
  misc_feature (1)..(1): n is a, c, t, g, unknown, or other
  misc_feature (26)..(26): n is a, c, t, g, unknown, or other
  misc_feature (27)..(27): n is a, c, t, g, unknown, or other
  misc_feature (33)..(33): n is a, c, t, g, unknown, or other
  misc_feature (34)..(34): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
naaaggggggggggggtatgggggtnnggggcnnaaccccccccacccgaacacacccgggggggannnnnnnnaaaaactggagctccccgcggtggcgggcgctctagaactagtggatcccccgggctgcaggaattcgcacgagaccattacctagaacatcctaatcaaaaccagatccctcttccctctccgctcccccacgtcatctagtcgccgcccccgctcaccgattgtcctctgctgtggagcgagcagcagcggcgagcgatggaggaaggagatcagaaaggagtcccgagtaacggtttctccctcgggaggagccggccccgaggggaccccgcccaaaaccctctccccggtgggtgggctacggggtcaactaaaaagagggaccccccgggggatttccggcccaaaaaggggggggggggtcaaaaaacccccccaaaagggggaaatgggggggggggggtaaaaaacgctcccaaaagggcccgaacatccggggggggggggggtttttggggggcaccccccctcctttcaaaaagggggggggaaaaaagagcggggggcaaaaaaaaaaaaggggaggggagggcccccccccccccgccttttttaccccccgcgggagaggggagggggggggggaggggggtgtctgtagaagcaacacccccgcgggggggg

SEQ ID NO: 29405 - DNA, 721 bp, Zea mays
  misc_feature: Ceres CLONE 1404215-F
  misc_feature: Encodes the peptide sequence at SEQ ID NO. 29406
  misc_feature (316)..(316): n is a, c, t, g, unknown, or other
atagctggagctccccgcggtggcggccgctctagaactagtggatcccccgggctgcaggaattcgcacgagaccattacctagaacatcctaatcgaaaaaaaaaccccgacgcgtccccacctccgtcgccgatgacaccgcgtgccccgcagcttcggcatcacccgccgcacctcctcctcgccgaggctgtcgcctcctggcaccccttccacaagaagccctgtctcacggaccgctccacggctcccccctcctcggcccgcctccctgatgcggagactccgacgcctgccctcttcggggggcggnagcggcggatccttcccggtggctcggggctcctcaaggggttccccctcgtccccctgtggggggggcgtacctgtgcgttcctacgcccacctccaacttgatgtccctgctcctgctcactcattcttcatcaatccacatgttaaacgatcctccggatacaattcttgtggtatacgatagtctttgcccccacacgctgttgttgcgacgcccggcccgtggcgcgacatgtcgtttttgttgtggttcctatgagtccaaagtgcctgaggggaaagggaagcttgggagtgtgtgttggtgtactattggttttgggcgggtcctctcctttttactacctacatttagggattgatcacccattagcgacaccaccctccgccaacgtgtcccgac

SEQ ID NO: 29406 - protein, 94 aa, Zea mays
  misc_feature: Ceres CLONE 1404215-F
  misc_feature (61)..(61): Xaa is any aa, unknown, or other
MTPRAPQLRHHPPHLLLAEAVASWHPFHKKPCLTDRSTAPPSSARLPDAETPTPALFGGRXRRILPGGSGLLKGFPLVPLWGGRTCAFLRPPPT

SEQ ID NO: 29407 - DNA, 652 bp, Zea mays
  misc_feature: Ceres CLONE 1404221-F
  misc_feature: Encodes the peptide sequence at SEQ ID NO. 29408
  misc_feature (365)..(365): n is a, c, t, g, unknown, or other
  misc_feature (463)..(463): n is a, c, t, g, unknown, or other
  misc_feature (473)..(473): n is a, c, t, g, unknown, or other
  misc_feature (474)..(474): n is a, c, t, g, unknown, or other
  misc_feature (477)..(477): n is a, c, t, g, unknown, or other
  misc_feature (582)..(582): n is a, c, t, g, unknown, or other
ggagctccccgcggtggcggccgctctagaactagtggatcccccgggctgcaggaattcgcacgagaccattacctcgaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtgncgccgctcctggtgctcaacctcatcatgtacatcatcgtcatcggcttcgcgagctggaacctgaacactttcatcacggcagacacttacccgggngtggcgaaannggngcgagtcaatttttcctggggtccctctggggggggcgggggggggggccccccccccccaccttgggggggggggcccccccggggcgccccctggggcccccngaaggcctgggcccccaccccccggggggtgttcttcttgcggtgggcccttccgggggcttcgctttcg

SEQ ID NO: 29408 - protein, 105 aa, Zea mays
  misc_feature: Ceres CLONE 1404221-F
  misc_feature (10)..(10): Xaa is any aa, unknown, or other
  misc_feature (46)..(46): Xaa is any aa, unknown, or other
  misc_feature (47)..(47): Xaa is any aa, unknown, or other
  misc_feature (82)..(82): Xaa is any aa, unknown, or other
MAGIGRNMVXPLLVLNLIMYIIVIGFASWNLNTFITADTYPGVAKXXRVNFSWGPSGGGGGGGPPPPPWGGGPPRGAPWGPXKAWAPTPRGVFFLRWALPGASLS

SEQ ID NO: 29409 - DNA, 550 bp, Zea mays
  misc_feature: Ceres CLONE 1404231-F
  misc_feature: Encodes the peptide sequence at SEQ ID NO. 29410
  misc_feature (52)..(52): n is a, c, t, g, unknown, or other
  misc_feature (234)..(234): n is a, c, t, g, unknown, or other
  misc_feature (306)..(306): n is a, c, t, g, unknown, or other
  misc_feature (331)..(331): n is a, c, t, g, unknown, or other
  misc_feature (369)..(369): n is a, c, t, g, unknown, or other
  misc_feature (377)..(377): n is a, c, t, g, unknown, or other
aaagctggagctccccgcggtggcggccgctctagaactagtggatcccccngggctgcaggaattcgcacgagaccattacctagaacatcctaatcgaaaaaaacaaatctcaacgaaacattgccgcctccccctgaccgcgccccactccccagacgccgtcgcctagatccatgagacttcccgatcttcctggcggcccgaggatgtcccagagcgacgtcgactacngttgcggatcttgtggataccctctaaacctttcatcttctaaccgaagcacatctgaaagtagctcatatnagaagtctctgaagaaaggactganttcatttcatttctgtgatctcagccgatttactcagntggacaangtatcttgctttcccctcacctggcgtgtttacgggccaaaacttagcttctgtgccgattatgtggggcatctatgggctacgatacggggagcggctggttttggggaaatttggaatccaagaaagttctctttcctccgaaactcccgaaagatttttaataagggtcc

SEQ ID NO: 29410 - protein, 113 aa, Zea mays
  misc_feature: Ceres CLONE 1404231-F
  misc_feature (9)..(9): Xaa is any aa, unknown, or other
  misc_feature (33)..(33): Xaa is any aa, unknown, or other
  misc_feature (41)..(41): Xaa is any aa, unknown, or other
  misc_feature (54)..(54): Xaa is any aa, unknown, or other
  misc_feature (56)..(56): Xaa is any aa, unknown, or other
MSQSDVDYXCGSCGYPLNLSSSNRSTSESSSYXKSLKKGLXSFHFCDLSRFTQXDXVSCFPLTWRVYGPKLSFCADYVGHLWATIRGAAGFGEIWNPRKFSFLRNSRKIFNKG

SEQ ID NO: 29411 - DNA, 683 bp, Zea mays
  misc_feature: Ceres CLONE 1404242-F
  misc_feature (157)..(157): n is a, c, t, g, unknown, or other
  misc_feature (160)..(160): n is a, c, t, g, unknown, or other
  misc_feature (161)..(161): n is a, c, t, g, unknown, or other
  misc_feature (179)..(179): n is a, c, t, g, unknown, or other
agagctggagctccccgcggtggcggccgctctagatactagtggatcccccgggctgcaggaattcgcacgagaccattacctgaacatcctaatcgaaaaaactacatcccacctacctcctcgcatcaggcaggcgggcctcgcgtttataagnaanncttcctctcctccagggncctcgccctggaaagcacagacacaaaccacgagcgcgaggcacgacctatatggaatcggccacgaaccaccatgtcggcctcacgcgcgctcctccccagcccgaaggggagccctgcgagcgcgcggggccgcgtgaccgcgcccgggccgccttcgctcacgctcaaggcgcgaggaggggcccgggcccaccacgggctcgcttctgcctcttcttattgtggttcgggccccgggcccggggcggcccactgatctcaaggggggggcccccagcaatcgggatggggggcccgcgccacgaagccgcttgcaaacccaaaccccggggccgcccgcggagaccaaaaacccttgaaccggggccgcgtcccggaaggggactgggctccggccccggaacacagggggttcgcgcccctacaggcgcgggtccccccccccggggagccccccccgccccaaggagcggggggtaaagtagggaacgcgcccccgca

SEQ ID NO: 29412 - DNA, 647 bp, Zea mays
  misc_feature: Ceres CLONE 1404247-F
  misc_feature: Encodes the peptide sequence at SEQ ID NO. 29413
  misc_feature (433)..(433): n is a, c, t, g, unknown, or other
  misc_feature (434)..(434): n is a, c, t, g, unknown, or other
  misc_feature (439)..(439): n is a, c, t, g, unknown, or other
  misc_feature (475)..(475): n is a, c, t, g, unknown, or other
aagctggagctccccgcggtggcggccgctctagaactagtggatcccccgggctgcaggaattcgcacgagaccattacctagaacatcctaatcgaaaaatccgacccagtatccccgacaaagtcaatgcgatgcgtctcctccttgctctatcgactatcgtagccgattccccgttgcaagtaactaaaactaagtctcaagtctgcagagtaaccggagtagcatagcactagcaagcaatggccgctctcacttccgctctcctcttcgccgccctcctcgtggccgcccagtacgtgctccgcttgctccactccttcctgtgggtcccgttccgcctggaacgccgcttccggcggcagggaatccggtggccagcacgaagcctggtctccggtaacgcagccgactaccgcgacctgctagnncgcgncaggtccgcgcccctctcctcctttcgcacaacggngtcgtcgcccgcgccacgccgaagtacgcggtctggctggcgcgtaacggccggccgttcgtgtaactggttcggccccgggccgcggttggtgatctccgacacggagctcgggaaggccgtgatgaccgactccccgggggggcttttgataagggggccctccggcggg

SEQ ID NO: 29413 - protein, 134 aa, Zea mays
  misc_feature: Ceres CLONE 1404247-F
  misc_feature (63)..(63): Xaa is any aa, unknown, or other
  misc_feature (65)..(65): Xaa is any aa, unknown, or other
  misc_feature (77)..(77): Xaa is any aa, unknown, or other
MAALTSALLFAALLVAAQYVLRLLHSFLWVPFRLERRFRRQGIRWPARSLVSGNAADYRDLLXRXRSAPLSSFRTTXSSPAPRRSTRSGWRVTAGRSCNWFGPGPRLVISDTELGKAVMTDSPGGLLIRGPSGG

SEQ ID NO: 29414 - DNA, 721 bp, Zea mays
  misc_feature: Ceres CLONE 1404248-F
  misc_feature: Encodes the peptide sequence at SEQ ID NO. 29415
  misc_feature (14)..(14): n is a, c, t, g, unknown, or other
  misc_feature (362)..(362): n is a, c, t, g, unknown, or other
  misc_feature (404)..(404): n is a, c, t, g, unknown, or other
  misc_feature (474)..(474): n is a, c, t, g, unknown, or other
  misc_feature (500)..(500): n is a, c, t, g, unknown, or other
  misc_feature (612)..(612): n is a, c, t, g, unknown, or other
  misc_feature (634)..(634): n is a, c, t, g, unknown, or other
  misc_feature (648)..(648): n is a, c, t, g, unknown, or other
ttggattgcccccnccccccctcgcccccccccgccgcccatgatgcccccccccaaaactggagctccccgcggtggcggccgctctcccatagtggatcccccgggctgcaggaattcgcacgagaccattacctagaacatcctaatcgaaaaaccatcatcgctcgctcttctcttggacttgcaactccagtgctgctcactgccactgccagtagatcgagctgctccgcctcactagccctcttgctttgctgctgcacctgcaagtctgcaaccgcgcacagagagatgtcgacggagagccgtgcgtccctcgaccagaagctcgccctcgccaagcgctgctcccgagaggngaccctcgccggagccaaggcggcagcggtggcgactatcgnctccgcgatccccaccctggccagcgtgcggatgctgccatggggcaagggcaacatcaaccccaccggncaggcgctcatcgtctccacgggggntgggatggcatacttcatcgccgccgacaagaagatcctgtcgctggcgacgcgccactcgttcgaccaagcccctgagcacctcaagatcacctccttccagggtcccggnccgcccccacccggatttcttnaggcagcgacacgnggccctccggtcgaggtaggatacctacctcctttccagtccgattcgtcagtgcaaaatcaacacccaatgt

SEQ ID NO: 29415 - protein, 142 aa, Zea mays
  misc_feature: Ceres CLONE 1404248-F
  misc_feature (11)..(89): Pfam Name: ENOD93 Pfam Description: Early nodulin 93 ENOD93 protein
  misc_feature (23)..(23): Xaa is any aa, unknown, or other
  misc_feature (37)..(37): Xaa is any aa, unknown, or other
  misc_feature (69)..(69): Xaa is any aa, unknown, or other
  misc_feature (114)..(114): Xaa is any aa, unknown, or other
MSTESRASLDQKLALAKRCSREXTLAGAKAAAVATIXSAIPTLASVRMLPWGKGNINPTGQALIVSTGXGMAYFIAADKKILSLATRHSFDQAPEHLKITSFQGPGPPPPGFLXAATRGPPVEVGYLPPFQSDSSVQNQHPM

SEQ ID NO: 29416 - DNA, 697 bp, Zea mays
  misc_feature: Ceres CLONE 1404249-F
  misc_feature (20)..(20): n is a, c, t, g, unknown, or other
cctgctggagcttactgcgntggcggccgctctagaactagtggatcccgcgggctgcaggaattcgcacgagaccattacctagaacatcctaatcgaaaaaaattcaatccggtctcagtggttggcccgccgctgccagtgccagatcgaatcggactctcggctcgtgtgcagcccaccggcgagacgccgaagctatatttttatgcccatctgatccgatgcgtggtgcggcgtcgcctccgcttctactacatcctcagcagccagcccaccacccgcgcccggtcaccccccgcccaagactttcccgttcttcttaccgaggatttaaaatataatattctccaccccccccccccccccccgggggggggggggggggttcccccaaacccctcccacccaaccctccccccccccctcacctccccatacttcctaccgctcccccccacccccttcttccctcactccctcaccccccccccctccctccacctccccccttctctcccccccctaattctccccctctcccctaccccttctccccccccttttacctccctatccactcctagtttgatttccacccccccacacccctctccactctcgcctgtcactctcctagtatatcccgccctctcactttcgtcccaaccctcttccattcccctccccctccccc

SEQ ID NO: 29417 - DNA, 703 bp, Zea mays
  misc_feature: Ceres CLONE 1404258-F
  misc_feature: Encodes the peptide sequence at SEQ ID NO. 29418
  misc_feature (703)..(703): n is a, c, t, g, unknown, or other
gctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggagggacggagtggtcgaacgggaccgcaaggaggacctgcggtggtgcaaggaggcgtgccgagtggcagtagggggggggacaccccgcgcaagagggaatgcgtagagcgagtgcccccgagcgggccccagcctagcttgacgcgctccgaggactggcttaatgccttccgggtaactcctcacttctccctgttccggtctaggagtttaaatatcctctccccctggctcttgcgccgtcccctcgggtcccatgcggtgcgccggatcgtggagcgggcggggtggcgatgcccgcccgcgggccgacctggcctaccccatgcgcccgtcgggtatgcggttcgtgctcgctcccccctctcgccgcgccagctttctactctcccgtccctattccttccccgtccccgcgcctaatgtn

SEQ ID NO: 29418 - protein, 170 aa, Zea mays
  misc_feature: Ceres CLONE 1404258-F
MGKGSVGASWWAFLLLAGVLLVVAATAGAEGRSGRTGPQGGPAVVQGGVPSGSRGGDTPRKRECVERVPPSGPQPSLTRSEDWLNAFRVTPHFSLFRSRSLNILSPWLLRRPLGSHAVRRIVERAGWRCPPAGRPGLPHAPVGYAVRARSPLSPRQLSTLPSLFLPRPRA

SEQ ID NO: 29419 - DNA, 619 bp, Zea mays
  misc_feature: Ceres CLONE 1404259-F
  misc_feature: Encodes the peptide sequence at SEQ ID NO. 29420
  misc_feature (298)..(298): n is a, c, t, g, unknown, or other
  misc_feature (326)..(326): n is a, c, t, g, unknown, or other
  misc_feature (332)..(332): n is a, c, t, g, unknown, or other
  misc_feature (337)..(337): n is a, c, t, g, unknown, or other
  misc_feature (415)..(415): n is a, c, t, g, unknown, or other
  misc_feature (420)..(420): n is a, c, t, g, unknown, or other
  misc_feature (456)..(456): n is a, c, t, g, unknown, or other
  misc_feature (495)..(495): n is a, c, t, g, unknown, or other
tggagctccccgcggtggcggccgctctagaactagtggatcccccgggctgcaggaattcgcacgagaccattacctagaacatcctaatcgaaaaaggattagtttgaccccctccagtacgtccgcaccgcaaggcctctcgccgtccttggacattctccgtccgtcgcctttgcctggggcagataacaatatctgatatccctgggccttcgccgtccgggcccccctaccttctctcatccgtcctcacacaaagcagaagggggaggagttttaggggaggagggggcgncaggaggagccattattatttcttcttncagcgncattncctgggccaccaccggcgcgctatattactcccgggttcgtggaccagcatgcagaagggcgtgtccttccctggcgnaatgncgaaggagtgcccgcccgccgagctctgcctcccgnacgagttcctggacgacgacttcttctcccgaggagagnaggcggcggtcgcggccaagagcgagagcgacgaggagaaggggatgggacgcctctcgcaccgcgcggccgggctcgtcgtcgggggtggaggggacggctcccctgcaaaggcgcaagggta

SEQ ID NO: 29420 - protein, 77 aa, Zea mays
  misc_feature: Ceres CLONE 1404259-F
  misc_feature (10)..(10): Xaa is any aa, unknown, or other
  misc_feature (12)..(12): Xaa is any aa, unknown, or other
  misc_feature (24)..(24): Xaa is any aa, unknown, or other
  misc_feature (37)..(37): Xaa is any aa, unknown, or other
MQKGVSFPGXMXKECPPAELCLPXEFLDDDFFSRGEXAAVAAKSESDEEKGMGRLSHRAAGLVVGGGGDGSPAKAQG

SEQ ID NO: 29421 - DNA, 664 bp, Zea mays
  misc_feature: Ceres CLONE 1404263-F
  misc_feature: Encodes the peptide sequence at SEQ ID NO. 29422
  misc_feature (434)..(434): n is a, c, t, g, unknown, or other
  misc_feature (435)..(435): n is a, c, t, g, unknown, or other
aaagctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgactcacggnnttttttttgggcgcgccgccccgcaatcgcgttgcgcttcatggccggcccgggttcgtcacctccggggggcctcggcgccgctgcggctgtccgtgttcctcctggaatgtacaaggtacctgacgggcaagcacccgcccgggcgccgaccagctggaccacgccaaaggcgaggcttggcgtccaaggcccgcgacatcaaggatgcagcacagcaccgcatcgc

SEQ ID NO: 29422 - protein, 155 aa, Zea mays
  misc_feature: Ceres CLONE 1404263-F
  misc_feature (36)..(151): Pfam Name: Oleosin Pfam Description: Oleosin
  misc_feature (80)..(80): Xaa is any aa, unknown, or other
MADHHRGATGGGGGYGDLQRGGGMHGEAQQQQKQGAMMTALKAATAATFGGSMLVLSGLILAGTVIALTVATPVLVTHGXFFGRAAPQSRCASWPARVRHLRGASAPLRLSVFLLECTRYLTGKHPPGRRPAGPRQRRGLASKARDIKDAAQHRI

SEQ ID NO: 29423 - DNA, 636 bp, Zea mays
  misc_feature: Ceres CLONE 1404265-F
  misc_feature: Encodes the peptide sequence at SEQ ID NO. 29424
agtggatcccccgggctgcaggaattcgcacgagaccattacctagaacatcctaatcgaaaaatcgtacatattattgccaccacctagctccatagataagcacaatactctagctacaatggcactacctaagattctgctcgcattatgccacttcctccctttctgcatgcgctggctaccgcaaagcatttttccacagtgagtcacaaatgtactatagcttattcttcgtctcccagacctatgcctccctgaagtccgcagtatgtgaaaacacaattgactcactgctacagagactctataggcaatcgacacagacatcgtactcattatccaccttgttacttaagcttgcgaaatgccgaatacaacgcttacctttgaggcctctggtgccacgaccgtcaggacatcgcaagtaacccaacttgtgatagcaaacgttgctgcatactctcaatgccctcaggctcatccattcaagcaactgactgcgtcgatatctgctgctgatatgcgaaggccgtgatcattcacacagttaagtgctgtctacccacggcaatttctctccttgaaacaactatagccaatggacgtctgctgcttatctacaggaacaagaat

SEQ ID NO: 29424 - protein, 56 aa, Zea mays
  misc_feature: Ceres CLONE 1404265-F
MPNTTLTFEASGATTVRTSQVTQLVIANVAAYSQCPQAHPFKQLTASISAADMRRP

SEQ ID NO: 29425 - DNA, 689 bp, Zea mays
  misc_feature: Ceres CLONE 1404269-F
  misc_feature: Encodes the peptide sequence at SEQ ID NO. 29426
  misc_feature (405)..(405): n is a, c, t, g, unknown, or other
  misc_feature (406)..(406): n is a, c, t, g, unknown, or other
  misc_feature (432)..(432): n is a, c, t, g, unknown, or other
  misc_feature (433)..(433): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (445)..(445): n is a, c, t, g, unknown, or other
  misc_feature (452)..(452): n is a, c, t, g, unknown, or other
  misc_feature (464)..(464): n is a, c, t, g, unknown, or other
  misc_feature (599)..(599): n is a, c, t, g, unknown, or other
aaagctggagctccccgcggtggcggccgctctagaactagtggatcccccgggctgcaggaattcgcacgagaccattacctagaacatcctaatcaaaaaaaatcctccgaaccccgccgccgacgagcgagctatggcgctggcgcggcggctgctccgccttactccctacctcggcacgctctcgctcccaccccccaactcgcatctcctccggaatcgcacctatatctctgacatgcgccgctctgccttcgtcgaccgcttgctccgttccgtacgctccgagatctccttcctcgataactccgccccgccaccgccaccaccgcctcctaagccattcaccattgaggaccgcccgggcgagcagtgggcccgcctgcgccgggtctgcggggnncccaaggagggaaaaaaaaaaaaaannaaannnggaaangccacgnttggtcgaaggngcgctccctccctcccgctcgggcgcggacacgggcggcccgcccagaatgcatatcagtgttaaaggttgaggtctccaaggccgcgccggcctggagtggcgctcaccttcgagtgctccgcgtggcctgacnagatggaggtgcggagggtctttcccgtccgccgcggggggcctgccccagtgcagcaggacgtcggccgccaattcaggcttcccaagg

SEQ ID NO: 29426 - protein, 29 aa, Zea mays
  misc_feature: Ceres CLONE 1404269-F
MEVRRVFPVRRGGPAPVQQDVGRQFRLPK

SEQ ID NO: 29427 - DNA, 704 bp, Zea mays
  misc_feature: Ceres CLONE 1404279-F
  misc_feature (237)..(237): n is a, c, t, g, unknown, or other
  misc_feature (295)..(295): n is a, c, t, g, unknown, or other
  misc_feature (368)..(368): n is a, c, t, g, unknown, or other
  misc_feature (378)..(378): n is a, c, t, g, unknown, or other
  misc_feature (385)..(385): n is a, c, t, g, unknown, or other
  misc_feature (462)..(462): n is a, c, t, g, unknown, or other
aagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacnagcggcggctgcggctgccagccaccgccgccggttcatctaccgccgcccggtgcantctgccacctccggttcacctggccacctccggtgcatctccccaccgccggtccactgggcccgccgccggntccactgttncaccggnccggtccatgtgtcccccccccccggtttcatcttggccggcggccaacatggccactaacccctaactcaaacggnccccgggcctcagccctcatcccccagccacaccccaatggcccggtggccaacagccgcattcccagcccgtgggcaggcttgcaaggaaacttgggggggggggtgggcagacccccgatcctggggccagaggggggttaaaaagttcttaaggggaacacggggaacccccaaggggaaaacccctacggggtctcctcaagggccaatcgttggggggaaaaaatggtttccacaac

SEQ ID NO: 29428 - DNA, 693 bp, Zea mays
  misc_feature: Ceres CLONE 1404281-F
  misc_feature: Encodes the peptide sequence at SEQ ID NO. 29429
  misc_feature (163)..(163): n is a, c, t, g, unknown, or other
  misc_feature (429)..(429): n is a, c, t, g, unknown, or other
  misc_feature (435)..(435): n is a, c, t, g, unknown, or other
  misc_feature (559)..(559): n is a, c, t, g, unknown, or other
  misc_feature (693)..(693): n is a, c, t, g, unknown, or other
aaagctggagctccccgcggtggcggccgctctagaactagtggatcccccgggctgcaggaattcgcacgagaccattacctagaacatcctaatcgaaaacacatcgagttcttcttctcggttctcaatttccacgataaaatggtgaccggcgacgtanagctgattggctcatgggctagtgtcttcgtcatgagggccagaatcgctctcaacctcaaatctattaggtacgagtttctccaggagacatacggtactaagagcgagttgctccttaaatctaatcccgttcacaagaaagatcccggttctgattcacgatgacaaatcccgtgtgtgagtccaacatcatcgttcagtacatcgacgaggcttggagctcatatggaccgtctattctcccttcccagccctacgacgagncatcgnctcggttctgggccgcctacgcgaacgaataagtggtttattgctctgagaagtatcctaaccgctcgagggagaagaggagaagaaagcagccatagctgaaggtcgaaggaaggactgaccnatttagagaaagccttcatcgagtgcagaaatgggaaacccgttcttcacggggacccatatcggttacctagactttgcccagggagcttttcttggttttggtggaaaaagcctgggagttagacgccaatn

SEQ ID NO: 29429 - protein, 61 aa, Zea mays
  misc_feature: Ceres CLONE 1404281-F
  misc_feature: SWISSPROT Homolog: EC 4.4.1.5 Lactoylglutathione lyase
  misc_feature (7)..(7): Xaa is any aa, unknown, or other
MVTGDVXLIGSWASVFVMRARIALNLKSIRYEFLQETYGTKSELLLKSNPVHKKDPGSDSR

SEQ ID NO: 29430 - DNA, 691 bp, Zea mays
  misc_feature: Ceres CLONE 1404284-F
  misc_feature (275)..(275): n is a, c, t, g, unknown, or other
  misc_feature (471)..(471): n is a, c, t, g, unknown, or other
tggagctccccgcggtggcggccgctctagaactagtggatcccccgggctgcaggaattcgcacgagaccattacctagaacatcctaatcgaaaaacctggtcgttctatcgcaggtgcaaaaatcgattcaggggcagtctagcattaatggccatgactctacgagtgcaatcgagagagcgatcctcttccgcgactatcgcgcattgtgacgctggtctgctcgtgacggtcctctgctccgcggtggctactttctctcgggctcggngccgcgagtggctctcgcgccttgctgccatactgcgggtttgccgactctgtctgtggacgactctgagaataattatctcgtgaccacggcgggcgccgacgcggcgccgataaggatcgacttcccaaggcacctgcctacgtcatgactctccaactcctgcaggatcccggagatcattgaccgagtgacngggctcgcagaccgggttgacgtatatgagctggaacatctgcggggagcagctgctcgtctgcgcctatttacggagcgtgcggtgacggaatcctcaacgctgcggaataaggggtcgtgagcatcatgcgggtatcgggcagaagcctgcacaacttccaggacaccaagcagagggttgggccggggtattaaccgcggacgagacaggcaaaagc

SEQ ID NO: 29431 - DNA, 680 bp, Zea mays
  misc_feature: Ceres CLONE 1404286-F
  misc_feature: Translation starting site: 184
  misc_feature: SWISSPROT Homolog: EC 5.3.1.1 Triose-phosphate isomerase
  misc_feature (559)..(559): n is a, c, t, g, unknown, or other
  misc_feature (612)..(612): n is a, c, t, g, unknown, or other
tggagctccccgcggtggcggccgctctagaactagtggatcccccgggctgcaggaattcgcacgagaccattacctagaacatcctaatcgaaaaactcacgaacgcacgaattcaccaaccaaactccactgtctccaactctccatcgcgtctgctacgcctctcctgcaggacgaccaatggcttccaggaagttcttcgtgggtggcaactggaaatgcaacggtactggcgaggacgtgaagaagatcgtcaccgtgctcaaccaagccgaggtgccctctgaagacgtcgtcgaaggtggtggtgagtccgccctttcgtttttctgcagcaggtcaaggggctgctgcggtggggacttcgccgtcgcagcgcagaactgctgggtgcgcaagggcggcgcctcaaccggcgaaatcagtgctgagatgctgtaaaacctgcaggtgccctggggtcattttgggacattctgagcgcagagctctgttgggtgaacccggtggattttgttgctgataaagttgcatatgcactcactcaaggtctcanggtaattgcttttgcattggtgagacccttgagcagagagagcaggaccaccnattgggatgttgtttgctgcacaaacaaaggctattgctgaaaaaatatcagatggacaaaattattg

SEQ ID NO: 29432 - DNA, 677 bp, Zea mays
  misc_feature: Ceres CLONE 1404292-F
  misc_feature: Encodes the peptide sequence at SEQ ID NO. 29433
  misc_feature (553)..(553): n is a, c, t, g, unknown, or other
aaagctggagctccccgcggtggcggccgctctagaactagtggatcccccgggctgcaggaattcgcacgagaccattacctagaacatcctaatcgaaaactttcctctccgatccggatctccccacccgctccggcgagacatcgccgcgtcgcctccacgcgaccgactacttctcatatcaatctatctatccggcttacccgccgccgcacgcaccaaggttgcgctcaccatattacctgtttgcttatcttctcccgagcccagcaaaccctagccgccgccacccatggacatagaggccgacggacgattcgccaacaaacgagtgcacaatcgcctaggcccggtctccggcgtcgctccaccatctaccaacggaaaggtctgcaactactgacgtgccggtcggggcaaccgctttccgtggcccttcctccacagagagctccccgaggctgctccgcccaagcgccccactggacccggggaggaacgtatggcgcaacctcaacaccggtagacgaggaggtggccatcacaatanatgggggaagggcccaggagggggcagcgaaattggaagccacaagccgcctgagaggccctgcaagaactttctcgccgggaccggaaggtacctattggcgagagggggcggctatccgccg

SEQ ID NO: 29433 - protein, 36 aa, Zea mays
  misc_feature: Ceres CLONE 1404292-F
MDIEADGRFANKRVHNRLGPVSGVAPPSTNGKVCNY

SEQ ID NO: 29434 - DNA, 617 bp, Zea mays
  misc_feature: Ceres CLONE 1404298-F
  misc_feature: Translation starting site: 273
  misc_feature (358)..(358): n is a, c, t, g, unknown, or other
  misc_feature (364)..(364): n is a, c, t, g, unknown, or other
  misc_feature (365)..(365): n is a, c, t, g, unknown, or other
  misc_feature (374)..(374): n is a, c, t, g, unknown, or other
tggagctccccgcggtggcggccgctctagaactagtggatcccccgggctgcaggaattcgcacgagaccattacctagaacatcctaatcgaaaagtttcttggatagtccgtagccgcttgccctgttcgcatcttcgcgcgtggcgcacaccgctccagctctccttcgacgggcacggccgagccgccttcgtcttggccgcagcggtgcgcgctctccatggcgtcctaattagcctagccgcaacgccgcgcccgtgcctgcggcatggatgaaccccttcttggcaatggtcttaagaccagcgggaaaagagagagcctgggtagtggccgaggtcagaaaaacagatngtaccnnttgctgggnccactcatcgctgcatggatcctacagaacattgtcagatgtatctaatcatgtttggtcgtcactttggtgagcttgccctctccagtggctcatcgcacctcctttgcaggcggtactgcttcagcttattgtctggcatgccagagaactggaaaccactgggtgggcaatcggtcggggaaagagaaaacaatcttcttggaatcaacaaaggaggggcaaaccttgggcccccttaaa

SEQ ID NO: 29435 - DNA, 627 bp, Zea mays
  misc_feature: Ceres CLONE 1404300-F
  misc_feature: Encodes the peptide sequence at SEQ ID NO. 29436
  misc_feature (527)..(527): n is a, c, t, g, unknown, or other
  misc_feature (534)..(534): n is a, c, t, g, unknown, or other
  misc_feature (565)..(565): n is a, c, t, g, unknown, or other
aagctggagctccccgcggtggcggccgctctagaactagtggatcccccgggctgcaggaattcgcacgagaccattacctagaacatcctaatcgaaaaatgttctgcctccgcaccctccgatcgcccgccgcgtccgattcccctgaccccgcctcgccctcaatctccgccgccgcgcccgcgacatccatcacccccgcccgcgacatcccgcctcgcacgccatcaactcacagcggcccttctccgaacgtggtttgttttttcgtttgctcgagcagccagccgactcgtctccagcaatgcggccggggtcggctcgctggaggtgggcgccgccgccgacacctccaacgcctccaagcagggattaggtgagccgtcggctaatcactcgtcattgggaggatctcctcctcccgttcagatttgggcaagaaaggcccgggcgcgatgtccatggccgaggaggggagtgaggccgaggcgctcgagaaagacggcagcaaggcttcttcaccnttcgggncagttaggcgttcctgccgctcttcttcctnccgtgtcgtcagaggaagccgcgaaaagacgcgggaatcaggcgggtcttgaggacgaggag

SEQ ID NO: 29436 - protein, 52 aa, Zea mays
  misc_feature: Ceres CLONE 1404300-F
  misc_feature (26)..(26): Xaa is any aa, unknown, or other
  misc_feature (36)..(36): Xaa is any aa, unknown, or other
MSMAEEGSEAEALEKDGSKASSPFGXVRRSCRSSSXRVVRGSREKTRESGGS

SEQ ID NO: 29437 - DNA, 824 bp, Zea mays
  misc_feature: Ceres CLONE 1404308-F
  misc_feature (824)..(824): n is a, c, t, g, unknown, or other
gcccccccccgcaacccctcccctcccctccctcccccatacctgcaaagctgtgactccccgcggaggggggcgctctatactagtggatcccccgggctgcaggaattcgcacgagagcattacctagaacatcctaatcgaaaaaagatgaccctaggaaacccaccctccctccagtgtcctcgacccccgccgccgcggtcgcgatcacagcccagaggacgccctccccaccccagactgtcccgatggctgcggacgccgccgctgcggcgatgtgagcgacttccctctgcgacgatctaaagcccgccaccgcgcgcacccgcatccgcgatgtcccggccgcaagtgccgcgggtgccggggaccgcgtcgaggacggcggctgggaccgaactggcctggagaaggccaaggcctcttgcgccttccgggatggtcaaagatgggagcctgcccctcgccacgctacaagccaacgctgacgaagtggtgcaacctcgtagggcgcggcacggggcaacggtaacttccgaccctcgaagaggcttttggtaaagggagcggcccgcccgcggcccaagccaaccccgcccgacgcaggaagggcccagctgcaggggatggacgggtcggggaagggtggtaggaccgacggtctgacccgagtggcctatgggggagaggttcaaatctctacgctcgcagaaagcacccagggtaccgaatacatccagctcccgagcctcgaaccgccccaccaactctcttggtaaaagacgtccgatcaacagacttaacggtccaccccattatan

SEQ ID NO: 29438 - DNA, 648 bp, Zea mays
  misc_feature: Ceres CLONE 1404309-F
  misc_feature: Encodes the peptide sequence at SEQ ID NO. 29439
  misc_feature (455)..(455): n is a, c, t, g, unknown, or other
  misc_feature (496)..(496): n is a, c, t, g, unknown, or other
  misc_feature (511)..(511): n is a, c, t, g, unknown, or other
  misc_feature (512)..(512): n is a, c, t, g, unknown, or other
  misc_feature (586)..(586): n is a, c, t, g, unknown, or other
  misc_feature (620)..(620): n is a, c, t, g, unknown, or other
aagctggagctccccgcggtggcggccgctctagaactagtggatcccccgggctgcaggaattcgcacgagaccattacctagaacatcctaatcgaaaaatcccacgctgccctcggcgctgcgcctggccccggcacctacctcccccctccccacctcgccgccggcgggtggagtcgggctggagcagccgctctcctctgttaccccctaaccccctataaagaaaaagaaaaaaacagagagagagcgagcgaccggcggctcggcagccatggggcacggcgtcagctgcgcccgcaccggtgacgagcacgactacttccgcgcggcgcaggtcggggacctcgaggccctggaagcgctcctcgacgctgacccctcccttgcccgccgcgccacgctctacgaccgcctctccgcgctccacatcgccgccgcgaatggcccgnctcgaggtgctgtcaatggtcttggaatcacggggtgccgnccggacgtggtgaannctccctgcgggccggcgccaatatccctcatgttcgactcccaaggacggggcggacctgccctggcacacgcngtcctacttcggcccacgtcgggctgcctgcagncatcctcacggggcgggggggaaccacg

SEQ ID NO: 29439 - protein, 123 aa, Zea mays
  misc_feature: Ceres CLONE 1404309-F
  misc_feature (60)..(60): Xaa is any aa, unknown, or other
  misc_feature (78)..(78): Xaa is any aa, unknown, or other
  misc_feature (79)..(79): Xaa is any aa, unknown, or other
  misc_feature (115)..(115): Xaa is any aa, unknown, or other
MGHGVSCARTGDEHDYFRAAQVGDLEALEALLDADPSLARRATLYDRLSALHIAAANGPXRGAVNGLGITGCRPDVVXXPCGPAPISLMFDSQGRGGPALAHAVLLRPTSGCLQXSSRGGGEP

SEQ ID NO: 29440 - DNA, 609 bp, Zea mays
  misc_feature: Ceres CLONE 1404312-F
  misc_feature: Encodes the peptide sequence at SEQ ID NO. 29441
  misc_feature (225)..(225): n is a, c, t, g, unknown, or other
  misc_feature (242)..(242): n is a, c, t, g, unknown, or other
  misc_feature (329)..(329): n is a, c, t, g, unknown, or other
  misc_feature (374)..(374): n is a, c, t, g, unknown, or other
  misc_feature (380)..(380): n is a, c, t, g, unknown, or other
cgctctagaacaggtggatcccccgggctgcaggaattcgcacgagaccattacctagaacatcctaatcgaaaatcaagccaacagcttccgaaaagtttccgaaagctccttcagatctgttggttaatggatacactcatcctgtacctatgtctactgctggctggccaaccaatgctagtttagtgcctgttcagagcactggatcaatgactgcaactnggttggcacccaatggntggtcaaatgcttttccaagtactgcatctctatcagctgctggtaattacaacattaaccagtcgcttcccaggtcttccgttggntgggctgtcaatggtgagcaaagtgttattcctagcattgctccnagattngaactcgtgcagcctgttgaagagcctgttttcagctcaacaagcagtggtgacaagcatggtggtactcagcacaagcacacaaggttacttttccccaaatgtatgtctgaaccattgtatctgcatcaatggtccaacgtttcagtagcactgattattcgaaaattctcagtgaacagaaatgctctttagggatggactgaatactgccaactaaactggaaat

SEQ ID NO: 29441 - protein, 140 aa, Zea mays
  misc_feature: Ceres CLONE 1404312-F
  misc_feature (25)..(25): Xaa is any aa, unknown, or other
  misc_feature (76)..(76): Xaa is any aa, unknown, or other
MSTAGWPTNASLVPVQSTGSMTATXLAPNGWSNAFPSTASLSAAGNYNINQSLPRSSVGWAVNGEQSVIPSIAPRXELVQPVEEPVFSSTSSGDKHGGTQHKHTRLLFPKCMSEPLYLHQWSNVSVALIIRKFSVNRNAL

SEQ ID NO: 29442 - DNA, 636 bp, Zea mays
  misc_feature: Ceres CLONE 1404315-F
  misc_feature: Encodes the peptide sequence at SEQ ID NO. 29443
  misc_feature (245)..(245): n is a, c, t, g, unknown, or other
aaagctggagctccccgcggtggcggccgctctagaactagtggatcccccgggctgcaggaattcgcacgagaccattacctagaacatcctaatcaaaaaacggtttgcgtataaataagtagtcagtcgctcatcttgttccttgtgaacatcgcagtgctgtagcctccttcgtcttgagcgagcatggagatgtcagccatggaggaagccctccccaaggcgatggagaggaggaaggnagtcctcaaaaccattccgctcatcatcttaaacgagatattcgagaaggtgcccacgttcgtgctggccggcaacatgatcctgtacctcaccgagcgttatctcatgaccaacgcctttgccaccgtcgtcctctacttctgggatgccttctccaacttcctgcccatcttaggcgccgtgctcgccgacgcccgcctcggccggttccgggtcatcaccctcggctcctgcgttagcctcttccggatgtggctgctgtgcctgacggcgatccttccggtgtacaagaacaccccgcagtgcgcaccggtccggccggaaagggggggcgcggttccgtggaagctgccggtccactttcaaggcttccgggacagtcccccaggt

SEQ ID NO: 29443 - protein, 149 aa, Zea mays
  misc_feature: Ceres CLONE 1404315-F
  misc_feature (19)..(19): Xaa is any aa, unknown, or other
MEMSAMEEALPKAMERRKXVLKTIPLIILNEIFEKVPTFVLAGNMILYLTERYLMTNAFATVVLYFWDAFSNFLPILGAVLADARLGRFRVITLGSCVSLFRMWLLCLTAILPVYKNTPQCAPVRPERGGAVPWKLPVHFQGFRDSPPG

SEQ ID NO: 29444 - DNA, 649 bp, Zea mays
  misc_feature: Ceres CLONE 1404316-F
  misc_feature: Encodes the peptide sequence at SEQ ID NO. 29445
  misc_feature (591)..(591): n is a, c, t, g, unknown, or other
  misc_feature (592)..(592): n is a, c, t, g, unknown, or other
  misc_feature (649)..(649): n is a, c, t, g, unknown, or other
tggagctccccgcggtggcggccgctctagaactagtggatcccccgggctgcaggaattcgcacgagaccattacctagaacatcctaatcgaaaaaggaatggcgtacgcggcggggcggaagaagcgggtgggccgctacgaggtgggccggaccatcggccagggcaccttcgccaaggtcaagttcgccgtcgacgccgacaccggcgcgcccgtcgccatgaaggtgctcgacaaggagaccatcttcgcccaccgcatgctccaccagatcaaaagggaaatatcaatcatgaagatcgtaagacatcccaacatagtcaggcttaatgaggtgttggcagggaagacgaagatatacataatcttggaacttgtcaatggaggcgaactgtttgataaaatagcccgatatgggaagctacgtgagaatgaagccaggaagtatttccagcagcttattgatgccattgattattgccacagcaaaggagtttatcatagggatttgaagcctgaaaatatgcttcttgactcacgtgaaaacttaaaaggtttctgagttttgactttagtacactgtctcnnaaatgggagcagggacttctttcacacaacatgtgggacaccaaaattatgttgccn

SEQ ID NO: 29445 - protein, 154 aa, Zea mays
  misc_feature: Ceres CLONE 1404316-F
  misc_feature (14)..(154): Pfam Name: Pkinase Pfam Description: Protein kinase domain
  misc_feature: SWISSPROT Homolog: EC 2.7.11.1 Non-specific serine/threonine protein kinase
MAYAAGRKKRVGRYEVGRTIGQGTFAKVKFAVDADTGAPVAMKVLDKETIFAHRMLHQIKREISIMKIVRHPNIVRLNEVLAGKTKIYIILELVNGGELFDKIARYGKLRENEARKYFQQLIDAIDYCHSKGVYHRDLKPENMLLDSRENLKGF

SEQ ID NO: 29446 - DNA, 670 bp, Zea mays
  misc_feature: Ceres CLONE 1404322-F
  misc_feature: Encodes the peptide sequence at SEQ ID NO. 29447
  misc_feature (394)..(394): n is a, c, t, g, unknown, or other
  misc_feature (400)..(400): n is a, c, t, g, unknown, or other
  misc_feature (418)..(418): n is a, c, t, g, unknown, or other
  misc_feature (421)..(421): n is a, c, t, g, unknown, or other
  misc_feature (437)..(437): n is a, c, t, g, unknown, or other
  misc_feature (438)..(438): n is a, c, t, g, unknown, or other
  misc_feature (507)..(507): n is a, c, t, g, unknown, or other
gctcttaactagtggtcccccgggctgcaggattcgcacgagaccattacctagaaatcctaatcgaaaagtctgtctgtctgcctccctccgctcacctcctctgcttcttctcgctttcttccatcttggtccagcctccactcttcctgctgagccatggcggctgccgaagaagggccagagccactcaggtatcagactctggccctgagggtgagcatccactgcgagggttgcaagaagaaggtgaagaaggtgctccacagcatagaaggggtgtacaagacggacatagacacgcagcagcagaaggtggtggtcataggcaacgtctctgcagacgcgctcgtcaagaagctccctcagtccgggaagcacgcggagccgtggncggagnctgctcccagcccacggncgncgacagcccgcccggnnccgacggatctcccggaagcgcagggcagaagaagaaaagaagaaggggcacaagagccccgaggcgcngaacaacaagcccgccgatccggggccaggggccgggccgggggcgggggaaggggaacgggggacccaaccccccggaggaaaccgaaaaggtggagggggggcgccccgggggaggagggatcggatgggggaggcaggaaaaccctgagggttggcgggg

SEQ ID NO: 29447 - protein, 170 aa, Zea mays
  misc_feature: Ceres CLONE 1404322-F
  misc_feature (17)..(77): Pfam Name: HMA Pfam Description: Heavy-metal-associated domain
  misc_feature (79)..(79): Xaa is any aa, unknown, or other
  misc_feature (81)..(81): Xaa is any aa, unknown, or other
  misc_feature (87)..(87): Xaa is any aa, unknown, or other
  misc_feature (88)..(88): Xaa is any aa, unknown, or other
  misc_feature (93)..(93): Xaa is any aa, unknown, or other
MAAAEEGPEPLRYQTLALRVSIHCEGCKKKVKKVLHSIEGVYKTDIDTQQQKVVVIGNVSADALVKKLPQSGKHAEPWXEXAPSPRXXTARPXPTDLPEAQGRRRKEEGAQEPRGAEQQARRSGARGRAGGGGRGTGDPTPRRKPKRWRGGAPGEEGSDGGGRKTLRVGG

SEQ ID NO: 29448 - DNA, 621 bp, Zea mays
  misc_feature: Ceres CLONE 1404324-F
aaagtggagctccccgcggtggcggccgctctagaactagtggatcccccgggctgcaggaattcgcacgagaccattacctagaacatcctaatcgaaaagacgacgagataaagaagagaacccaccaaatcaaaggcggacacatcgccacatcctccattccgccttctcggctcctccccacctggccaccactaccacctcccgtctcctcgcctccttccaaatccaccggttgccatccgtccgacgaggacggaaagggaccggcgtgagggaaacctagatgacccgttcctgggtcgggaccagagagccttccgggctgcgccttcgatcgccgccccgccgcctagggttcccgcgcctgtagatcgggtttgggggacgaggaaggggagtgccaagtaagggaacgatggggccgaggcgctccaagcgcgtttcgtgggccaccggggccaatctctgcaaagggtagggtttttttatttcgggaggattccccttctcaagctggatttgagaccgcaggacaatctccaagcaaaaggctcatggttatgggcatgcagctgcccaaagctcagatgattcgctgccacctgacttcgaatc

SEQ ID NO: 29449 - DNA, 1041 bp, Zea mays
  misc_feature: Ceres CLONE 1404342
  misc_feature: Encodes the peptide sequence at SEQ ID NO. 29450
tttttgttttgtcgtttcgtttggtcgtcgaggacgtctcacggaagcgtaggcaggcgagctaggctaattaacagcgacgtgacactgtgcgcgcgcagatacccgaggacctgcacttcgtgctgcggatgcgacacacgttcgagtcgctgggctaccagtcgggcttcttcctctcccagctcttctcgtcggcgcggggcgcctcgccgacgccgcctcctccggccgcgcgtcccccgccggcgcagcttttcaactggccgggcgcccaccagccgcagctcttcccgcccggtccgggcgcgttccaccacccgtcggcgcgggcgatgccgccattgttcccaggcggcggcaaggacgagggccacatgttccacattccaccggcacaccatggcagcaagccactgcacatggacgagctccagcaccggcaccagcagacgatgggggccggtggcgaggcgcccgacggtgaactccggtggcccaacgggctgtccttcttcaccgcgctcaccgggcgagacgacgacgcgaagctgctattcggtggccccggcgccgcggacgacgagaaggcggcgccggacgcgcagaccgggcacggcggggctgggaacgtggaggagtmcctgagcctggagagccactcggacaaggcgccgagcaaggtggagaacggcgcccagcacagcaccaagtccaagaggagcttcacgttgcccgcgcgggtgagctcgtccacgaccacgtccccgtccgtgtcggcctccacggcgccgcaagggatggagtaccgagggacgcacgagggcggcgtctactcggacctcatggagacgttcttggagtagctagctagatccgtagcatgcatgatcggttggttcaagccttcaaggtcactacaacaacaagtgcacgcttctttttttttcttttcctcaccgccctcccaagtcccaagctttgttttaggtctggagttttaatcgcataatatctttaattaaaaaaaaaaaaaaaaaa

SEQ ID NO: 29450 - protein, 244 aa, Zea mays
  misc_feature: Ceres CLONE 1404342
  misc_feature (171)..(171): Xaa is any aa, unknown, or other
MRHTFESLGYQSGFFLSQLFSSARGASPTPPPPAARPPPAQLFNWPGAHQPQLFPPGPGAFHHPSARAMPPLFPGGGKDEGHMFHIPPAHHGSKPLHMDELQHRHQQTMGAGGEAPDGELRWPNGLSFFTALTGRDDDAKLLFGGPGAADDEKAAPDAQTGHGGAGNVEEXLSLESHSDKAPSKVENGAQHSTKSKRSFTLPARVSSSTTTSPSVSASTAPQGMEYRGTHEGGVYSDLMETFLE

SEQ ID NO: 29451 - DNA, 644 bp, Zea mays
  misc_feature: Ceres CLONE 1404344-F
  misc_feature (459)..(459): n is a, c, t, g, unknown, or other
  misc_feature (544)..(544): n is a, c, t, g, unknown, or other
  misc_feature (545)..(545): n is a, c, t, g, unknown, or other
aaagctggagctccccgcggtggcggccgctctagaactagtggatcccccgggctgcaggaattcgcacgagaccattacctagaacatcctaatcgaaaaaacaacggtgtcagcggcctccctacgccaccgtcctcatccgccgccgtcgtccactacaccgccacggtcgtcctcggtcgcgaccgcgcccttcgttctcatccagcgccacggtctagggtttgagcactcctccatcgtctccttgcctcttctccatcatctccttgcctcttctctcctctgtgttctccctctggtcacggtcttgtttgctcttttgtttttcattcaaatcgtcgtgcatccagatctggcgtctatttttgggccagatgcttatttcttgcagaaaccaggcatccagatctagcgtgttctgagcacaaaagttgtacaggcatgacctattgnatcaggaaagttgtagcagaccacgttcgtcgtcgcgaacatcgttcgagccgtgtggctactgcgcctggccggtgagcatccnncaaggtcggtgtggctgctgcccctggacagcacgaatgcgtctctggtctcccatgaatgattaagatggcacctggatcacccgcgtctctggacac

SEQ ID NO: 29452 - DNA, 640 bp, Zea mays
  misc_feature: Ceres CLONE 1404345-F
  misc_feature (245)..(245): n is a, c, t, g, unknown, or other
  misc_feature (282)..(282): n is a, c, t, g, unknown, or other
  misc_feature (283)..(283): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
aaagctggagctccccgcggtggcggccgctctagaactagtggatcccccgggctgcaggaattcgcacgagaccattacctagaacatcctaatcgaaaaaaagaggagagaatccatcgagtcgaccaccgagcacggttagggcggcggggctcgccgtggccacagctcaggaatccaatcccccactcctcaccggcgcccgcggttttataaatagattccctcgtcactgtcgcggntcgcggctttgggatcggattcaacttcaccttaccnnccaccccctcgaattnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29453 - DNA, 644 bp, Zea mays
  misc_feature: Ceres CLONE 1404350-F
  misc_feature: Encodes the peptide sequence at SEQ ID NO. 29454
  misc_feature (577)..(577): n is a, c, t, g, unknown, or other
  misc_feature (587)..(587): n is a, c, t, g, unknown, or other
  misc_feature (588)..(588): n is a, c, t, g, unknown, or other
aaagctggagctccccgcggtggcggccgctctagaactagtggatcccccgggctgcaggaattcgcacgagaccattacctagaacatcctaatcgaaaaatctccccttccttcctttcctactcccacactcccccaccctccactagtactagtactagtaccacaaccaccccaccgggaaaaaacccaacaaggggtagggccgccgccgccgccagcgccgccgtgcagatcgcggccggatctacggcgctggggcacgggggtccccggatcgacgacgcctccgccgagggttcggatggctatgcgaaaagaaaaccctgtgcttaatgcttgtcaagcatccaatggccggatcacgcgagctcaagctgctgcaaatcgtcgaagctttggagctttcccttctgttccattgcctgcaaaaaccgaacgaaaacagactgcacaagggaagccaaaacgaggttcttcatatgacaacaccagtggcagcgttggcactttcaggcccccagcctaaaagcgcacagtaacttcggggatgtgaccaatttgagcatgctanctctaaccannagttttgctgctgcaccgaagcttcagacaagccctctctaaaggactggaagaac

SEQ ID NO: 29454 - protein, 74 aa, Zea mays
  misc_feature: Ceres CLONE 1404350-F
MAMRKENPVLNACQASNGRITRAQAAANRRSFGAFPSVPLPAKTERKQTAQGKPKRGSSYDNTSGSVGTFRPPA

SEQ ID NO: 29455 - DNA, 751 bp, Zea mays
  misc_feature: Ceres CLONE 1404353-F
  misc_feature: Encodes the peptide sequence at SEQ ID NO. 29456
  misc_feature (527)..(527): n is a, c, t, g, unknown, or other
  misc_feature (627)..(627): n is a, c, t, g, unknown, or other
  misc_feature (643)..(643): n is a, c, t, g, unknown, or other
  misc_feature (644)..(644): n is a, c, t, g, unknown, or other
  misc_feature (657)..(657): n is a, c, t, g, unknown, or other
  misc_feature (668)..(668): n is a, c, t, g, unknown, or other
  misc_feature (723)..(723): n is a, c, t, g, unknown, or other
  misc_feature (738)..(738): n is a, c, t, g, unknown, or other
aaagctggagctccccgcggtggcggccgctctatactagtggatcccccgggctgcaggaattcgcacgagaccattacctagaacatcctaatcgaaaaatccaggcagcacagctccctccccactcgaggctccgagctttattttttcttgttttgttttgttttcttggtaggagtaacaatagtttctggcagccttcttcctcctcgctctctacccgaggagagaggagaggagagaaatccggaggcaaagcttcagggtttgtataaagggattctagatctaatcgactaaccagagagaaaaaaaaacaaaaaataacgcgagaaagcatgagccacttcgccgccgccgccgtgaagagccccctcgccgtggccgcgcccgccgccggcgacgccaagagcccgctcttctgccccaagccgcggcgccccgcggcgcccctgcggtgccaccagggcggcgacgccggcatggatctgctcgacctcctcctgtcaaagcacagtgtttanggtgatgaacagtgacacactgacacgctatatctggggggaaagagaaagggaacgaacacgaagggggcgctgtaaggggaaccactgcgggccatanaattgtcttgcaatgnncgaaatcttaatncctcctctccncctattcctatatcattggattaacagggtacagggtgaccctcaacggtcccgnaaggggaaaacctcntaccatagccccc

SEQ ID NO: 29456 - protein, 66 aa, Zea mays
  misc_feature: Ceres CLONE 1404353-F
  misc_feature (62)..(62): Xaa is any aa, unknown, or other
MSHFAAAAVKSPLAVAAPAAGDAKSPLFCPKPRRPAAPLRCHQGGDAGMDLLDLLLSKHSVXGDEQ

SEQ ID NO: 29457 - DNA, 689 bp, Zea mays
  misc_feature: Ceres CLONE 1404358-F
  misc_feature: Translation starting site: 177
gctctttcctagtggatcccccgggctgcaggttttcgcacgagaccattacctagaacatcctaatcgaaaagtcgcgccgccgcttccctcccaacccactagctcaaaaccctagagctctcgcctgctcgcctccgccgccggagcgagctccccatcttcatccgtcaaccatggcgacccagatcagcaagaagaagaagttcgtcagcgacggcgttttctacgccgagctcaatgagatgctgacgcgggagctggcggaggacggctactctggcgtggaggtgcgcgtcacgccgatgcgcacggagatcatcatccgcttttttgtgcacgcacaccgcgcccggcgagaagggccgcaggatcagggagctcacctccgtcgtccagaagaggttcaacttccctgagaatggcgccgacccccatcccgagaacggcgtcaaccgtgggctctgtgccatcgcgcaggccgagtccctcccgctacaaagctcctcggtgggccttgccgccccgcagggccttggctacggggctccttccttaccgtcaatggccagaggctggcccaaagcgttgggaacgtgggttcctggaggcgggaaaggctctagggccccccaaagagaccccaggtacctcgagagggtccaaaggggtgggctctactacccatc

SEQ ID NO: 29458 - DNA, 647 bp, Zea mays
  misc_feature: Ceres CLONE 1404370-F
  misc_feature: Translation starting site: 296
aaagctggagctccccgcggtggcggccgctctagaactagtggatcccccgggctgcaggaattcgcacgagaccattacctagaacatcctaatcgaaaagtccgccccccgccaccaccgcactcccatccagatgggagtgcgcaagaggagctttcggcattccggtctcgctcgaccaaccggatccccgtgagagtccccacccacaccccgagggcggcgtcgggtcgtcggggacagctgatttcacaagacgagccggcgagccggccggcatttcgtcgtcgggatggggccggcctcctcctcgtccgccggcgtcgcgtgcctcgtcctgctcctgctctgggtccttcgccggcgcctccgcggggcacggctcgttccaggctaggcgtgctctgtcagatgaccatgggagcggtatagtggcggaagggcgggaggttgctcgccgacgctgcgactcccgcgaacaactctcttgtgctggttgcggcgaggactccccggagcgacccctttcgccaccttacggcgtacagcggcggctggaacattagcgacgagcactactgggccttcgtgacgtaaaccgcggtggccctctcctctgggccgggctgggggttcgccggctt

SEQ ID NO: 29459 - DNA, 603 bp, Zea mays
  misc_feature: Ceres CLONE 1404372-F
  misc_feature: Encodes the peptide sequence at SEQ ID NO. 29460
  misc_feature (361)..(361): n is a, c, t, g, unknown, or other
tggagctccccgcggtggcggccgctctagaactagtggatcccccgggctgcaggaattcgcacgagaccattacctagaacatcctaatcgaaaaagcaggagaagagagacgacacagcagctttttgggtttccccttccctttccccgcgcggtgatcgcagggttctccgcgagcgaggcacagcactgcgcgtcctccgtgacttcctggtgatcgctgggggttctggacgttggtgtttcatttggttggttggtggctgcagcagccgtggcgagatggacctgatgatgccggtgacggtgaaggaggagtggccgccggaagagggagagcacgaggacctggacgctnacgcggacgctccgcggccgatggagggctgcacgaggacggcccaccgcccgttctgaacaaaacgttcggactggtgcccgacccgggcaccgaggaaggcctcttccgggggccggcccggaaaagggtccgggggttgggatccccaaggggttcgcgggcgggggtgccccccgggggccttaaagaaaaaaaatttttccaggttttgggggcccggggagaaccccaattttaag

SEQ ID NO: 29460 - protein, 44 aa, Zea mays
  misc_feature: Ceres CLONE 1404372-F
  misc_feature (26)..(26): Xaa is any aa, unknown, or other
MDLMMPVTVKEEWPPEEGEHEDLDAXADAPRPMEGCTRTAHRPF

SEQ ID NO: 29461 - DNA, 648 bp, Zea mays
  misc_feature: Ceres CLONE 1404373-F
  misc_feature: Encodes the peptide sequence at SEQ ID NO. 29462
  misc_feature (365)..(365): n is a, c, t, g, unknown, or other
  misc_feature (376)..(376): n is a, c, t, g, unknown, or other
  misc_feature (384)..(384): n is a, c, t, g, unknown, or other
  misc_feature (396)..(396): n is a, c, t, g, unknown, or other
  misc_feature (447)..(447): n is a, c, t, g, unknown, or other
  misc_feature (460)..(460): n is a, c, t, g, unknown, or other
  misc_feature (556)..(556): n is a, c, t, g, unknown, or other
  misc_feature (601)..(601): n is a, c, t, g, unknown, or other
aaagctggagctccccgcggtggcggccgctctagaactagtggatcccccgggctgcaggaattcgcacgagaccattacctaagaacatcctaatcaaaaaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggcggaatctcccgggacgcctctccgtcggcgcctccgcgacggtggtagcggcaccgcggcggggagacggatcccaagaagncgggtggtggncaccgggnaatggggctggntcctccgtttccggaaacgatgtagacgcttactacgaccgcctggctagntcggggagagcgncatcgggcccatcgaccgcttcgaaggcttctaagttccccacccgctttggcggtcagatccggggcttctcctccgagggatacatcgacgganagaacgacgccgccttgatgattgcctccgatactgcatcgtcgntggcaagaaggctctcgaggcctccggtatcgcccacggctccaggc

SEQ ID NO: 29462 - protein, 142 aa, Zea mays
  misc_feature: Ceres CLONE 1404373-F
  misc_feature: SWISSPROT Homolog: EC 2.3.1.41 Beta-ketoacyl-acyl-carrier-protein synthase I
  misc_feature (48)..(48): Xaa is any aa, unknown, or other
  misc_feature (52)..(52): Xaa is any aa, unknown, or other
  misc_feature (75)..(75): Xaa is any aa, unknown, or other
  misc_feature (80)..(80): Xaa is any aa, unknown, or other
  misc_feature (112)..(112): Xaa is any aa, unknown, or other
  misc_feature (127)..(127): Xaa is any aa, unknown, or other
MQSLLLPTAAVAPVAPPCGRRNLPGRLSVGASATVVAAPRRGDGSQEXGWWXPGNGAGSSVSGNDVDAYYDRLAXSGRAXSGPSTASKASKFPTRFGGQIRGFSSEGYIDGXNDAALMIASDTASSXARRLSRPPVSPTAPG

SEQ ID NO: 29463 - DNA, 644 bp, Zea mays
  misc_feature: Ceres CLONE 1404374-F
  misc_feature (246)..(246): n is a, c, t, g, unknown, or other
  misc_feature (247)..(247): n is a, c, t, g, unknown, or other
  misc_feature (342)..(342): n is a, c, t, g, unknown, or other
  misc_feature (371)..(371): n is a, c, t, g, unknown, or other
  misc_feature (479)..(479): n is a, c, t, g, unknown, or other
  misc_feature (517)..(517): n is a, c, t, g, unknown, or other
aaagctggagctccccgcggtggcggccgctctagaactagtggatcccccgggctgcaggaattcgcacgagaccattacctagaacatcctaatcgaaaagtacttttacagcgtgtttctgggctcagacatgcgctggattcgtctccttttcctcgatctctccttcgatctctttcttcccggcttgttttattcctatattcctacgttccctggacctgatcataactgaatatgctnncgactttgcagtttgtccatgccttcctcgtgaagtcggagaatcagaaactgtaggctgggactgggagtgctcgttcatcctggtatcgtacngcgttggccgatctctgcaagccatgcantcgcggccatgtcaccgcccaggcccagctgcatggcagttgcagccgtgtttgccgtttagcaatttcaaactcgtcgtcgtacaactaacggacagacgtacgcgncttggttgcgttcgtccacgacaaggggcatgaagggncgcgctcgaacgattttgaaagtgatggctcacgagggaacgagcccatcaccggctccggccaggggggggggggcgggccctccgggatctcccggctcggggggcgtcgccggggccttggggg

SEQ ID NO: 29464 - DNA, 678 bp, Zea mays
  misc_feature: Ceres CLONE 1404375-F
  misc_feature (377)..(377): n is a, c, t, g, unknown, or other
  misc_feature (379)..(379): n is a, c, t, g, unknown, or other
  misc_feature (380)..(380): n is a, c, t, g, unknown, or other
  misc_feature (595)..(595): n is a, c, t, g, unknown, or other
tccccgcggtggcggccgctctataactagtggatcccccgggctgcaggaattcgcacgagaccattacctagaacatcctaatcgaaaaacactgaactgaacacgcgcgcgcgcacgccatccgcctcccgtagcgtgcggggtgccgtcaatccaaaccaccaaaagcaatgccgccgccgtccgcaaacggcgccaccgccgccgccgccgctcgcgagggacgacatgtccccggccggaagccatcccttgaagatgaatgaaaactggcataaacatcgtttgtccccgcacaccaaaatgggtcccttgggggaaacagcaaaaaaacacactcatgagaggaggtatctctcccccaatttattatntnngggggtggggggggggggtaaacacccctactttgtttggggaaaatataccctctggtgtggccagagagaacccccccccccttctgggggatgcccccccccctgtcggtccaccgcgcgttgttttttttgtttatttcttaatataacctcacctccccaagacggggggggcattttttttttccccccaccacaggggggtgagctancctagaaggcaggccgcccccccccccctgtggtggtctccccctcacctcgcacgtaacgatcttaatccaaaccacaaaca

SEQ ID NO: 29465 - DNA, 720 bp, Zea mays
  misc_feature: Ceres CLONE 1404381-F
  misc_feature: Encodes the peptide sequence at SEQ ID NO. 29466
  misc_feature (685)..(685): n is a, c, t, g, unknown, or other
cgcggtggcggccgctctagaactagtggatcccccgggctgcaggaattcgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggtaccagcgggtggagaagccgccgcccgaggccgccgccatcggcgagaatgagatccgcatcaccactcagggcctcgtccgcaactacgtcacctacgccacctccctcgtccaggaaaaacaggtgaaggaaattgtgttgaaggctatgggacaggctataagcaaggcagtggctattgctgagatcataaagaagaggattcctggtttgcatcaagatacaataatcagttctgtcagtattactgatgtatgggagcccattgaggaaggacttgtaccattggagatgactcgtcatgtttcaatgatatcgatttccttgtcacctaaggagcataacaagaattcacctgggtatcaagctcctctacattcggatctgaagncacaaagatatctgcaacctcagcaatatcaacag

SEQ ID NO: 29466 - protein, 146 aa, Zea mays
  misc_feature: Ceres CLONE 1404381-F
  misc_feature (18)..(88): Pfam Name: Alba Pfam Description: Alba
  misc_feature: SWISSPROT Homolog: EC 3.1.26.5 Ribonuclease P
  misc_feature (135)..(135): Xaa is any aa, unknown, or other
MDRYQRVEKPPPEAAAIGENEIRITTQGLVRNYVTYATSLVQEKQVKEIVLKAMGQAISKAVAIAEIIKKRIPGLHQDTIISSVSITDVWEPIEEGLVPLEMTRHVSMISISLSPKEHNKNSPGYQAPLHSDLKXQRYLQPQQYQQ

SEQ ID NO: 29467 - DNA, 618 bp, Zea mays
  misc_feature: Ceres CLONE 1404384-F
  misc_feature: Translation starting site: 168
  misc_feature (202)..(202): n is a, c, t, g, unknown, or other
  misc_feature (330)..(330): n is a, c, t, g, unknown, or other
  misc_feature (408)..(408): n is a, c, t, g, unknown, or other
cgctctagaactagtggatcccccgggctgcaggaattcgcacgagaccattacctagaacatcctaatcgaaaattccctccctccactcgcgtccaaattctctcctcaccacaccacctctccctccgacgcacgggtgcatcgcagtgctagatagagtgaccatgcaggcggcggcggtgacggtgaatggcgcggncgacgtgcaaaagccccagcagcagccgatggtggtgggggcgccgccgccggcggccatggtgccgccccattgggttgccataccgatgccgccgcacccgatggcgccgccccagttcgcggcgnctcaattcgtgccgttccacgccgtcgtgcagtcgccgcagctggcggcacctgtgccagcggtcgtcctgggatcgncggcgccgcatcaggccggggcaggaggagaacaagaccctctgggggtggtgatctccatttctggatggacgaggaatatctgcaccactgcttcggctacaccgggggaggttggggccattaaaagtatcccggaataagcaaaacggacaggctgaaggatacggattttgttgagtcctaccggcctgctgcagctgaagggtt

SEQ ID NO: 29468 - DNA, 637 bp, Zea mays
  misc_feature: Ceres CLONE 1404386-F
  misc_feature: Encodes the peptide sequence at SEQ ID NO. 29469
  misc_feature (594)..(594): n is a, c, t, g, unknown, or other
  misc_feature (606)..(606): n is a, c, t, g, unknown, or other
aagctggagctccccgcggtggcggccgctctagaactagtggatcccccgggctgcaggaattcgcacgagaccattacctagaacatcctaatcgaaaaacacacccggaccccggtctgcgtttgtccctgcgggctgcggccctgcctcttctcgtctcccgttcccctcgccgcgtgagctctctctctctctctctctcctctgtggtgacgactgggcgcccgcacccctggcagccgccgccgcccagtccccgtcgggcccttcggcaggtcttcttcggcctcttcgccggcgacgagccgcaccaggcgtacatgtgtacacccagcccaggcccttaactgcgcccgcccctgcgactggttttcctgctggtttctgtggatttggctgccggaggattggtgcagcctttaggatcacggtagattcgctgtgaaatccgaagggtgctcaggtcatggtgggggaccagcgcatgatactgggcttagactcggcaacctcatcaagcactgcccctgatttgacccgcgctgaagaggatccttctgtgagcaggagctgcgtgatcgacggctgganggtggggtgggncgcaaaagggagacaagtgggaggttcctga

SEQ ID NO: 29469 - protein, 55 aa, Zea mays
  misc_feature: Ceres CLONE 1404386-F
  misc_feature (42)..(42): Xaa is any aa, unknown, or other
  misc_feature (46)..(46): Xaa is any aa, unknown, or other
MVGDQRMILGLDSATSSSTAPDLTRAEEDPSVSRSCVIDGWXVGWXAKGRQVGGS

SEQ ID NO: 29470 - DNA, 637 bp, Zea mays
  misc_feature: Ceres CLONE 1404388-F
  misc_feature: Encodes the peptide sequence at SEQ ID NO. 29471
  misc_feature (121)..(121): n is a, c, t, g, unknown, or other
  misc_feature (297)..(297): n is a, c, t, g, unknown, or other
  misc_feature (320)..(320): n is a, c, t, g, unknown, or other
  misc_feature (374)..(374): n is a, c, t, g, unknown, or other
  misc_feature (447)..(447): n is a, c, t, g, unknown, or other
  misc_feature (485)..(485): n is a, c, t, g, unknown, or other
  misc_feature (520)..(520): n is a, c, t, g, unknown, or other
aaagctggagctccccgcggtggcggccgctctagaactagtggatcccccgggctgcaggaattcgcacgagaccattacctagaacatcctaatcgaaaagagctcacacacacatcangaaagcaagaaagaaaagagtgtagctagctagccaccgcgcgcgcgcacgagtagtctagctagaatacattcgcgttcaaaacaaacacacagcgtcgtgctgcgtgatctctgaccgcgtcgacaactaccgcagcaccaagaagttgatggcggccaccgtatcttcctgcntgagcctcgtccccaccgtgcanccaccgggccggcgggttccccagcagtgtggcactgacgaacacgctcagcgnccgtcgtcgttctcccgcttatcttgtcgtcgcctcggcgacgagagccgaacaggaggtcgcccctgtgagnatcggaggacgtggacctcagctctcatcaggccgcgnaccgacgacggagagttcgccgcgcggtgggcggnaagtccacgacagacaaaacggggagggtctgctggaccccttcgacggcgtgctcctccagagctcatccgctacggcgagttcgcccaggccacctacgacagcttcgactacga

SEQ ID NO: 29471 - protein, 121 aa, Zea mays
  misc_feature: Ceres CLONE 1404388-F
  misc_feature (9)..(9): Xaa is any aa, unknown, or other
  misc_feature (16)..(16): Xaa is any aa, unknown, or other
  misc_feature (59)..(59): Xaa is any aa, unknown, or other
  misc_feature (83)..(83): Xaa is any aa, unknown, or other
MAATVSSCXSLVPTVXPPGRRVPQQCGTDEHAQRPSSFSRLSCRRLGDESRTGGRPCEXRRTWTSALIRPRTDDGEFAARWAXSPRQTKRGGSAGPLRRRAPPELIRYGEFAQATYDSFDY

SEQ ID NO: 29472 - DNA, 623 bp, Zea mays
  misc_feature: Ceres CLONE 1404391-F
  misc_feature: Encodes the peptide sequence at SEQ ID NO. 29473
tggagctccccgcggtggcggccgctctagaactagtggatcccccgggctgcaggaattcgcacgagaccattacctagaacacctaatcgaaaaaaaattaaaacccacacagctatccagcaacagccaggccagccaccatggctccaccacctctgttcccgctcccgcctctcctcatcctcctcgtcatcgtgcctctgttccccaccgccgcgccgacggccacgacgctgccgctgtaccgccacctaccgcacgtagccgaggccgtggcatcgcaccaccaccacccgctgtcccgcctggccgccgcgtcgctagcccgcgcgttgcacctcaagcgccgggaccccaaccaccacagccagaaaagatcaggcggtcacccgtcagtaccagccaccgccgcgctgtacccgcactcctacggcggctacggcttcacggggtcgctcggaacgccgccgcagccgctccccgtgctgctcgacaccggcaggcacctcacgtgggtgccatgcacctcgagctacgagtgccggaactgctcctccccatccggctcggcggtccggtcttcaccccagaactcctccctctccgctcgtggctggcgg

SEQ ID NO: 29473 - protein, 160 aa, Zea mays
  misc_feature: Ceres CLONE 1404391-F
  misc_feature: SWISSPROT Homolog: EC 3.4.23.1 Pepsin A
MAPPPLFPLPPLLILLVIVPLFPTAAPTATTLPLYRHLPHVAEAVASHHHHPLSRLAAASLARALHLKRRDPNHHSQKRSGGHPSVPATAALYPHSYGGYGFTGSLGTPPQPLPVLLDTGRHLTWVPCTSSYECRNCSSPSGSAVRSSPQNSSLSARGWR

SEQ ID NO: 29474 - DNA, 781 bp, Zea mays
  misc_feature: Ceres CLONE 1404402-F
  misc_feature (21)..(21): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (73)..(73): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
tttttttttcccctccctttncgcctttccgctcggcccccccgggtgtacccgccgcatgtgggggnnnaanccccnnnnnccccaagctggagctccaccgcggtggcggccgcttctatactagtggatcccccgggctgcaggaattcgcacgagaccattacctagaacatcctaatcgaaaagtcccaggtcctcctccctgtctgctcccctccactggtgtggagctctccctctcccgtctcccctcaccttctccacctcccccattccgccaccgcacaagccgacctccctcaccaagaggagaatagaaagggagagcgaacgaggcaaaccaggcggtacagcaacgcgacgtgcttgcctattctctcgagagagatgtcaattttataacaaaaccccaccatgccgtcacctgggcgaattatgacttgagcttcatgccaggcgtcaagtctttactgcgagaaatggccacctgtgtaatgcttaagacccaccactagggcctctccttgattacacaggtagggggggcccgcaaaacttgagcataccactcccaccccccttgctttcagaagtatcgggtcccaacgggttttgccatcgccccccctctggagcaaaggggccctggtaagcctttccgggcccaccctgccgcccttcttacccgagtaaggccccccggccatttttttcccccgccgcccgttgcgctttaccccttggagcggcggtgttttttacgcgcccccgtggtgtg

SEQ ID NO: 29475 - DNA, 658 bp, Zea mays
  misc_feature: Ceres CLONE 1404403-F
  misc_feature: Encodes the peptide sequence at SEQ ID NO. 29476
  misc_feature (658)..(658): n is a, c, t, g, unknown, or other
tggagctccccgcggtggcggccgctctagaactagtggatcccccgggctgcaggaattcgcacgagaccattacctagaacatcctaatcgaaaaaaggttgttttgttgcttccttgtcccgctctcaccagcaatcccgtcgatcacccagacctccacggcactgctccgtctcctccgttccgttccgaaccgcaagctcccaacccttccgcgatggacctcacctcgccgtcgcccgcggcgcgccgcgccgccgccatcgcgcgccacttcgccgcagccgccgcccccatccccgcgagcagcgccctggaaacttcctgctgcctcagctacgtcccgccggagtccacgcaccccccggcgcggtttggcccggccaacctccagtttctggtgggacgggcacgacttgccccaccgggaatggcttcttccgccccatgaaggagaacccccctttttccccaggccggaagttcgccggaagggtatccaagggttgttccgtgggggccgggattttcaacgaatggccaaggaaaagggctaagggggaagcgccaacccttggagggcggaatatcgggttaccctggaaaccgggagcgcgggggggggttccccgggggggtgggattacaaccggan

SEQ ID NO: 29476 - protein, 77 aa, Zea mays
  misc_feature: Ceres CLONE 1404403-F
MDLTSPSPAARRAAAIARHFAAAAAPIPASSALETSCCLSYVPPESTHPPARFGPANLQFLVGRARLAPPGMASSAP

SEQ ID NO: 29477 - DNA, 622 bp, Zea mays
  misc_feature: Ceres CLONE 1404405-F
  misc_feature: Encodes the peptide sequence at SEQ ID NO. 29478
  misc_feature (264)..(264): n is a, c, t, g, unknown, or other
  misc_feature (340)..(340): n is a, c, t, g, unknown, or other
  misc_feature (447)..(447): n is a, c, t, g, unknown, or other
  misc_feature (547)..(547): n is a, c, t, g, unknown, or other
tggagctccccgcggtggcggccgctctagaactagtggatcccccgggctgcaggaattcgcacgagaccattacctagaacatcctaatcaaaatcaagctagctagttaactgtgcaattagttgagtcagtagataagctgttccgtcttagcttatctaccgatcgagctcgcggcaatggcgatgatggcatgcaataacactcgaccccgcaagctgtcgctgccatgccgcacccgtactttccaagccttaaacnaaagcacagcagtcttcctggctgcttccacgggccgtcgtcgtcggcaaggagccacaaccaccgtcctcctccnggcggcggctgtcactaccgcttcgagctcacccacgtagatgccaacctcaaccttaccagcgacgaggttgatgcgtcgtgcctatgacaggagccgcctccggnccggcgagcttggccgccctactcggacggccgacacgaaagggcgcgttagcattcctgacgcctcgtacatcatcacgtttttacttgggcaacccgncggcccgaggacaacatcctcccgcccgtccgtgaacaccgggcgccgactttattttggacgacccgagagggg

SEQ ID NO: 29478 - protein, 65 aa, Zea mays
  misc_feature: Ceres CLONE 1404405-F
  misc_feature (28)..(28): Xaa is any aa, unknown, or other
  misc_feature (53)..(53): Xaa is any aa, unknown, or other
MAMMACNNTRPRKLSLPCRTRTFQALNXSTAVFLAASTGRRRRQGATTTVLLXAAAVTTASSSPT

SEQ ID NO: 29479 - DNA, 636 bp, Zea mays
  misc_feature: Ceres CLONE 1404410-F
  misc_feature: Translation starting site: 523
  misc_feature (635)..(635): n is a, c, t, g, unknown, or other
aaagctggagctccccgcggtggcggccgctctagaactagtggatcccccgggctgcaggaattcgcacgagaccattacctagaacatcctaatcgaaaagtatcctgtgccagctgactcgccttctcaagttctgaaacgcagcggagcgcgccggaggagagcaaagcggacagtggaggatagagagagcagaacaccagatcagatcagatggcccctccgtctccccagccgcggtttagtgcgcgtgctcgaccgcatccgcgtctcgccgccgccggctgattctgagcaagagcccgcgctcccctcatttttcttcgacgttgcctggctcttcaccggccccgtcgagcgcctcttcttcttccgccacccggagccggcctccactctcccgctcctccgctcctcgctctccctcgcgctccgccgcttctacccactcgccggcaccatcaggccccacgcgcccttcctctgctcctacacccatgggtaccgatgccctcaaccatggtcgtcgccgagtcgaccagcccccgacgatttcgacagcctcgtagccaggtcgcccggggaacctggacgggatccgcccctttcgttccgcagttgccgccgccggng

SEQ ID NO: 29480 - DNA, 643 bp, Zea mays
  misc_feature: Ceres CLONE 1404413-F
  misc_feature: Encodes the peptide sequence at SEQ ID NO. 29481
  misc_feature (295)..(295): n is a, c, t, g, unknown, or other
  misc_feature (355)..(355): n is a, c, t, g, unknown, or other
  misc_feature (389)..(389): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (542)..(542): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (569)..(569): n is a, c, t, g, unknown, or other
  misc_feature (584)..(584): n is a, c, t, g, unknown, or other
  misc_feature (601)..(601): n is a, c, t, g, unknown, or other
aagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcagagcttaattaggctccctctacatctgatccagctaagtagctagccagcactacagaagggcgtggcaagaatcangagagagatagcaggggggctagctagctgagctcgtgcgacgaagaatggccggaattngcaggaacatggtgacgccgctcctggtgctcancctcatcatgtacatcatcgtcatcggcttcgcgagctggaacctgaaccacttcatcaacgggcagacaactaccccggcgtggccgcaccggcgcgacgttctacttcctggtgtcccatctggcccgggggtgggggccgcccccnnnanggtggggggggggnnnnnnnnnggggnccccctgggggcccngggggccgggccccccngggcgggggtcgtgccttcttcgccggggcccctcccggcgg

SEQ ID NO: 29481 - protein, 100 aa, Zea mays
  misc_feature: Ceres CLONE 1404413-F
  misc_feature (5)..(5): Xaa is any aa, unknown, or other
  misc_feature (16)..(16): Xaa is any aa, unknown, or other
  misc_feature (66)..(66): Xaa is any aa, unknown, or other
  misc_feature (67)..(67): Xaa is any aa, unknown, or other
  misc_feature (72)..(72): Xaa is any aa, unknown, or other
  misc_feature (73)..(73): Xaa is any aa, unknown, or other
  misc_feature (74)..(74): Xaa is any aa, unknown, or other
  misc_feature (76)..(76): Xaa is any aa, unknown, or other
  misc_feature (81)..(81): Xaa is any aa, unknown, or other
  misc_feature (87)..(87): Xaa is any aa, unknown, or other
MAGIXRNMVTPLLVLXLIMYIIVIGFASWNLNHFINGQTTTPAWPHRRDVLLPGVPSGPGVGAAPXXVGGGXXXGXPLGAXGAGPPXAGVVPSSPGPLPA

SEQ ID NO: 29482 - DNA, 715 bp, Zea mays
  misc_feature: Ceres CLONE 1404414-F
  misc_feature: Encodes the peptide sequence at SEQ ID NO. 29483
  misc_feature (504)..(504): n is a, c, t, g, unknown, or other
  misc_feature (648)..(648): n is a, c, t, g, unknown, or other
ccgggctggagctccacgcggtggcggccgctctagaactagtggatcccccgggctgcaggaattcgcacgagaccattacctagaacatcctaatcgaaaagtctcgatccggaaacctctcacaccctaaccgcctcctgcaagtttcagagctcaggaatctgcgccatggcgagtgagacggagaccttcgcatttcaggatgagatcaaccagctgctctcactcatcatcaacaccttctactccgacaaggagatcttcctccgcgagcttatctccgactcttccgatgcgctgcacaagatcaggttcgagagcctcactgaccagaccaaggtccgatgagagcgctggagcttttcatcccaccttgttccgagacaaaggtcccgaaaggcgtttttccgtccatcgccggagaggcggcgccggcgcccaggcgcgcacccctcccaaaaaaaatttgttggggagtagtggtggccccctccccccaangaaacttatttgtatttgctctgtgagcgtatctgttacgcggcgcgggcacgtggagtacggcagcggggtggggccctccggcaacggccttgtccccgtctctgtgggggtggtctatggttgcgtccgttcgtcgtgganccgcccgcatttctgcgtctaaccacgatgccgcggctagatttgcgaggccgggacgctacgggga

SEQ ID NO: 29483 - protein, 59 aa, Zea mays
  misc_feature: Ceres CLONE 1404414-F
MASETETFAFQDEINQLLSLIINTFYSDKEIFLRELISDSSDALHKIRFESLTDQTKVR

SEQ ID NO: 29484 - DNA, 628 bp, Zea mays
  misc_feature: Ceres CLONE 1404416-F
  misc_feature: Encodes the peptide sequence at SEQ ID NO. 29485
  misc_feature (397)..(397): n is a, c, t, g, unknown, or other
  misc_feature (407)..(407): n is a, c, t, g, unknown, or other
  misc_feature (426)..(426): n is a, c, t, g, unknown, or other
tggagctccccgcggtggcggccgctctagaactagtggatcccccgggctgcaggaattcgcacgagaccattacctagaacatcctaatcgaaaaacgataacccaaacaaaccaatcatcctctccgtgtaggccgcgggattccgtgtccctctccaatccggcgtagccatcgtcgccggatacaggatccggtccccgcgatggagccctcaccaacctcctcctcgccggtggtggcgcgccggttgtcgccggaggtaaggagggtgccgaagcgggcgctggaggagttgttggagcaggtccagcgggctgttgagatgctgcgcgatgccgacgctgatctcgccatctctctctcggaggagaccgcagcagcctcgccggaggncgaggaccgnagggacgatgttggtgtcnatggagatggcatggcgacgtcgtcggttgcgagtgactccgattacgagacgacgcagatgtgtggacttctttaatctaaggttggatcactcgagttcttcaaaagctcaatggtattcagaaggcagtagatcagaattgggcaagtgaacctgatacatcatgggaatatataaaggcggattttgggggaagatgg

SEQ ID NO: 29485 - protein, 98 aa, Zea mays
  misc_feature: Ceres CLONE 1404416-F
  misc_feature (64)..(64): Xaa is any aa, unknown, or other
  misc_feature (74)..(74): Xaa is any aa, unknown, or other
MEPSPTSSSPVVARRLSPEVRRVPKRALEELLEQVQRAVEMLRDADADLAISLSEETAAASPEXEDRRDDVGVXGDGMATSSVASDSDYETTQMCGLL

SEQ ID NO: 29486 - DNA, 637 bp, Zea mays
  misc_feature: Ceres CLONE 1404418-F
  misc_feature: Encodes the peptide sequence at SEQ ID NO. 29487
  misc_feature (241)..(241): n is a, c, t, g, unknown, or other
  misc_feature (285)..(285): n is a, c, t, g, unknown, or other
  misc_feature (325)..(325): n is a, c, t, g, unknown, or other
  misc_feature (344)..(344): n is a, c, t, g, unknown, or other
  misc_feature (350)..(350): n is a, c, t, g, unknown, or other
  misc_feature (365)..(365): n is a, c, t, g, unknown, or other
  misc_feature (386)..(386): n is a, c, t, g, unknown, or other
  misc_feature (404)..(404): n is a, c, t, g, unknown, or other
tggagctccccgcggtggcggccgctctagaactagtggatcccccgggctgcaggaattcgcacgagaccattacctagaacatcctaatcgaaaagctagtcttcacggcggggttgttgtcgcttgtggccagccgccagcaccagcacaaggcgatcgagagtggtgaccaccagtaaactgcaaagtgcaaaccaaacaccacccacgaagaaagcggaggagggagcaatggcgnagccgagccagcagctggcgtcgtttcgtggaaggtgccggcgnctcccacttccccatcagaacctgcccttcggggcttccngccgggggggggtgcaggngcaggngcccgggccccgggntggccatgggggatttcgggntcgacctcggcgccgttnccgaagtggtttttcttcacgggcccgcgctctcggcctccccgtgtttccccccacaatatcttaacatggttcttggacaatgcccccctcccccgtgcaaagaaggccccttcccccccccaaccaaaaaacccataccggcgacggaggctgttttggcctgcaccccaaaaaatttgagaaacaagtttctccccaccaacgttttttttaaacccttgctcccaccg

SEQ ID NO: 29487 - protein, 89 aa, Zea mays
  misc_feature: Ceres CLONE 1404418-F
  misc_feature (6)..(6): Xaa is any aa, unknown, or other
  misc_feature (12)..(12): Xaa is any aa, unknown, or other
MGDFGXDLGAVXEVVFLHGPALSASPCFPPQYLNMVLGQCPPPPCKEGPFPPPTKKPIPATEAVLACTPKNLRNKFLPTNVFFKPLLPP

SEQ ID NO: 29488 - DNA, 615 bp, Zea mays
  misc_feature: Ceres CLONE 1404419-F
  misc_feature: Encodes the peptide sequence at SEQ ID NO. 29489
  misc_feature (165)..(165): n is a, c, t, g, unknown, or other
  misc_feature (247)..(247): n is a, c, t, g, unknown, or other
  misc_feature (257)..(257): n is a, c, t, g, unknown, or other
  misc_feature (305)..(305): n is a, c, t, g, unknown, or other
  misc_feature (346)..(346): n is a, c, t, g, unknown, or other
  misc_feature (363)..(363): n is a, c, t, g, unknown, or other
  misc_feature (392)..(392): n is a, c, t, g, unknown, or other
  misc_feature (416)..(416): n is a, c, t, g, unknown, or other
  misc_feature (446)..(446): n is a, c, t, g, unknown, or other
  misc_feature (476)..(476): n is a, c, t, g, unknown, or other
tggagctccccgcggtggcggccgctctagaactagtggatcccccgggctgcaggaattcgcacgagaccattacctagaacatcctaatcgaaaagttatttaatttggagcagttctttcttatctcgacactgcacggcacggaggagttaaagggacggnagcgcaccggcacctcctctcacacaggcagtccccccacccacccagcgtgcgaggcgatcaaaccgtgtgcggccgtgcnggcatggcgnccacgctgctcctggcctcggcgaccgcgctcctggcgctggcggcgncgtggttctgggactacgtcgtggtgcgcctcctttggcgnccccgcgccgtggccgncatgttcagggcgcaggggggtccgcggnccgccctacagcttcctcagcggntgcaaccgcgagatgaggaagattgaagcngaggccgacgacgggctcccgggtggacgntcgcgaacacaactaccctccccagggtgatgccccacttcctcgcctggaagcagcagtacggggagccattcctggaactggatgggtccgcgggccccgggtctgcctcttccaaaacgaggcggaaagggaagtt

SEQ ID NO: 29489 - protein, 63 aa, Zea mays
  misc_feature: Ceres CLONE 1404419-F
  misc_feature (3)..(3): Xaa is any aa, unknown, or other
  misc_feature (19)..(19): Xaa is any aa, unknown, or other
  misc_feature (38)..(38): Xaa is any aa, unknown, or other
  misc_feature (48)..(48): Xaa is any aa, unknown, or other
  misc_feature (56)..(56): Xaa is any aa, unknown, or other
MAXTLLLASATALLALAAXWFWDYVVVRLLWRPRAVAXMFRAQGGPRXALQLPQRXQPRDEED

SEQ ID NO: 29490 - DNA, 642 bp, Zea mays
  misc_feature: Ceres CLONE 1404421-F
  misc_feature: Translation starting site: 509
  misc_feature: SWISSPROT Homolog: EC 1.11.1.15 Peroxiredoxin
tggagctccccgcggtggcggccgctctagaactagtggatcccccgggctgcaggaattcgcacgagaccattacctagaacatcctaatcgaaaaagcagttcgattggcaggaagcccgtgcacgtcgaccgacgcacgccaccatgccggggatcatcataggcgcacatcgtccccaacctggagctggactccacccacggcaagatccgaatccacgactaccttggggacggatacgactatcatcttctctcacccagcctacttcacgcccgtgtgcacgacggagatggaggcgatggcggtgtacgccaaggagactcgagaagagtggcgtgaagctgctgagcatctcgtgcgacgacatggagtcgcacaggtagtggaccataggacgtggaggcgtacggagcaaagcggcagcagcaacagcatacgacgacgaaggtgacgttcacgatcctggcggacccggcgcggaacgccatcctgcagctgaacatggtggaccccgacgagaaggacgcgtcggtgcggagcatgacgtctcgagcgatccacgtcgtgggcaccagacaggccgtgaagatgagcttcctgtacgcggtcaccacgtcccggaacatggacgaggt

SEQ ID NO: 29491 - DNA, 622 bp, Zea mays
  misc_feature: Ceres CLONE 1404430-F
  misc_feature: Encodes the peptide sequence at SEQ ID NO. 29492
aagctggagctccccgcggtggcggccgctctagaactagtggatcccccgggctgcaggaattcgcacgagaccattacctagaacatcctaatcgaaaaatcgcttcgattcggagtattcacgagcgccgggacagactctcgcccgagtgcgagagatcttcatatgcccattccgcccaccgatggagctgcacgccagcctcggtctcatccgaatgcgtcacgagcgtgtgtatgagaggagaggagtcatatgacggagagcctctccgtccacatcgggcacgacggaaacgaagtcgatgacgcgtgatgggaactttactgactcgagcagggtatccatgctgatgatcatgtggctggagatagagagcgcgggacatcacgatgatggcttcagcaccttcttcagccaaactggtgctggaaaacacgttcaccgagcaagcttcgttgatctacaagccactgccatcgatgaagtgcgtactggcactgaacgtggggtattccaaccagaacgactcatcagtgcgaagcatgatgtcgctaacagattccgccgtgggcactacacaggtgcgaaggatattgttgctgtgtgccttgaccgc

SEQ ID NO: 29492 - protein, 105 aa, Zea mays
  misc_feature: Ceres CLONE 1404430-F
MTRDGNFTDSSRVSMLMIMWLEIESAGHHDDGFSTFFSQTGAGKHVHRASFVDLQATAIDEVRTGTERGVFQPERLISAKHDVANRFRRGHYTGAKDIVAVCLDR

SEQ ID NO: 29493 - DNA, 663 bp, Zea mays
  misc_feature: Ceres CLONE 1404436-F
  misc_feature: Encodes the peptide sequence at SEQ ID NO. 29494
  misc_feature (394)..(394): n is a, c, t, g, unknown, or other
  misc_feature (439)..(439): n is a, c, t, g, unknown, or other
  misc_feature (440)..(440): n is a, c, t, g, unknown, or other
  misc_feature (478)..(478): n is a, c, t, g, unknown, or other
  misc_feature (503)..(503): n is a, c, t, g, unknown, or other
  misc_feature (525)..(525): n is a, c, t, g, unknown, or other
  misc_feature (527)..(527): n is a, c, t, g, unknown, or other
  misc_feature (533)..(533): n is a, c, t, g, unknown, or other
  misc_feature (601)..(601): n is a, c, t, g, unknown, or other
  misc_feature (602)..(602): n is a, c, t, g, unknown, or other
aagctggagctccccgcggtggcggccgctctagaactagtggatcccccgggctgcaggaattcgcacgagaccattacctagaacatcctaatcgaaaaaccagagagtcagagtgcggaggtgaacgtgacgtgacgctcctcctctataaaaggagacgcctgtgctgcagtgtgcacagcacagcccgtcgcgcgccgctgcgttgaggttgagccaaggcgcaatggcaacctccacctcagttcccgtcctcctgctcctcgccgccgccgccggcctcctcctgctccccggctcgctggcgtggcagagcagcaactgtgcaccgggcgcgcccggcagtggctcgccgacgtggccttcacccggctccggctccggcggcggncacagcccgccccaccatagcaagccgcccaagcaccaccatggnncagcgccccagtgcccgccgtgcacccctccgtacgtngctcccgacgctcgcccgtcaccgncgtacgtggccacatatgtccngncgacgnctcgggcatcacccaccacgaacgtggccacataagtccccgtccggccgacgcctcggccctacggnntttaaggggcaccaatatgtcccgtccccccgaagcctcgggcggtacccgccgaagtttc

SEQ ID NO: 29494 - protein, 112 aa, Zea mays
  misc_feature: Ceres CLONE 1404436-F
  misc_feature (71)..(71): Xaa is any aa, unknown, or other
  misc_feature (92)..(92): Xaa is any aa, unknown, or other
  misc_feature (99)..(99): Xaa is any aa, unknown, or other
  misc_feature (100)..(100): Xaa is any aa, unknown, or other
  misc_feature (102)..(102): Xaa is any aa, unknown, or other
MATSTSVPVLLLLAAAAGLLLLPGSLAWQSSNCAPGAPGSGSPTWPSPGSGSGGGHSPPHHSKPPKHHHGXAPQCPPCTPPYVAPDARPSPXYVATYVXXTXRASPTTNVAT

SEQ ID NO: 29495 - DNA, 655 bp, Zea mays
  misc_feature: Ceres CLONE 1404438-F
  misc_feature: Encodes the peptide sequence at SEQ ID NO. 29496
tggagctcaccgcggtggcggccgctctagaactagtggatcccccgggctgcaggaattcgcacgagaccattacctagaacatcctaatcgaaaactcctccgcacaaacgcgtcgcatccgctccacaggatcctctgcgccaccgcaaccgtgagaccgaacgtgccgccgccaatcccgatccgccgacccgtcccagccccgctcgaagccatgtcgccgtcggagccgacgcgggaggagagcgtgtacatggccaagcttgcggagcaggcggagcggtaccaggagatggtcgagttcatggagcgcgtcgcgcgctacgccgggggcgccggcggcggagacgagatctccctgcaagaatacaacgtgctgtccatcacctacaagaaagtaattccaccccctcaagtcctcgcgggggaaaattcaccccatcgaacaaaaggaggaaactctttgccaacaaagcccctagtacgatacattctcgtcttaccggttcaaaaacgaaccccaagttagcctccctcctgcacgggtaaccctcccggctccaccgactcccacattccttaccccccccacgtcaccccccattccccccggacctccacccgaaatacattccctttccccccccccccg

SEQ ID NO: 29496 - protein, 104 aa, Zea mays
  misc_feature: Ceres CLONE 1404438-F
MSPSEPTREESVYMAKLAEQAERYQEMVEFMERVARYAGGAGGGDEISLQEYNVLSITYKKVIPPPQVLAGENSPHRTKGGNSLPTKPLVRYILVLPVQKRTPS

SEQ ID NO: 29497 - DNA, 637 bp, Zea mays
  misc_feature: Ceres CLONE 1404442-F
  misc_feature: Encodes the peptide sequence at SEQ ID NO. 29498
aagctggagctccccgcggtggcggccgctctagattccgtggatcccccgggctgcaggaattctcacgagaccattacctagaacatcctaatcgaaaaatctatattattgttaccaacgagcaacatagaaagtcttttccagtaccaacaatagagcaacattggcgaccacgatatattccctccttatgttccttgctctttctggacgaggtgctaacaacacaatcttcccgcagtgctcacaagctcctatagattcccttcttccccggtaccttccatcaatgatagcttctccatgcgaaaacccaactcttcaatcctatatggtccaacaagcaatcgcagcaagcaacagtaccttcatcacccttgcctcaagaaccgacagcccgatctttgatgcactcattggaacacttcatcaagggactgtagctgggcaactcgtgttacctgtgatcgaccacgtatctctggccaatctttgtacctagtcgcacgaacaacaattccttaccatcaaccaaatgtctacattgtagccgggctccttatttgcgcagccgctattaccaatggtccagagaaatactgtctactctcagggacacctactccttacatgg

SEQ ID NO: 29498 - protein, 103 aa, Zea mays
  misc_feature: Ceres CLONE 1404442-F
MFLALSGRGANNTIFPQCSQAPIDSLLPRYLPSMIASPCENPTLQSYMVQQAIAASNSTFITLASRTDSPIFDALIGTLHQGTVAGQLVLPVIDHVSLANLCT

SEQ ID NO: 29499 - DNA, 648 bp, Zea mays
  misc_feature: Ceres CLONE 1404444-F
aagctggagctccccgcggtggcggccgctctagaactagtggatcccccgggctgcaggaattcgcacgagaccattacctagaacatcctaatcgaaaaatcgtttcttttcctcgtcttcactaacggcggggcaaactctcgaccgaggccgaaagatcttagattccaccttgcggcgcggctctcgaccttcacggcagactacccctctatctcaaagcgttcctggccgccggttcataggagacgacgaatatgacgtggtggatctccgtccacttcggcctctccgccttccaagtcatcaacgactgctgagaattttactggctcgagcacggcatccagcctgatgtccatctgcctggacataagatcgcgtgacatcacgatgatgctcttcttcatcttcgtctaccagactgccgctgataacacttgtctctcgtgacatattcactgatctacatcccactgagatctaggagctgtgcactgacacataccgccagatgctgcaccctgagtatctcgtcaagggagggcggatgacgatatcaattcatacggacctgtacacattgagagggagattgacgatctgagacttgttcgtatccagcagcttgctgacactgcaccg

SEQ ID NO: 29500 - DNA, 633 bp, Zea mays
  misc_feature: Ceres CLONE 1404447-F
  misc_feature: Encodes the peptide sequence at SEQ ID NO. 29501
tggagctccccgcggtggcggccgctctagaactagtggatcccccgggctgcaggaattcgcacgagaccattacctagaacatcctaatcgaaaaatttttcgaccgccgccgcccccagtccccgatccgaagctgtgcctcataccatttcgatccaatggcggcgacgaccaagttgttcatgggcatcatgcgcgcttcgggttcgcacacgtaccatcgccgtgggctgtgggccatcaaggccaagaacggcggcgccttccccaaggccgacaagggcgccgccgccgtggaacccaagttctaccctgccgacgacgtcaagacccgcgttcccagcacccggaagcctaagcctaccaagctcaggtcgaggatcacgcctgcaacgctgataatcctcctcgcaaggcgcttcatgggaaagagagtggtgtttctcaagcagctcaggtctggtctgctccttatctctggggctttcaagatcgatggagtaccgatccgccgtgtgaaccagacctatgtcattgctacatcaaccaaagttgacatctctggcgatgatgtcaccaagtttgatgagaagtactttgccagggagaagaagcagaaggtgaagaaga

SEQ ID NO: 29501 - protein, 157 aa, Zea mays
  misc_feature: Ceres CLONE 1404447-F
  misc_feature (112)..(157): Pfam Name: Ribosomal_L6e Pfam Description: Ribosomal protein L6e
  misc_feature (1)..(49): Pfam Name: Ribosomal_L6e_N Pfam Description: Ribosomal protein L6, N-terminal domain
MAATTKLFMGIMRASGSHTYHRRGLWAIKAKNGGAFPKADKGAAAVEPKFYPADDVKTRVPSTRKPKPTKLRSRITPATLIILLARRFMGKRVVFLKQLRSGLLLISGAFKIDGVPIRRVNQTYVIATSTKVDISGDDVTKFDEKYFAREKKQKVKK

SEQ ID NO: 29502 - DNA, 604 bp, Zea mays
  misc_feature: Ceres CLONE 1404452-F
  misc_feature: Encodes the peptide sequence at SEQ ID NO. 29503
  misc_feature (154)..(154): n is a, c, t, g, unknown, or other
  misc_feature (232)..(232): n is a, c, t, g, unknown, or other
  misc_feature (235)..(235): n is a, c, t, g, unknown, or other
  misc_feature (262)..(262): n is a, c, t, g, unknown, or other
  misc_feature (279)..(279): n is a, c, t, g, unknown, or other
  misc_feature (280)..(280): n is a, c, t, g, unknown, or other
  misc_feature (282)..(282): n is a, c, t, g, unknown, or other
  misc_feature (535)..(535): n is a, c, t, g, unknown, or other
aagctggagtccccgcggtggcggccgctctagaactagtggatcccccgggctgcaggaattcgcacgagaccattacctagaacatcctaatcgaaaactgaattcttttctactagagctagagccaggcagccagccaacgccaagcggngtaggttgactcttctgtctacagcacctacctcttcacaccaactgccgcccctgctccgagaaccagaatgcccgncgncgatgcatcttcggtggctcccgtcgncatcacctggcgagcgnngntggcgtggggaccgggccagccactggtgatggaggaaggggagtcgccccgccggggcccatggagatccggggcaggggcgtctcccccttcggctggcggagggaacttcctggctgggaaacccagctgaaaggctgagaccaacgatctccctgaccgaaattggccaccgggggctcctcccaattcaacatggaggcggcacttggatctgtcccccgagagctccggcacgaggatcccgagtanatagagagtcccggaaagggggaaccagatcccaaggcggggaccaggttcacttgctcctttggggga

SEQ ID NO: 29503 - protein, 63 aa, Zea mays
  misc_feature: Ceres CLONE 1404452-F
  misc_feature (3)..(3): Xaa is any aa, unknown, or other
  misc_feature (4)..(4): Xaa is any aa, unknown, or other
  misc_feature (13)..(13): Xaa is any aa, unknown, or other
  misc_feature (19)..(19): Xaa is any aa, unknown, or other
  misc_feature (20)..(20): Xaa is any aa, unknown, or other
MPXXDASSVAPVXITWRAXXAWGPGQPLVMEEGESPRRGPWRSGAGASPPSAGGGNFLAGKPS

SEQ ID NO: 29504 - DNA, 640 bp, Zea mays
  misc_feature: Ceres CLONE 1404453-F
  misc_feature: Translation starting site: 222
  misc_feature: SWISSPROT Homolog: EC 1.1.1.1 Alcohol dehydrogenase
tggagctccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaagctgagagcctgagacaaacgatctctctgatcgaatttgctcatctgtgttctcttccaattccaacatgcaggcgcaacttgatctgttccccagagtcttcggccacgaggcatccggagtagtagagagtgtcggtgaaggtgtgaccgagttccaagtcggtgaccacgttctcactgtcttcattggggaatgcaagagctgcaagcactgcgtctcagggaaga

SEQ ID NO: 29505 - DNA, 639 bp, Zea mays
  misc_feature: Ceres CLONE 1404454-F
  misc_feature: Translation starting site: 222
  misc_feature: SWISSPROT Homolog: EC 1.1.1.1 Alcohol dehydrogenase
  misc_feature: SWISSPROT Homolog: EC 1.2.1.66 Mycothiol-dependent formaldehyde dehydrogenase
tggagctccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaagctgagagcctgagacaaacgatctctctgatcgaatttgctcatctgtgttctcttccaattcccacatgcaggcgcaacttgatctgttccccagagtcttcggccacgaggcatccggagtagtaaagagtgtcggtgaaggtgtgaccgagttccaagtcggtgaacacgttctcactgtcttcattggggatgcaagagctgcaagcactgcgtctcagggaaga

SEQ ID NO: 29506 - DNA, 629 bp, Zea mays
  misc_feature: Ceres CLONE 1404456-F
  misc_feature: Encodes the peptide sequence at SEQ ID NO. 29507
aaagtggagctccccgcggtggcggccgctctagatctagtggatcccccgggctgcaggaattcgcacgagaccattacctagaacatcctaatcgaaaaatactcctccggatccgtgttccatcacggctacaaaaatactccgcctgcatctccaaagcacacggctccctctggtttcccgcctcctcttcacctccttcgcgccccgacgctccctcatggacgccgctgccgcagcaacagcagcagtttcctccccgattgctccacgcgctgtggacgacgcggactcccgccgggagttcgtcacgtttggtggaggcgccgcccgctcctcgcccacgctgcggtccggtcgcgacttctctgatgatgaaacccatgttgccgatgatgaacaagcagttgtaaaagatgctaccaagctggaagctccagttgtcgatgttacaggtgcctctagagggattggaaaggcaactgctctagtccttaggaaagcaggatgccaggttctggtaaattatgctcggtcttcgatagaggctgaagaggtctccaaagagattgaagcatctgctggagaggctatcaccttttggaggagatgtttcaaaagaagcg

SEQ ID NO: 29507 - protein, 135 aa, Zea mays
  misc_feature: Ceres CLONE 1404456-F
  misc_feature: SWISSPROT Homolog: EC 1.1.1.100 3-oxoacyl-[acyl-carrier-protein] reductase
MDAAAAATAAVSSPIAPRAVDDADSRREFVTFGGGAARSSPTLRSGRDFSDDETHVADDEQAVVKDATKLEAPVVDVTGASRGIGKATALVLRKAGCQVLVNYARSSIEAEEVSKEIEASAGEAITFWRRCFKRS

SEQ ID NO: 29508 - DNA, 628 bp, Zea mays
  misc_feature: Ceres CLONE 1404458-F
  misc_feature: Encodes the peptide sequence at SEQ ID NO. 29509
aagctggagctccccgcggtggcggccgctctagaactagtggatcccccgggctgcaggaattcgcacgagaccattacctagaacatcctaaacaaaacacgcattcattcagctagcgagcgagagagaggggaacaaaaaggaagggcgaggaggacagggagccgagcgcaagagctgaggcttcgccgcgaaaccccagacctcgcgccgccccttcccctccgcggcgtcgtcctcgcacgctctccgatccaagatgtataacctggtgagaggaaaccgcgaccaggcgcagcagttcatgaccattaccggcgccagtgagaaggatgcccttcaggcactgaaagctagtgattggcacttggaaggagctgttgacttcttctatagccaagctcagggctctgtggtcaatactcggcatcttgaagatattttcaacagatataaagaacctgatgctgatatgataatggtggaaggaatatctcaattttgcaaggatctgcaggctgatcctcacgatattgtcatgcttgtcatatcatggcacatgaaagccgccacaatgtgtgaatttactcgtcaggaattcattggcggactgcagtcaattggg

SEQ ID NO: 29509 - protein, 122 aa, Zea mays
  misc_feature: Ceres CLONE 1404458-F
  misc_feature (7)..(44): Pfam Name: UBA Pfam Description: UBA/TS-N domain
MYNLVRGNRDQAQQFMTITGASEKDALQALKASDWHLEGAVDFFYSQAQGSVVNTRHLEDIFNRYKEPDADMIMVEGISQFCKDLQADPHDIVMLVISWHMKAATMCEFTRQEFIGGLQSIG

SEQ ID NO: 29510 - DNA, 634 bp, Zea mays
  misc_feature: Ceres CLONE 1404459-F
  misc_feature: Encodes the peptide sequence at SEQ ID NO. 29511
  misc_feature (519)..(519): n is a, c, t, g, unknown, or other
aagctggagctccccgcggtggcggccgctctagaactagtggatcccccgggctgcaggaattcgcacgagaccattacctagaacatcctaatcgaaaaatttttcgaccgccgccgcccccagtccccgatccgaagctgtgcctcgtaccatttcgatgcaatggcggcgacgacgaagttgtccacgggcatcaagcgcgcttctggtacgcacacgtaccatcgccgcgtgctgtggtccatcaaggccaagaacggcgtcgccttccccaaggccgacaagggcgccgccgccgcgtacaccaagttctaccctgccgacgacgtcaagccccgcgttcccagcacccgcaagcctaagcctaccaagctcaggtcgagcatcacgcctgagacggtgctgatcctcctcgaagggcgcttcatgcggaatagagtgatgaatctcaagcagctgcggtctgggctgctccttatctctgggcctttcaagatctatggactaccgatccgncgtgtgaaccatacctatgtcattgctacatcaaccaaagtcgacatctctggtgttgatgtcaccaagtctgatgacaagtactttgccaaggagaagaagcacaaggtgacga

SEQ ID NO: 29511 - protein, 156 aa, Zea mays
  misc_feature: Ceres CLONE 1404459-F
  misc_feature (112)..(154): Pfam Name: Ribosomal_L6e Pfam Description: Ribosomal protein L6e
MAATTKLSTGIKRASGTHTYHRRVLWSIKAKNGVAFPKADKGAAAAYTKFYPADDVKPRVPSTRKPKPTKLRSSITPETVLILLEGRFMRNRVMNLKQLRSGLLLISGPFKIYGLPIRRVNHTYVIATSTKVDISGVDVTKSDDKYFAKEKKHKVT

SEQ ID NO: 29512 - DNA, 630 bp, Zea mays
  misc_feature: Ceres CLONE 1404468-F
  misc_feature: Encodes the peptide sequence at SEQ ID NO. 29513
aaagctggagctccccgcggtggcggccgctctagaactagtggatcccccgggctgcaggaattcgcacgagaccattacctagaacatcctaatcgaaaaatacccacaaccaccaccaccagcagcagctgaggatgggcgacgcggccatcgccgccgtgcatttgcatgagtctgatgaggagcacatcttgcggatgacgatccctgccgtgctcgtaccagacgacgtcaccgtgccggtactcgtgctggctgaactcgaggactacgtggacaaaaccgtcctcgtgaaggccccgccgagttgcccgttctaaacctaccaggaacttgcccccgaaaggggggcgcatctccaaagcgcctgtgtgtcatctgccgtccccaaggggcacgggaaaggtgggccctctccccaaaaatggcggggtaccccgccggggagccccccgataattttccccccggaagggccttcttcccccttgaaaacacccggccctttggccccccaaaaaaaaaaaaaaaaagggggggaaccccttgaggccccctccttgggaaccccaacacaccggggccctctaccaagtggaaacacccccttgttggcccccccgaaaa

SEQ ID NO: 29513 - protein, 61 aa, Zea mays
  misc_feature: Ceres CLONE 1404468-F
MGDAAIAAVHLHESDEEHILRMTIPAVLVPDDVTVPVLVLAELEDYVDKTVLVKAPPSCPF

SEQ ID NO: 29514 - DNA, 594 bp, Zea mays
  misc_feature: Ceres CLONE 1404471-F
  misc_feature: Encodes the peptide sequence at SEQ ID NO. 29515
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (122)..(122): n is a, c, t, g, unknown, or other
  misc_feature (280)..(280): n is a, c, t, g, unknown, or other
  misc_feature (291)..(291): n is a, c, t, g, unknown, or other
  misc_feature (321)..(321): n is a, c, t, g, unknown, or other
  misc_feature (332)..(332): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnccccnnnaaaannnnnnnnnnnnnnnnnttcaaaactggaactccccncggtgggcggccgctctagaactagtggatcccccgggctgcaggaattcgcacgagaccattacctagaacatcctaatcgaaaaacggatcaaaatcgaatccaacgctactgcctagggtttcctctgcatttcccctaccacaccccgcgccgnccacccatggncgccgcagacgcgtccgccgagaccgccgncatcgcggggngcctggcctcctgcaaaccgggaacccgggaaggggggctccggtacctccctctccgaatttttggcgggctccggggcggggctttccggcaacgaactccctaaggttttggaaggggcattttcttttttggttttgggaaacccccaaaaacccctttaccaaaaaatcccgggccctcgccctccgcgggtttccggcccccggggcccccccggaggggggggccgcttttttttggggggataaaattaaaaag

SEQ ID NO: 29515 - protein, 50 aa, Zea mays
  misc_feature: Ceres CLONE 1404471-F
  misc_feature (2)..(2): Xaa is any aa, unknown, or other
  misc_feature (12)..(12): Xaa is any aa, unknown, or other
  misc_feature (16)..(16): Xaa is any aa, unknown, or other
MXAADASAETAXIAGXLASCKPGTREGGLRYLPLRIFGGLRGGAFRQRTP

SEQ ID NO: 29516 - DNA, 577 bp, Zea mays
  misc_feature: Ceres CLONE 1404479-F
ggagctccccgcggtggcggccgctctagaactagtggatcccccgggctgcaggaattcgcacgagaccattacctagaacatcctaatcgaaaaaccattcgaaagatccctccaggaaagatttttctttccctcctccgacgccccagcccaccaacacactctataaagcagccccccagtcacacacagaacggacaagcgcaagcaggcaaagaaaactccgcaaggcaatctgcgcgagttggatggccttcctctttgggccccgggggcatcccccgccttggtaagcatcgcccccaaaggtcagaaaaatcccttgggaaaagggaaaaagccccttcccgggcccggggaggggcggctccccgggaaagggcccccggggccccggggggggcgcttacctggggggaaaccccccgtttttttccccaggacccccgggggttttttttttttcaaaaaaaaaaagggggggggggaatttttaaagaaccccctctttggggccccccgggggggggttgggcgaaacccccggggggggcggggtttttggggtgggaac

SEQ ID NO: 29517 - DNA, 612 bp, Zea mays
  misc_feature: Ceres CLONE 1404484-F
  misc_feature: Encodes the peptide sequence at SEQ ID NO. 29518
  misc_feature (201)..(201): n is a, c, t, g, unknown, or other
  misc_feature (294)..(294): n is a, c, t, g, unknown, or other
ggagctccccgcggtggcggccgctctagaactagtggatcccccgggctgcaggaattcgcacgagaccattacctagaacatcctaatcgaaaaatcattcctctcgagtagtcgatcggagtcaggagatgggcgcgtctggtggtgaaaagcttggtactcttgtgtgtgttcttgcacatgtatcgttattattgntgctcgtgctagcaccgtgtgtgtgcaaggcgactggtggtgactacggggggctctccaacgaccactacaccgagtcctgcccggagctgnaaaccatcgtcaagaaatccctgggcgccgaatcttccccggggaaattaccttcgcggccggcctcctccggctggtctttccaggaatggcaagtcccacgaatgggaaccgtttcctaattggtcaaattccgaagagaggccgggacataaaccccgggaaatgtggttcccccaaaaaaccccctggatccggaacccctcggaaccccctgggtttttaaaaaagggccccggaaaaaagcccttccccctgtggcggtttcccttggggcgaaaattttttttctttgtgggaaaaagaaagcccccgggg

SEQ ID NO: 29518 - protein, 94 aa, Zea mays
  misc_feature: Ceres CLONE 1404484-F
  misc_feature (24)..(24): Xaa is any aa, unknown, or other
  misc_feature (55)..(55): Xaa is any aa, unknown, or other
MGASGGEKLGTLVCVLAHVSLLLXLVLAPCVCKATGGDYGGLSNDHYTESCPELXTIVKKSLGAESSPGKLPSRPASSGWSFQEWQVPRMGTVS

SEQ ID NO: 29519 - DNA, 663 bp, Zea mays
  misc_feature: Ceres CLONE 1404495-F
  misc_feature: Encodes the peptide sequence at SEQ ID NO. 29520
  misc_feature (440)..(440): n is a, c, t, g, unknown, or other
  misc_feature (482)..(482): n is a, c, t, g, unknown, or other
  misc_feature (544)..(544): n is a, c, t, g, unknown, or other
  misc_feature (545)..(545): n is a, c, t, g, unknown, or other
  misc_feature (596)..(596): n is a, c, t, g, unknown, or other
cgcggtggcggccgctctagaactagtggatcccccgggctgcaggaattcgcacgagaccattacctagaacatcctaatcgaaaaaaaccaacaggtgttgcctgcccaagtgcccagcctcgcttctccagtcaattctcagcctcgtcctccgcctccctcccgctctctcctctccttggcctccgcttccgctcctgcctggaggctgcatcaaaccctaccgctccggacctcccggctggccgcgagatgcgacgcctgtccggcccctaatccttctcctcgatactgcccctcgcccgcccgcccgccggcatgggccgctacgggcccttccctgccgccgccggtgatggcgggggctgcctgcccctgccgattgtagcggctgaaggcgcgctggctgtcctggacggcgccattgcgaccgcggncttcgtgcagttagcaaggattcataggcacaaccagctacnaggatggactcggcaaaagatattccattttatgattggcctatcaaacatagtatcctagnnatatttcgtgtctaccatcattgcctacttgcaaaagatggatttgctggnaaatgggaatgggggattttgttctccatgcaaggccaaagaaaattgcttctgggtccttcccctg

SEQ ID NO: 29520 - protein, 73 aa, Zea mays
  misc_feature: Ceres CLONE 1404495-F
  misc_feature (40)..(40): Xaa is any aa, unknown, or other
  misc_feature (54)..(54): Xaa is any aa, unknown, or other
MGRYGPFPAAAGDGGGCLPLPIVAAEGALAVLDGAIATAXFVQLARIHRHNQLXGWTRQKIFHFMIGLSNIVS

SEQ ID NO: 29521 - DNA, 623 bp, Zea mays
  misc_feature: Ceres CLONE 1404503-F
  misc_feature (338)..(338): n is a, c, t, g, unknown, or other
  misc_feature (340)..(340): n is a, c, t, g, unknown, or other
  misc_feature (548)..(548): n is a, c, t, g, unknown, or other
  misc_feature (549)..(549): n is a, c, t, g, unknown, or other
tcacccgcggtggcggccgctctagaactagtggatcccccgggctgcaggaattcgcacgagaccattacctagaacatcctaatcaaaaacccacgagtacaaacagcggaagatcgcctccacgcgagtcaagcgcccgcaaaaccctagccgcgcccgccccaaaccctaggcggctagcggtctccgatcccggtgtcacgtactaatggtatcttcgccggacttgttcatcaacgatacattctccgacgtatccgaagccgcagtgggttctgccgccgacggggccactgtcgtattcagcgctcggtgactctactggatgctggggncntccaacttcggtagggctaggccgatacatggtgccagatcaacatcgcgaaacgcaggatttaacgtgagacccaccgaacgcttggggatgggaaaattgggagtttaggagggcgggaaaagaaccttttcaggggaaaaaaggttgttttagaccaaaactggatgaaaggcctcctttaagttttccggggggggccccaaanntttagggaaaaacccggaaacgttgggaaaaggaaacaaaagggtcaaaaaaaaattttgtcacaaaatttggg

SEQ ID NO: 29522 - DNA, 673 bp, Zea mays
  misc_feature: Ceres CLONE 1404504-F
  misc_feature: Translation starting site: 158
  misc_feature: SWISSPROT Homolog: EC 4.1.1.19 Arginine decarboxylase
cgcggtggcggccgctctagaactagtggatcccccgggctgcaggaattcgcacgagaccattacctagaacatcctaatcgaaaaacacaccacagcactaaaatctgttcatctctggctccccaaattcagctggagagcactttttcccatcatggataagaactacggtgaactctacaacatcctcggatggggtgaggagtacttcgcggtgaacacggaggggcacctcagcgtgaagcctttcggccgctggacggagcccgggcaggagatcgacgtgcactcggtcatcgtggaagctctagcgacccacccaacgacagcaccagcaaatctcagttccccatgatccttcgcttccccgacgtgctcaagaaacgtatcgagacgctccataacgcattcaacagggccatgaaggccaccgggtacacgccaggaaccaaggcggttcccggacaaagggacccaaacaaggccgccgggagaaaaggggttaaggtccgccaaaaaggaactttgggctcgggggctggccccaaacaaaaatggttcacccctggagtggccccccggcccaaaagcgggcccaaagcgtttttttttttgaaggggtaaaagagggggggaaaaaacccgcggccccgcctcccgggggggggca

SEQ ID NO: 29523 - DNA, 648 bp, Zea mays
  misc_feature: Ceres CLONE 1404505-F
  misc_feature: Translation starting site: 162
  misc_feature: Pfam Name: PsbQ Pfam Description: Oxygen evolving enhancer protein 3 (PsbQ)
  misc_feature (261)..(261): n is a, c, t, g, unknown, or other
  misc_feature (500)..(500): n is a, c, t, g, unknown, or other
  misc_feature (510)..(510): n is a, c, t, g, unknown, or other
tccccgcggtggcggccgctctagaactagtggatcccccgggctgcaggaattcgcacgagaccattacctagaacatcctaatcgaaaagctcgaccggaccgacgagcgacgaagcgcgcagaaagagaagaacctcggagctgagatggcacaagccatggcgtcgatgaccggcctctcgcagggcgtcctgcccagcaggcgcgccgacagcagaaccaggacggccgtcgtcatcgtcagggcgtccgcggagnggcgacgccgttgcgcaggcgggccgccgcgccgtgatcgggctggtggcctgggcaatcgtcggcggcgccttgtcgcaggcggcgcgcgccgagaccgtcaagaccatcaagattggagccccgccgccgccctccggtggactccccgggactctcaactctgaccaggcgagggacttcgacctcccttgggaaggagcggttctacctgcagccgctgccgccggcggaggcgncggcgagggntgaagacgtcggcgcaggacatcatcaacctcaagccgctcatcgacaagaaggcgggggccgtacgtccagaacgacctccgcctccggggctcctacctgcgctacgaccttcagaccgtcatcgcttccaggccc

SEQ ID NO: 29524 - DNA, 613 bp, Zea mays
  misc_feature: Ceres CLONE 1404508-F
  misc_feature: Encodes the peptide sequence at SEQ ID NO. 29525
  misc_feature (354)..(354): n is a, c, t, g, unknown, or other
aaagctggagctccccgcggtggcggccgctctagaactagtggatcccccgggctgcaggaattcgcacgagaccattacccagaacatcctaatcgaaaacactgaaacgaaattaccctatagggatgagatttaaaatgaggtttgaaggtgaagaggctccagaacaaaggttcactgggaccattgttggaaatgtggatcctgatcaagctggatgggctgaatctaaatggcgttacctcaaggtgaggtgggatgaagcttcctcattcacgtcctgaaaggtttctccctggcaatagaactgcagtcagccctccccctatcaccgcttcagtgacagacccnagagacgcgctctaagctgtagcttctctgcccgagtctcagctcaacaaaggagctgctccaagtcccattagagactccacacatggcctgcaagggcctttgaaaaccagaataatggggcccgaaaaagggttttgggaaaacaggggaattggatctggttaaaaagcccccctggggaaccgtcaggttttttattgggaaaaagacccccttgggtttttaaaaaagaaaacttgggtccccaaaatatttg

SEQ ID NO: 29525 - protein, 52 aa, Zea mays
  misc_feature: Ceres CLONE 1404508-F
  misc_feature (1)..(41): Pfam Name: Auxin_resp Pfam Description: Auxin response factor
  misc_feature: The sequence is a functional homolog of SEQ ID NO 2380 in the 10/374,780 US patent application
  misc_feature: The sequence is a functional homolog of SEQ ID NO 962 in the 10/225,066 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 100 in the 10/666,642 US patent application
  misc_feature: The sequence is a functional homolog of SEQ ID NO 576 in the 10/666,642 US patent application
  misc_feature: The sequence is a functional homolog of SEQ ID NO 696 in the 11/479,226 US patent application
MRFKMRFEGEEAPEQRFTGTIVGNVDPDQAGWAESKWRYLKVRWDEASSFTS

SEQ ID NO: 29526 - DNA, 677 bp, Zea mays
  misc_feature: Ceres CLONE 1404509-F
  misc_feature: Encodes the peptide sequence at SEQ ID NO. 29527
  misc_feature (476)..(476): n is a, c, t, g, unknown, or other
  misc_feature (551)..(551): n is a, c, t, g, unknown, or other
  misc_feature (552)..(552): n is a, c, t, g, unknown, or other
  misc_feature (593)..(593): n is a, c, t, g, unknown, or other
  misc_feature (677)..(677): n is a, c, t, g, unknown, or other
tccccgcggtggcggccgctctagaactagtggatcccccgggctgcaggaattcgcacgagaccattacctagaacatcctaatcgaaaaaaaaggttcgagacgcgcaccgccagccgatacgaatccgacgagctcgatcgctccacttccccgatcgcacgccaatcagcaccagccaccgtggcgatgacggaggaggcggaggcgaaggcgaagggcaacgcggcgttcgcggccggccgtttcgaggaggctgtccagcacttcagcgacgccatcgcgctcgcgcccgacaaccacgtcctctactccaaccgctcggcggcgtacgcgtcgctctggcgctacgcggaggcgctagatgacgccaagcggaccgtggcgctgaagccggactgggccaagggctactcccgcctcggcgccgcgcaccttggcctcggtgacgcgcccaaggccgtcgaggcctacngagaaagggcttgcgctcgagccgtccaatgaggcgctcaaatccggcctcgcacaggcgcgccagtccgcacgnncgccgagaaacgtccggtggggcttccggggctggacgcgntttggcaagaatgttccagggccctgagcttatgggagcccaagggtcgcggccgatcccccaccacggcgtgggctacctcgn

SEQ ID NO: 29527 - protein, 105 aa, Zea mays
  misc_feature: Ceres CLONE 1404509-F
  misc_feature (4)..(37): Pfam Name: TPR_2 Pfam Description: Tetratricopeptide repeat
  misc_feature: SWISSPROT Homolog: EC 3.1.3.16 Phosphoprotein phosphatase
  misc_feature (96)..(96): Xaa is any aa, unknown, or other
MTEEAEAKAKGNAAFAAGRFEEAVQHFSDAIALAPDNHVLYSNRSAAYASLWRYAEALDDAKRTVALKPDWAKGYSRLGAAHLGLGDAPKAVEAYXERACARAVQ

SEQ ID NO: 29528 - DNA, 674 bp, Zea mays
  misc_feature: Ceres CLONE 1404512-F
  misc_feature: Encodes the peptide sequence at SEQ ID NO. 29529
  misc_feature (674)..(674): n is a, c, t, g, unknown, or other
ctcggtggcggccgctctagaactagtggatcccccgggctgcaggaattcgcacgagaccattacctagaacatcctaatcgaaaacattgaatttggccgagtaacagaaccgtgtctgtttttaattcctgacggttagagatggcccacccctccgccgccgccgtatcctccacggcgctcgctgcaaaccctagctctggcgccagcgaggaaggaggcgcccgctctccgccgtcgccgtctcagagggggcgggccaaggtggtgatcgttatgggcgccacgggcgccggcaagtcgcggctggccgtcgacctcgcggcccacttcgccggcgtcgaggtggtcagcgccgactccatgcagctctaccgcggcctcgacgtcctcaccaacaaggctcccctccacgagcagaacggtgttcctcatcatctacttagcgtgattgatccctctgccgagttcactttgccgtgatttccgcgaccgtgccctgccgattataacaggaaatagtgcgaccgcggcggcgccccccggtggttggccggcggcaacaaacttctaaatccagggctcccgtaagaccatttcctacttggaaggataggccacaaaaaagtgcccaccgctgcccttctcacagatcttcctcgcgcggccgn

SEQ ID NO: 29529 - protein, 113 aa, Zea mays
  misc_feature: Ceres CLONE 1404512-F
  misc_feature: SWISSPROT Homolog: EC 2.5.1.8 tRNA isopentenyltransferase
MAHPSAAAVSSTALAANPSSGASEEGGARSPPSPSQRGRAKVVIVMGATGAGKSRLAVDLAAHFAGVEVVSADSMQLYRGLDVLTNKAPLHEQNGVPHHLLSVIDPSAEFTLP

SEQ ID NO: 29530 - DNA, 631 bp, Zea mays
  misc_feature: Ceres CLONE 1404516-F
  misc_feature: Translation starting site: 167
  misc_feature: SWISSPROT Homolog: EC 3.5.1.14 Aminoacylase
  misc_feature (600)..(600): n is a, c, t, g, unknown, or other
aaagctggagctccccgcggtggcggccgctctagaactagtggatcccccgggctgcaggaattcgcacgagaccattacctagaacatcctaatcgaaaaatatttcagtcgtcgctcgcggagccgtggcgcatcgcgactcaggcactcaccgaccgcggatatggccccgccgccatggcctctccttgcgacttccctcctcctcatcctattccaccactcgcctcgcgccgcggtggcgtttccgccgtctctgggcgacagcctcctgggcgccgcccgcgcgccgggtttcgcggcttggctgcgcggcttgcggcgccgcatccacgagcgccccgagctcgccttccaggagcaccgcaccagcgagctcgtccgcgacgagctcgacgcgatcggggtgccgtacgcgtggcccgtcgcgcagacgggcgtcgtgcgaccatcgccggcggagcgatggccccgtcgtcgcgctccgagccgacatggacgcgctacccttgcagggaatggtagactgggaaacacagagcaaggagagtggaaagatgcatgcttgtggacatgatgctcacaccacgatgcttncttggggcagctaaaatggctcaatgctcgg

SEQ ID NO: 29531 - DNA, 490 bp, Zea mays
  misc_feature: Ceres CLONE 1404526-F
  misc_feature (194)..(194): n is a, c, t, g, unknown, or other
  misc_feature (342)..(342): n is a, c, t, g, unknown, or other
tggagctccccgcggtggcggccgctctagaactagtggatcccccgggctgcaggaattcgcacgagaccattacctagaacatcctatcgaaaaatcatcatccaatcagatcagcaaagcggcagtgcgtagagaggatcgtcgaacagaacagcatgaagatggtcatcgttctcgtcgttggccctggnttctgccagctgccagggcctctggaatgaaaaagggccctggcccttggggggggggttttgaggggttttttgtaccgcgggttttttgggcccccccccccttaaaaaaaaaaaaaatattttggggggggcccccccccggggntttttttgtcccccccccccctccggggggggggatcccccctgggggggggggccccccccccccgggggggggggccccccccccccgttttttggtggggggggggggccgggccccccctcctctataaaatgagggggggggg

SEQ ID NO: 29532 - DNA, 684 bp, Zea mays
  misc_feature: Ceres CLONE 1404528-F
  misc_feature: Encodes the peptide sequence at SEQ ID NO. 29533
  misc_feature (527)..(527): n is a, c, t, g, unknown, or other
  misc_feature (532)..(532): n is a, c, t, g, unknown, or other
  misc_feature (540)..(540): n is a, c, t, g, unknown, or other
  misc_feature (554)..(554): n is a, c, t, g, unknown, or other
  misc_feature (634)..(634): n is a, c, t, g, unknown, or other
  misc_feature (641)..(641): n is a, c, t, g, unknown, or other
agagctggagctccccgcggtggcggccgctctacaactagtggatcccccgggctgcaggaattcgcacgagaccattacctagaacatcctaatcgaaaatcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctactttctggtgttcgccatcctggccgncgtgntgggcgcngcgtccaagctggncggcgtgcacacgtgcgcgcctggcgcacgacagcctggccaccacgccgcgtcgtcgctcatcgcctggggcatcacgncgctcgncttcgggttgccctgcaaggaaaccacatcggcggaacccgcg

SEQ ID NO: 29533 - protein, 113 aa, Zea mays
  misc_feature: Ceres CLONE 1404528-F
  misc_feature (14)..(112): Pfam Name: AWPM-19 Pfam Description: AWPM-19-like family
  misc_feature (61)..(61): Xaa is any aa, unknown, or other
  misc_feature (63)..(63): Xaa is any aa, unknown, or other
  misc_feature (70)..(70): Xaa is any aa, unknown, or other
  misc_feature (97)..(97): Xaa is any aa, unknown, or other
  misc_feature (99)..(99): Xaa is any aa, unknown, or other
MAGIGRNMVAPLLVLNLIMYIIVIGFASWNLNHFINGQTNYPGVAGNGATFYFLVFAILAXVXGAASKLXGVHTCAPGARQPGHHAASSLIAWGITXLXFGLPCKETTSAEPA

SEQ ID NO: 29534 - DNA, 623 bp, Zea mays
  misc_feature: Ceres CLONE 1404531-F
  misc_feature: Encodes the peptide sequence at SEQ ID NO. 29535
  misc_feature (442)..(442): n is a, c, t, g, unknown, or other
  misc_feature (486)..(486): n is a, c, t, g, unknown, or other
  misc_feature (518)..(518): n is a, c, t, g, unknown, or other
  misc_feature (529)..(529): n is a, c, t, g, unknown, or other
  misc_feature (536)..(536): n is a, c, t, g, unknown, or other
tggagctccccgcggtggcggccgctctagaactagtggatcccccgggctgcaggaattcgcacgagaccattacctagaacatcctaatcaaaaatccccgctcactcccgtccccatcccacgcgatggccttccgcctcgccgtcgccgtctccgtcgcagcgcctgcgtcgtggccttccccggtcgccaccttcgccccgccccgcctcgccctccgccgaggcctcccgccgacgtggcgcgcagttcgcgccctcccgcgttcccgtggcgccgtcgtggtgtgccaggcccagggcggccaggacactgcaatccaagttcctgatgtgagcaaatccacatggcaatcacttgtggtggagagcgagcttcccgtcctttgttgagtctgggcttcatggtgcggaccgtgtaagatgatagaccccatcgntggcaagctctcaaaggagtacgaaaggaagctgaaatgttacnagctaaacaccgacgaggaccctgacatcgcnacccaattcgncatcggnagcatccccaccatgatgatattcaagacggggagaaaaaggactcggtgattgggagcgtgccaaaaaagaccctcggacctgatt

SEQ ID NO: 29535 - protein, 88 aa, Zea mays
  misc_feature: Ceres CLONE 1404531-F
MAFRLAVAVSVAAPASWPSPVATFAPPRLALRRGLPPTWRAVRALPRSRGAVVVCQAQGGQDTAIQVPDVSKSTWQSLVVESELPVLC

SEQ ID NO: 29536 - DNA, 681 bp, Zea mays
  misc_feature: Ceres CLONE 1404535-F
  misc_feature: Encodes the peptide sequence at SEQ ID NO. 29537
tggagctccccgcggtggcggccgctctagaactagtggatcccccgggctgcaggaattcgcacgagaccattacctagaacatcctaatcgaaaagcaggatattctagacgcactggcgcgcatggaggcacgcttgaccgatgcgctgatgggtcgctgcggcgagcagtacgcacgcgagcacacttcccccttcgacggatccgcgcctccttcttccatcgtcaacacacagtaccgcgacgaggtaatccttccgcctctcgtccacgacgacgctgcgaaggtggcgtccttggattcgggaaacgactttggcctgcagcagaccgccacggtgcttgcgtccctagggtccgacgagatgtcttcgtcgaccatgcccctcgccggctccatatccgaccgctacattccgccgctctacgacgacgactgctacaccatgccacagccgtttgtcgatactctcgccaaccccgacgatgacctcctccaggagctcgacgtgttggacgaggatgccacgagcgccaacgcggctgacgacgattcaggcgctgtcctcgtctatgcgccgctcgactcgaacatcgacagcagcggatcaccgcgctcccgggctccccaaggggggggggggggttgttccatcgggacccgggacgagaggcctc

SEQ ID NO: 29537 - protein, 185 aa, Zea mays
  misc_feature: Ceres CLONE 1404535-F
MEARLTDALMGRCGEQYAREHTSPFDGSAPPSSIVNTQYRDEVILPPLVHDDAAKVASLDSGNDFGLQQTATVLASLGSDEMSSSTMPLAGSISDRYIPPLYDDDCYTMPQPFVDTLANPDDDLLQELDVLDEDATSANAADDDSGAVLVYAPLDSNIDSSGSPRSRAPQGGGGGCSIGTRDERP

SEQ ID NO: 29538 - DNA, 815 bp, Zea mays
  misc_feature: Ceres CLONE 1404541-F
tgagcccactctccccgtccatacctcaccgccacaaatcgccccccacacaaaactggcactccccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggccccggccacatccaagtcgccgcctccggccccggtcacacccaagccgccgactccggccccggccacacccaagccgccgccagcgggggaggagaaggccggtggcgcggtggtggagctcaccggccgccccggcggagggttaaacggggagggcgccgccgcctgcggacgacgcggggcacggaggtggtcgcgaatcaacgcgccgcaggcgggcggcccaagccacgcatggttctacccccacggcaaacgcccgcgcacctcggccacaatcgacgagctctttcatccgaggttcaaacgccacccctcaaggtcacccccgatggggggcaatggactattccccgcgccactggggcctatctaaccgggccacagctccaaacgataaccacaacaccat

SEQ ID NO: 29539 - DNA, 690 bp, Zea mays
  misc_feature: Ceres CLONE 1404542-F
  misc_feature: Encodes the peptide sequence at SEQ ID NO. 29540
  misc_feature (516)..(516): n is a, c, t, g, unknown, or other
  misc_feature (538)..(538): n is a, c, t, g, unknown, or other
  misc_feature (539)..(539): n is a, c, t, g, unknown, or other
  misc_feature (594)..(594): n is a, c, t, g, unknown, or other
  misc_feature (623)..(623): n is a, c, t, g, unknown, or other
  misc_feature (624)..(624): n is a, c, t, g, unknown, or other
  misc_feature (640)..(640): n is a, c, t, g, unknown, or other
  misc_feature (662)..(662): n is a, c, t, g, unknown, or other
  misc_feature (663)..(663): n is a, c, t, g, unknown, or other
tggagctccccgcggtggcggccgctctagaactagtggatcccccgggctgcaggaattcgcacgagaccattacctagaacatcctaatcgaaaaatcgcaccgcgagtttcgaaaaccccaaccaatcgcgcctcagatcacgcgagggcgtgagggggaattcgctctcccagcctccgctcacccgtcgatcgatcgtccgggccaggggctctccggcggcaccggggccatggaggaggacccgctcatccctctggtgcacgtctggaacaacgccgccttcgaccatgcctccgcctccgcctccgcgtggcacgcccattcccctgcgcccgcgagcgcccgcgagggggacaaggagaaccaccgccccgagcccgacgttgaggcggaggtcgacgacgttgaggccgagatttaccacatcgaggcggagatcctgcgcctgtcttcccgcctccaccacctccgcacctccaagcagacggagccgccccaagcgtggacanggtcgcgcgggacgcggatgcnngggggctcagtctggggcccaggctcgacgtcggcccgctggcccgtcgactccngacccgctcaccgacaagcagcagcgganncgccccccgcaagggncttggaaaagccctatcaaganngggccccgcggggggccccccgaggag

SEQ ID NO: 29540 - protein, 151 aa, Zea mays
  misc_feature: Ceres CLONE 1404542-F
  misc_feature (94)..(94): Xaa is any aa, unknown, or other
  misc_feature (101)..(101): Xaa is any aa, unknown, or other
  misc_feature (120)..(120): Xaa is any aa, unknown, or other
  misc_feature (129)..(129): Xaa is any aa, unknown, or other
  misc_feature (130)..(130): Xaa is any aa, unknown, or other
  misc_feature (135)..(135): Xaa is any aa, unknown, or other
  misc_feature (142)..(142): Xaa is any aa, unknown, or other
  misc_feature (143)..(143): Xaa is any aa, unknown, or other
MEEDPLIPLVHVWNNAAFDHASASASAWHAHSPAPASAREGDKENHRPEPDVEAEVDDVEAEIYHIEAEILRLSSRLHHLRTSKQTEPPQAWTXSRGTRMXGGSVWGPGSTSARWPVDSXPAHRQAAAXXPPARXLEKPYQXXAPRGAPRG

SEQ ID NO: 29541 - DNA, 671 bp, Zea mays
  misc_feature: Ceres CLONE 1404547-F
  misc_feature: Encodes the peptide sequence at SEQ ID NO. 29542
  misc_feature (363)..(363): n is a, c, t, g, unknown, or other
  misc_feature (441)..(441): n is a, c, t, g, unknown, or other
  misc_feature (636)..(636): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (649)..(649): n is a, c, t, g, unknown, or other
  misc_feature (650)..(650): n is a, c, t, g, unknown, or other
tggcggccgctctagaactagtggatcccccgggctgcaggaattcgcacgagaccattacctagaacatcctaatcgaaaatcgatcgtcgtgcacgcccccgccaccggccggatcgacagcaccgatcaccctgaccgtctgcgcgcggcggctctcactccggtgacacgcagggcgcgcataggcgagggcctccccccccggcgagggatggtgtggtcggctgggatggcaacaatgcgaggcgcctccgccgccgcgctactggtgctggcgctcgccgccgccgtggcgcgcgcggaggacccctaccacttcttcgagtggaaggtgacgtacgggacgaggaccatcatggnggacggcgcagaaggtgatcctcatcaacgacatgttcccgggccctaccatcaactgctcatccaacaacaacatcnctcgtcaacgtcttcaacatgctcgaccagccgctcctcttcaccttggcacggggatccagcagaggaagaactcgtggcagacggggccatgccgggcaccattgtgcccgatccagcccaacaccaacttcacgtaccactcgcagccaaggggaaccagaatcggcagcttcttctactaccccagacggnatgagnnnngggnncggcgggcgccctacggggct

SEQ ID NO: 29542 - protein, 92 aa, Zea mays
  misc_feature: Ceres CLONE 1404547-F
  misc_feature: SWISSPROT Homolog: EC 1.10.3.2 Laccase
  misc_feature (16)..(16): Xaa is any aa, unknown, or other
  misc_feature (81)..(81): Xaa is any aa, unknown, or other
  misc_feature (83)..(83): Xaa is any aa, unknown, or other
  misc_feature (84)..(84): Xaa is any aa, unknown, or other
  misc_feature (85)..(85): Xaa is any aa, unknown, or other
MFPGPTINCSSNNNIXRQRLQHARPAAPLHLGTGIQQRKNSWQTGPCRAPLCPIQPNTNFTYHSQPRGTRIGSFFYYPRRXEXXXRRAPYGA

SEQ ID NO: 29543 - DNA, 705 bp, Zea mays
  misc_feature: Ceres CLONE 1404548-F
  misc_feature: Translation starting site: 249
  misc_feature: Pfam Name: ARD Pfam Description: ARD/ARD' family
  misc_feature (369)..(369): n is a, c, t, g, unknown, or other
  misc_feature (393)..(393): n is a, c, t, g, unknown, or other
  misc_feature (431)..(431): n is a, c, t, g, unknown, or other
  misc_feature (439)..(439): n is a, c, t, g, unknown, or other
  misc_feature (456)..(456): n is a, c, t, g, unknown, or other
  misc_feature (508)..(508): n is a, c, t, g, unknown, or other
aaagctggagctccccgcggtggcggccgctctagaactagtggatcccccgggctgcaggaattcgcacgagaccattacctagaacatcctaatcgaaaaacaagagtgcgggttcgcgttcagtccaagctgaacataaacgcaggcccctcgacgcagattccgcgctcaggactcaggagcattcgagaagccgaagaaaattcgaagacgaggagcagctacactgcggacggacttcgggcatggagggccagttccaggttggcaaggaggaggtcatccaagcatggtacatggatgacagtgaagaggaccagaggcttcctcatcatcgcgagcccaaagaattcattcctctcgacnaactttccgaactagggatattangctggcgcctaaatgctgatgattgggagaatgatgangacctcangaaaattcgtgaagccnggggtttactctacatgaacatttgtgatggggtgcccagaagaagttgccnaaatacgaggcttagataaggaaattctttggagaacccttgcatactgatgaaaagaaccccttttccttgggggggacgggctactttgaggggaggggccaaaagaccagggggccccgggaaggggaaaaaaaggggggaatggtctttttcccgggggaggggatccccgttttacggggggaggggaaaca

SEQ ID NO: 29544 - DNA, 720 bp, Zea mays
  misc_feature: Ceres CLONE 1404549-F
gctctagaactagtggatcccccgggctgcaggaattcgcacgagaccattacctagaacatcctaatcgaaaaaatcacgagaagggcgccgatctgggaaggcattgtcttgttgtactttcccttccggcagtggactcgattcgcatccccttttcccgtccatgcgcgagccggcgggcggtgtcagagccaccacgctcgcggaggccatgaagattaagaagccgctgcacggggcatcgacgcagatcgcgctgctctctctctcgctgctcctcctccgactgactcctccgactacgactggacgccttccgagacgcggtgctgtcgctccacctgctggcacgactccgactccgccgcggcctccactgcctcccggcagactgccacgacggcggagccggcgccgacgccaccacactgcgagtctggtgcaccgacaccccatcatccaaggcgccgctgctcctccgacaagatttcagctacagacgcaaagtgtagctgatgcgagcaatctccagcgcctgatccgccacttccacgtgtacgcgccgtacctcgtggtcatcggagggtagtcccggtacgcgtcgcctatgcgctacgagtcgttctaagcccactgcgacgccgaggatcagcaccatctcggcgacgctccgctacaatgtctcgtagatcagctacggtgggctcgtagtctaag

SEQ ID NO: 29545 - DNA, 687 bp, Zea mays
  misc_feature: Ceres CLONE 1404554-F
  misc_feature: Encodes the peptide sequence at SEQ ID NO. 29546
  misc_feature (492)..(492): n is a, c, t, g, unknown, or other
  misc_feature (540)..(540): n is a, c, t, g, unknown, or other
aaagctggagctccccgcggtggcggccgctctagaactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtcgctaaggagccggagccggtggaggccgagactgagactgagaccaaggaggccgaggccgttgctgagccgaccgaggcagagcccaaggaagcagagccggaggccgccgcgccggcngcagagacggaggtcaaggaagcagagacggaggccgccgcgccggcngcagagacggaggctgctgctgccccggtcgaggctgctgagccggagatagccgccgagaccaaagaggtggcggtggggaaagggctaacgaggaaggaggaggaggcagcgcctgctgttgctgccactcctgaggtcgcacga

SEQ ID NO: 29546 - protein, 149 aa, Zea mays
  misc_feature: Ceres CLONE 1404554-F
MAAVEVQVPTAAPVEEAAQLAAASAVETPNEETAAPAVETEVVVAKEPEPVEAETETETKEAEAVAEPTEAEPKEAEPEAAAPAAETEVKEAETEAAAPAAETEAAAAPVEAAEPEIAAETKEVAVGKGLTRKEEEAAPAVAATPEVAR

SEQ ID NO: 29547 - DNA, 760 bp, Zea mays
  misc_feature: Ceres CLONE 1404558-F
  misc_feature: Encodes the peptide sequence at SEQ ID NO. 29548
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (38)..(38): n is a, c, t, g, unknown, or other
aaagaaaaacaccnnnnccnnnacccccaccccccacnccccacccccgccttatagtggtgctccaccgcggtggcggccgctctagaactagtggatcccccgggctgcaggaattcgcacgagaccattacctagaacatcctaatcgaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcatgttccgcgggccgtggctcgcccgcgcggacttcctgctgacgtgcgacccggcggccgtccagcactgcctggcgtccaaccacgggggctacgacaggggccgagaactttgcggagatgttcgacctcctgggcgacggggctgctgggttgcggacgcacccggtccgggggccgcgcccagcggcacgttcgcccgccaaccgtctcctgttacccccgcggggttaccgggtccccttcgaccctgtggaatcaatgggcctggccaacacaccgcacgcgtaatacgcaccataacgcacactcatagcacccggagtacca

SEQ ID NO: 29548 - protein, 183 aa, Zea mays
  misc_feature: Ceres CLONE 1404558-F
MGALRSLAISYPEFLVAGLCFVSLSALRHAMRERRQRAPLSWPVVGMLPFVLANLGRLYDAITDALHGSGCTLMFRGPWLARADFLLTCDPAAVQHCLASNHGGYDRGRELCGDVRPPGRRGCWVADAPGPGAAPSGTFARQPSPVTPAGLPGPLRPCGINGPGQHTARVIRTITHTHSTRST

SEQ ID NO: 29549 - DNA, 674 bp, Zea mays
  misc_feature: Ceres CLONE 1404560-F
  misc_feature: Encodes the peptide sequence at SEQ ID NO. 29550
  misc_feature (433)..(433): n is a, c, t, g, unknown, or other
cgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacggagaagaaggacgacgcggtggtgcagccgcagaccttcccgcccttcgaccgcctcggcggcgggcggtccccgngcgttcggcggcctccccggcggcagcattcctggagcaccaattcccgggttcagcatgcccggcagcggaggccctaaaccggggttcagcttgcccggagcgaggcccccccctcttcttgggggggggggggcctcccgggtttttcaggggttttcgggggtgattgcccggttcgcccacccgccgggctccgtccccgagcacgccaacaagccctgaacgccaacaagggggg

SEQ ID NO: 29550 - protein, 84 aa, Zea mays
  misc_feature: Ceres CLONE 1404560-F
  misc_feature (59)..(59): Xaa is any aa, unknown, or other
MARSSKMMVAAALLALALAVSTAEARNIKTTTTEKKDDAVVQPQTFPPFDRLGGGRSPXVRRPPRRQHSWSTNSRVQHARQRRP

SEQ ID NO: 29551 - DNA, 733 bp, Zea mays
  misc_feature: Ceres CLONE 1404565-F
  misc_feature: Encodes the peptide sequence at SEQ ID NO. 29552
  misc_feature (506)..(506): n is a, c, t, g, unknown, or other
  misc_feature (577)..(577): n is a, c, t, g, unknown, or other
  misc_feature (614)..(614): n is a, c, t, g, unknown, or other
  misc_feature (691)..(691): n is a, c, t, g, unknown, or other
tccccgcggtggcggccgctctagaactagtggatcccccgggctgcaggaattcgcacgagaccattacctagaacatcctaaaaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgccctcttcgcgcccccgatcgcccgattccttcagggccaaagttacagatgttccagtgtttaccaacagagtttctcgtacgtaccgggcaaaatcattgacagttccagatcacggagttgatgtgtgtcctttggaatacaatgagtatgtcccctgccatgatggagcctatataagcagcttgaagagcctggatacatctaggcatgaggnatcttgaaagtatttgtcctccatgggagaagcggttggtttttgtttggtgccccctccaaatgactacnagataccaataagatggccaacaagccgagactacgntatgggcgtagtaatgtcaaccattcacattcttgctgaggtcaaaggaggacagaactgggtggcatgagaaggcnaaactttttgtggtttttccttggaggtggcactcacttcaa

SEQ ID NO: 29552 - protein, 121 aa, Zea mays
  misc_feature: Ceres CLONE 1404565-F
  misc_feature (120)..(120): Xaa is any aa, unknown, or other
MRRWWSPALAAVEPRSVQLLLLGVALVAASFYAGTLFGSSASPALVLPSSRPRSPDSFRAKVTDVPVFTNRVSRTYRAKSLTVPDHGVDVCPLEYNEYVPCHDGAYISSLKSLDTSRHEXS

SEQ ID NO: 29553 - DNA, 687 bp, Zea mays
  misc_feature: Ceres CLONE 1404567-F
  misc_feature: Encodes the peptide sequence at SEQ ID NO. 29554
  misc_feature (539)..(539): n is a, c, t, g, unknown, or other
  misc_feature (550)..(550): n is a, c, t, g, unknown, or other
  misc_feature (551)..(551): n is a, c, t, g, unknown, or other
  misc_feature (563)..(563): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (602)..(602): n is a, c, t, g, unknown, or other
  misc_feature (603)..(603): n is a, c, t, g, unknown, or other
aaaagctggagctccccgcggtggcggccgctctagaactagtggatcccccgggctgcaggaattcgcacgagaccatttaccctagaacatcctaatcgaaaactccctcttcgctcgcgtccgcacaaatcccgtgctccccccgtctgaaaaccctcccccaccctccggcggcggcggcggcgcttggcgaccgggtgtctttctccggcgagtctccccccttagtaacaaaaaaattattggatgtacctgttgatgaccctgtggagaaccttcactggaagtcctagtaccctttggcaatgaggaagaagccactacttatgctaatgtgcaagatcagtccaaggaagaaccagaaaagcttttacgaggaacccaaagacccaatgcaagacgagttgggtaaccaagggcattgtgagcattgaacaatgaagatgtgggaggccagaacaaagtggaccaagctacccccacagagcacggcgaggaagctggggtgaagcagcatgatgctacagttcctgatngacagaatggnncctgttgcctgnannnnagagtgtgttcccgtatactggttcctaccaccnnaggtgtggttggccgtcattgggcgcccaaaagggggatttccattcaagaaaaaatgtgttgaggaaatccagagccccccat

SEQ ID NO: 29554 - protein, 42 aa, Zea mays
  misc_feature: Ceres CLONE 1404567-F
MRKKPLLMLMCKISPRKNQKSFYEEPKDPMQDELGNQGHCEH

SEQ ID NO: 29555 - DNA, 697 bp, Zea mays
  misc_feature: Ceres CLONE 1404568-F
  misc_feature: Encodes the peptide sequence at SEQ ID NO. 29556
  misc_feature (359)..(359): n is a, c, t, g, unknown, or other
  misc_feature (490)..(490): n is a, c, t, g, unknown, or other
cgcggtggcggccgctctagaactagtggatcccccgggctgcaggaattcgcacgagaccattacctacaacatcctaatcgaaaaaacaaagaaagtcgcggcggagcaatgtgctgcaacgcgaaggtctcgccactgccggttgagatggacacctccgcctccaaagtgctcaccaacgacgatctccttcacgacatccttctccgcctaggatgcccgagctgcctcgtcagtgccgcgctcaccagcaagtgctggctgcgtggcgcctccgatcaggtcttcgcgcgcgacttctgcgcggaccaccagccgcgcctacttgggatctacgtctccagcagcggcatctntggggtcggagttcatcccattcaggcaacctgctggtggctttaggcccggagggtgagtactgtcctcaccatggccgattttccggtttgggcgacctggccggcgccgagcgttttgggactgacgnaaacggatgggccctctttcccaaagttcggttggccgagacctttaaaaccccgcttggctccggcgtgcgcggtccccccggctgctggtatcctaacatgcaccgagaaaaagcgtggtgggttccccgccgtccggccgcaggccgtcctaaaatttccccgggaagtacccctcacggcgaatgctccctccctacccgaaa

SEQ ID NO: 29556 - protein, 97 aa, Zea mays
  misc_feature: Ceres CLONE 1404568-F
  misc_feature (83)..(83): Xaa is any aa, unknown, or other
MCCNAKVSPLPVEMDTSASKVLTNDDLLHDILLRLGCPSCLVSAALTSKCWLRGASDQVFARDFCADHQPRLLGIYVSSSGIXGVGVHPIQATCWWL

SEQ ID NO: 29557 - DNA, 712 bp, Zea mays
  misc_feature: Ceres CLONE 1404574-F
  misc_feature: Encodes the peptide sequence at SEQ ID NO. 29558
cgctctagaactagtggatcccccgggctgcaggaattcgcacgagaccattacctagaacatcctaatcaaaatcgattagccgcgtgctctttgtttcctctctcaccataatgtctgctctgcgcgcccttcgttcacctctccttcctcgcgcccctggctggccggcataggggaagtcataggcaccgactggcgcagagcagacccccgcgacccattgtagctgtccctgtcgtcttcgaccacataccatacccccactacgcccggatggagaataagcccagcatcctcatgaacaggcacgagctacgctcgcacgctcgagcagggtcaccttcgccgaggtgtgaccacgctcgtaacctcgcgtccggggagagccgtgctctccgggacatcgaccaggacaatgtgatgcgcgtcggcgtgatcgaccagatgaggcgcgagatctccgtcctgcgtctcgtccggcaccccaacgtagtgtacctgcaccaggtgatggacaacaggagcaggatatacttcgccatgcactacgtccggtgtgtcaaggtcttcgcccgggttcgccgcggacggctcaaggaggacgcctggagaacgaacttccaccatctcgttcgcgccggctatctctgtcacagacgcggtgtcgaccaccgacctcgagctcaataacctcctcgttgacgagtag

SEQ ID NO: 29558 - protein, 138 aa, Zea mays
  misc_feature: Ceres CLONE 1404574-F
  misc_feature: SWISSPROT Homolog: EC 2.7.11.1 Non-specific serine/threonine protein kinase
MENKPSILMNRHELRSHARAGSPSPRCDHARNLASGESRALRDIDQDNVMRVGVIDQMRREISVLRLVRHPNVVYLHQVMDNRSRIYFAMHYVRCVKVFARVRRGRLKEDAWRTNFHHLVRAGYLCHRRGVDHRPRAQ

SEQ ID NO: 29559 - DNA, 586 bp, Zea mays
  misc_feature: Ceres CLONE 1404577-F
  misc_feature (33)..(33): n is a, c, t, g, unknown, or other
  misc_feature (342)..(342): n is a, c, t, g, unknown, or other
gctcagaatagtggatcccccgggctgcagganattcgacgagaccattacctagaacatcctaatcgaaaagacaaatcgacgagcgccgcttctcttggccattgcacagggagagatggagcgagagtgacctacgttacccgcgtccgcgactggttgacactttcgctgattcgactccgctcacgatgagtttgcgcggagggcgccaccgcctcagatccgatgcgccgtgcgcgtgctcgtcagaggccgctcgcgcgggactcccataccgtggcggtgagtagagggcctcacactgttctccctgcggatgttcattttgaccagctaggncacgacacgtcccatgggcactacgagacagagctgaggcaggacacacacgagggaaggcatctcagacagtgacggacagctctgacgtacacatgaaggcgatcatcggttcactgctcgcgtatgatgcatcacgtgccaggacaatcgcctaaagggggatgagaaggccgaaaacccagccatttaagtgggaggttggcaaaagccaacttttcccaaattttcttgttcccgaaag

SEQ ID NO: 29560 - DNA, 672 bp, Zea mays
  misc_feature: Ceres CLONE 1404583-F
  misc_feature: Encodes the peptide sequence at SEQ ID NO. 29561
aaagctggagctccccgcggtggcggccgctctagaactagtggatcccccgggctgcaggaattcgcacgagaccattacctagaacatcctaatcaaaaagacaccgctgtcgtcctcgctcacctcgtccgtcctcgtgagctccgcctgccttccctctggacagctccagcctccagccatcttcccccacctgtacacagttcgcactcgcatgctcttcgccccctcgcgcttaccgctgccgcgcctcccgactcgccgcctccgcctagctccgggctctccaatggcctccatgctcgccatcctcaggccctcggcgccggccccgctcgcgggacgccgggccagggctgccgcgccggcgaccgcgagggtggcgctatctaccagatctaggtattcgtcagccagggtgtcgctcggctccgaggttgcagtgggcgccgacgcgctcttcgccgactataagcccaccaccgctttcctcttccccggccagggtgcccaaaccgttggaatgggggcagaagctcagagtgttccagcagctaccaaattgttcaaccaggcaaatgaaatccttgggatatgacttggctggatctttgcaccaatggaccaaaagaaaagcttgactcaacaatgatcagtcagccagctata

SEQ ID NO: 29561 - protein, 127 aa, Zea mays
  misc_feature: Ceres CLONE 1404583-F
  misc_feature: SWISSPROT Homolog: EC 2.3.1.39 [Acyl-carrier-protein] S-malonyltransferase
MLFAPSRLPLPRLPTRRLRLAPGSPMASMLAILRPSAPAPLAGRRARAAAPATARVALSTRSRYSSARVSLGSEVAVGADALFADYKPTTAFLFPGQGAQTVGMGAEAQSVPAATKLFNQANEILGI

SEQ ID NO: 29562 - DNA, 763 bp, Zea mays
  misc_feature: Ceres CLONE 1404590-F
  misc_feature: Encodes the peptide sequence at SEQ ID NO. 29563
aaagtggagctccccgcggtggcggccgctctataactagtggatcccccgggctgcaggaattcgcacgagaccattacctagaacatcctaatcgaaaaagttccccaaattcccaacgccgccgcgacggcgctgctagctagtctttggtgttgtaggtgttcgattcctgattccaaattccagactccaaactcggttcttcaatcgacagattccgatttacatcccaaagctcttcggattgaaatccagccgcgacccaagagataagagtatttgggattagtagataggatagtagaatagaagaggaacactttcgctgatgattacggcggaggagactagccctcgaaagggaggaggaggaggaggcgaacccgcgcgcggaggcttttctggagatcatctgccgcgtcccggcgaggaaggtggaggcggcgctgtccgcttgcggcatcggccccacggccgaggtcgaggaactggtgctcaagtcccgcgaatgctacaagcgccctaagtccgccgtccgcttcttccgctgggcggcgcagtccgagtcgcacaccgcctacgcatggaacctccttgtcgacatcctcggcaaggtcgccatgttcgagcccatgtgtgacgccatccgctccatgaatcatgagggcgacggcgggctcgtctccgtcgacagcttacgctacgtcttcgactcctactgcgccgctggtgacatcagagatgcaatcgcggccattaa

SEQ ID NO: 29563 - protein, 46 aa, Zea mays
  misc_feature: Ceres CLONE 1404590-F
MFEPMCDAIRSMNHEGDGGLVSVDSLRYVFDSYCAAGDIRDAIAAI

SEQ ID NO: 29564 - DNA, 654 bp, Zea mays
  misc_feature: Ceres CLONE 1404593-F
  misc_feature: Encodes the peptide sequence at SEQ ID NO. 29565
gcaattcactagtggatcccccgggctgcagtatccgcacgagaccattacctagaacatcctaatcgaaaaacatcgacccagctatctcctcaccctcgttcaccacacagtccgccactcctttagtagcttgtgatttgtacgtcgacgagatcactggtcggttggcggacgacgacacatggtgaagggtagtgtggctgcatcatggtgggcgttcctcctgctcgccggcgtgctgctggtcgtagcagccacggccggtgcggaggacggagtggtcgaacgggaccgcaaggaggacctgcggtggtgcaagcaggtgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgcgccgccacgagggccagccgtgggagacccaggagtgcatgatgcggagccgccgccgcggactggccgtcgacatggagcaagagtacggtcgtgacaccgagagcccgctcaagtgcccggagaggtgcgagcgccaccaccgcggtgactgatgggagagaaa

SEQ ID NO: 29565 - protein, 152 aa, Zea mays
  misc_feature: Ceres CLONE 1404593-F
MVKGSVAASWWAFLLLAGVLLVVAATAGAEDGVVERDRKEDLRWCKQVCEWQYGKDTPRKRECESECRERHQQADAGEDGDSGVDAYVSRSGRGECRRQCLRRHEGQPWETQECMMRSRRRGLAVDMEQEYGRDTESPLKCPERCERHHRGD

SEQ ID NO: 29566 - DNA, 660 bp, Zea mays
  misc_feature: Ceres CLONE 1404598-F
  misc_feature: Encodes the peptide sequence at SEQ ID NO. 29567
aaagctggagctccccgcggtggcggccgctctagaactagtggatcccccgggctgcaggaattcgcacgagaccattacctagaacatcctaatcgaaaaagatttggatgtggactagatgcttaaggtgtgaacgtgaaagtggggtccccagatcatcacgaagggtgataatgtcagctgaagcacactacctttcatttgggaagttccttgaacttagtttttcaagccactcaaccgctagaaggctgccaatatgcgggcattcactcaatacggattgtctgcgctttttttgggttgggctccaaagttgcaatgttccagtattcctcagtcgaaatttacaatgcctgcaaaccacagcctactcttgagattcacaaccccgatatgcacaaagatgccccaaggttgctgccctcgtgtttcgtgctctgattgttgagtcttcaatgagagctgattccagttatatagaggtgaacaagcttttgattatttcttttgttaatttggtgcaacatatagaggtgaacaagcttattaaaggaagatccttgtacaatcaagagttcatacaatagatgaaacgatattgtgattctctcaatggtggcttcatgagcaagcaatcattcaccttgttcacta

SEQ ID NO: 29567 - protein, 90 aa, Zea mays; identical to SEQ ID NO: 11994
  misc_feature: Ceres CLONE 1404598-F

SEQ ID NO: 29568 - DNA, 657 bp, Zea mays
  misc_feature: Ceres CLONE 1404600-F
aaagctggagctccccgcggtggcggccgctctacaactagtggatcccccgggctgcaggaattcgcacgagaccattacctagaacatcctaatcgaaaaccccaaccccgttcttctccctccgtccgaccgtccctcgacagtgccgaggcgcaacctagcagccgcccacgcggcgcgacatccactggcgcaagcgcaatccgcaagggccccccggcgcgccgccagcctcctggctcggccgcccccgcggctaacccaggggcggaaaggccggccagccgcccacaccccatccggccagccaggcggaaacgaccgtaagagggaagccgcagccggccgctgactccgatcccacctctagtcaaccccaggcagaccgatcctcttcgtctgaccacgacgtccatctcgcacgcctacttccactcaaccacataagtcttttctgccaggcctaacctttcccctgcgccgcctctactggttttgcacagtgccgtgacgtgggaagacgtggagatccaacgaaaattagatttatttcttccttcttcggtccaacaggttcctcagcttgcgtaagatccgtctgggttgtccgccctccattggactacccaaggtgcggcgcatccaccaggtgga

SEQ ID NO: 29569 - DNA, 650 bp, Zea mays
  misc_feature: Ceres CLONE 1404604-F
  misc_feature: Encodes the peptide sequence at SEQ ID NO. 29570
aagctggagctcaccgcggtggcggccgctctagaactagtggatcccccgggctgcaggaattcgcacgagaccattacctagaacatcctaatcgaaaaatctcgtccacgaaacgtacggacttcgggcatcggtgccaacggcagcgggaccgcaccaccacgcccgtcggcgacatgaatccgcccgcagcagccgcgtccaccggcgaaagaggccacgccgcggcgcctgcggcagcccgggagtacgtgcactacccgaggctctcgccagaggaggtggccccgcccccgcccccggcttatcacgccgtcaccgccgcgccgtccgcctacggaggcaacccctagatctactcccccgccgggggggccgccacctccccgaacaatacgatggactccgtgaaggacgagctcgtcaagatggacgaagaggtttggcgaggaggcccgcaagaccgagaccatcaccggcaatttctgggaggactgcgagtttctcgatttcgttgccggattttcacgaaatagggtgccgaagctgtttctgagtgttattcatctaattgcgaatcgcgcctggcatttttcatgtacattctgctactgcaatatgaaattaggttgtcggtaacctgttag

SEQ ID NO: 29570 - protein, 58 aa, Zea mays
  misc_feature: Ceres CLONE 1404604-F
MNPPAAAASTGERGHAAAPAAAREYVHYPRLSPEEVAPPPPPAYHAVTAAPSAYGGNP

SEQ ID NO: 29571 - DNA, 695 bp, Zea mays
  misc_feature: Ceres CLONE 1404606-F
  misc_feature: Encodes the peptide sequence at SEQ ID NO. 29572
  misc_feature (489)..(489): n is a, c, t, g, unknown, or other
  misc_feature (496)..(496): n is a, c, t, g, unknown, or other
  misc_feature (639)..(639): n is a, c, t, g, unknown, or other
aaagctggagctccccgcggtggcggccgctctatacatagtggatcccccgggctgcaggaattcgcacgagaccattacctagaacatcctaatcgaaaactggtcctccattcaagctccactactccacacctagacttcccaatcctccattgggcaacctgtcacacagtacgccgtcgcctgtggtttggtttgtggagtgagagagaaagagagagagagacatagactcggactcggagagaaggagatgatgtcgagggagcgcaagaaggcggctgctcttcaggagaagctgaagatcctccgctccatcactcactcccacgctctgagcaacacgtcgataatcatggacgcgtcggcgtacatcaaggagctgaagcagaaggtggtgaggctgaaccaggagattgcgtgcgcgcaggacgcgctgagacacaaggcatcatcctatcccacggtgaccgtggaagccctagnagtgcanggggtcgtcgttcctgggtgaacgtgttctccgacagagctgcccggggtgggctcgtcgccgtgctggaggccttcgacgagcgggggctcagcgtgctccaggccaccgcgtcctgcgccgactcctcccgcctccgaggncgtggggcggagagaacgtggcggacaacgtggacgagcagttcgtgaagcaggcc

SEQ ID NO: 29572 - protein, 86 aa, Zea mays
  misc_feature: Ceres CLONE 1404606-F
  misc_feature (78)..(78): Xaa is any aa, unknown, or other
  misc_feature (80)..(80): Xaa is any aa, unknown, or other
MMSRERKKAAALQEKLKILRSITHSHALSNTSIIMDASAYIKELKQKVVRLNQEIACAQDALRHKASSYPTVTVEALXVXGVVVPG

SEQ ID NO: 29573 - DNA, 596 bp, Zea mays
  misc_feature: Ceres CLONE 1404610-F
  misc_feature: Translation starting site: 134
  misc_feature: SWISSPROT Homolog: EC 3.4.16.6 Carboxypeptidase D
  misc_feature (296)..(296): n is a, c, t, g, unknown, or other
  misc_feature (362)..(362): n is a, c, t, g, unknown, or other
  misc_feature (432)..(432): n is a, c, t, g, unknown, or other
cgctctagaactagtggatcccccgggctgcaggaattcgcacgagaccattacctagaacatcctaatcgaaaagcaccaccaaccaaccagtgctgccctccgccgatccactgacctaccgcgagcgccaatggcgaccgccgcggtcctggccgccacattagcgctgttcctccgcgccgccgccgcaacggccgcgacggctgcggcggaggcggaccggatcggcaggctgcctggccagccgccggtcaacttctccatgtactccggctacgtcaccgtggacgcgngcggcggggcgggccctcttctactggttcatcgaggcggccggcgtgcccgcggagtccgcgccngctcgtgctgtggctcaacggcgggcccgggtgctcctccgtcggctacggcgcgtcagaggagctcggngccttcccggatcaacggccgaaggaggacgttcaactgaaaccctaccccgggaaaaaaaggggggaaaaaatggttggtcttgggaccccccggccgggggtggggaaatcataaccccaaccccccccccgaaattgggaaacaggggggcggggaaaaaa

SEQ ID NO: 29574 - DNA, 679 bp, Zea mays
  misc_feature: Ceres CLONE 1404612-F
  misc_feature: Encodes the peptide sequence at SEQ ID NO. 29575
  misc_feature (658)..(658): n is a, c, t, g, unknown, or other
caaagctggagctccccgcggtggcggccgctctagaactagtggatcccccgggctgcaggaattcgcacgagaccattacctagaacatcctaatcgaaaacctcgcgcgcacgttctgccgcgcgcatacgcccgcatcccgcagccgcggcagcgccgcagccgctccttccatcctccgccctccttccatcctccgcggatcccagctctccctcccgcgcccgcccgcagccgcaccgcatcccgcagccggcgtcggcgcaacggctgatgctcaaggggtgtgagtcgctgctacagcggcagtgccggccgcgcacccccgcggggtacatggagcccacgccgctaccggttggcggtgaagagcaaggggacagataagcccaaaggcagcaaggggaacgtcgacaaggaccccaacaagcctgactcccaacactttttttgttcgctggtgctgcggcgacggtgctggcgagctctcccgtgctgggctctgggatgctccagggcaccgggttcggcgagacgtggagtcaccacacggcggatgcgccgccgtgcttgccttgcagttcctcgatcgatcaagggaaaaatggtcagtggaaagagactggtgaatcaaaggcagcaacgctaagggggnaggcgaagtgcctgctgattg

SEQ ID NO: 29575 - protein, 37 aa, Zea mays; identical to SEQ ID NO: 25346
  misc_feature: Ceres CLONE 1404612-F

SEQ ID NO: 29576 - DNA, 674 bp, Zea mays
  misc_feature: Ceres CLONE 1404614-F
  misc_feature: SWISSPROT Homolog: EC 3.2.1.15 Polygalacturonase
cgctcagattcaaaaaatcccccgggctgcaggaatttgcccgagaccattacctagaacatcctaatcgaaaaataaataacaaacatatttttttcccaacactaataatactctcactatcggattacaattcatcataaccttgaagattcattgcacatcctagcaactaaaaaaaacccatatcatgtgtgtacattttggaatacctgcattatttgttgtttgattgctaagtttatcactaaatgctaaggatttcacaatctctgctcctccacgctgtgatatcaccagcttattgctcaaaacattcactgcggcatgctagttctcttattaagagcatcgacctgatccctaaaggcgaatacaagcttatcccaacacagatgatgagtccctgcaacgctcccataacgattactcttccaggcactgtgatagctgacggcaacgataacgctgatgactactggctcgctttccgcaggattaatggttttaagttgaaccaaagtgccagtatttgacgatgaaggccacactgcatgcgagtcctaataattgtcaccaaagagccatccactcagtggcaccaccctccctactcgcttaagagttcgaatttcgtgaactgaaccttaacataacaggcataatcctcaaag

SEQ ID NO: 29577 - DNA, 716 bp, Zea mays
  misc_feature: Ceres CLONE 1404619-F
  misc_feature: Translation starting site: 198
  misc_feature: SWISSPROT Homolog: EC 3.2.1.4 Cellulase
tcaccgcggtggcggccgctctagaactagtggatcccccgggctgcaggaattcgcacgagaccattacctagaacatcctaattgaaaagacgacttagagcggacactacacacatagttcagtgacagcgagcggcaacgctccagtgtccactgctcagtatcccagccaggacgtgtgccattggccgaacatggctcgcctcccctgcggcttccttccttaccgcctgctctcgtctgccctccgacttccaggcgacgccattgcctgctcggcttaccatgggcccgacgcacaatactaccggtacgcgctcgacaacttcatcctcttcttcaagggccagcgatcggccatactgcctgcgctgcagagcgagtactggcgcatgactcgagactctccgacggtcacatccgccaaggtgcacctggtggggggcgaccactagcctgatgacaacgacaaatgcgggttccatatgtcgttcatcatagacgatgttggtgtgtaccgtgtttggaatctgcttccctcatgaagacatagctgcagtacgcctcgcacgccgtacgatgtcttatctactacattctcaaggtcacatcgcaaccgagaaccatctacatccaggtcggtgatgcgaccaaagacctcacgagatgagagcggactctaagactgaacacccccacgacagtgatcaacg

SEQ ID NO: 29578 - DNA, 600 bp, Zea mays
  misc_feature: Ceres CLONE 1404626-F
  misc_feature (292)..(292): n is a, c, t, g, unknown, or other
  misc_feature (322)..(322): n is a, c, t, g, unknown, or other
  misc_feature (335)..(335): n is a, c, t, g, unknown, or other
  misc_feature (360)..(360): n is a, c, t, g, unknown, or other
  misc_feature (373)..(373): n is a, c, t, g, unknown, or other
tggcggccgctctacaactagtggatcccccgggctgcaggaattcgcacgagaccattacctagaacatcctaatcgaaaaaattcgaagccttcccggttaccccttcggcctccacctatcaccacccgggacgtcttccatggcctcctcgtagtagaatagctctatctcaccgcaacaactcctcattacatcctttatgagaggctgatcgattgggtagatacgtactcgggtggagcagaacaacgagagacatggcgacgacgacgcgtgttgccgccaccngccgccgcgtgctgctggtcctgtcggcgntggcgaccctggncgcgggccgaggacccgtacctggntctcgagtggaangtgacgtacggggacaagtccctgctgggcgtgccccaaaagtcatcctcatcaacgggaagttcccccgggcccaaggataaaatgggtccctccaaaaaaaaaaaaattggggggggaaaagggttttataaaaacaaggtttgccacaacccccccctttttccccgggggagggggggtgggcccaaggaaagaaatccgggggtggtggccggtttcccccc

SEQ ID NO: 29579 - DNA, 700 bp, Zea mays
  misc_feature: Ceres CLONE 1404627-F
  misc_feature: Translation starting site: 183
  misc_feature (200)..(200): n is a, c, t, g, unknown, or other
  misc_feature (263)..(263): n is a, c, t, g, unknown, or other
  misc_feature (298)..(298): n is a, c, t, g, unknown, or other
  misc_feature (382)..(382): n is a, c, t, g, unknown, or other
  misc_feature (411)..(411): n is a, c, t, g, unknown, or other
  misc_feature (449)..(449): n is a, c, t, g, unknown, or other
  misc_feature (473)..(473): n is a, c, t, g, unknown, or other
  misc_feature (491)..(491): n is a, c, t, g, unknown, or other
  misc_feature (492)..(492): n is a, c, t, g, unknown, or other
  misc_feature (503)..(503): n is a, c, t, g, unknown, or other
aaagctggagctccccgcggtggcggccgctctagaactagtggatcccccgggctgcaggaattcgcacgagaccattacctagaacatcctaatcgaaaaaagctccttcgcctcgaaccctctcgcgcttggcttgctttcactctccagggccccactcccacctcgccgccgcagccatggcgatcacagcgccnactcccgacatcctcggcgagcgccagtccggccaggacgtccgcacgcagaacgtgatggtntgcggggcggtggccaacatcgtcaaatcctcgcntcggccccgttggtctcgacaagatgctagtggacgataattgggtgatgttacaatcactaatgatggagcaccatacttagnaatgttggaagttgagcatccagccgccnagggtcttgggtgagttggctgagctcccagatcgtgnaggtagaagatgaaataacttccngttgtcatcataagcggnngaagtactcangaagaggcaaggaatcttgggaagaataaaaatccatcccaactcctataatcaaggggtacggggtttggtatggcggaagccctgcaaaaatggttgaggaaaaaagtaacaatcccaggtttgaaaaaacttggaaaaaaaaaccccttaaaaactcctcaaaaaaaaaaaaggggcttccaaaatgataaaaa

SEQ ID NO: 29580 - DNA, 694 bp, Zea mays
  misc_feature: Ceres CLONE 1404630-F
  misc_feature: Encodes the peptide sequence at SEQ ID NO. 29581
  misc_feature (539)..(539): n is a, c, t, g, unknown, or other
  misc_feature (625)..(625): n is a, c, t, g, unknown, or other
  misc_feature (652)..(652): n is a, c, t, g, unknown, or other
  misc_feature (679)..(679): n is a, c, t, g, unknown, or other
caaagctggagctccccgcggtggcggccgctctagaactagtggatcccccgggctgcaggaattcacgagaccattacctagaacatcctaatcgaaaaaccttcccggctcctttactcgccggaggcgaaccagaactcgtgccacctcctcctgttccttgccatctccgaattcccatctgaaattccaagggccgcgccgtgcaatcgaggctctccccgctcaccatatatcggaggctccgcccccgcgcctcgaatccttcgcgagaggtgctgttgtttgccgtgatttgagccgggtggaggtgtctcgcttcttgatcttgagaggtgttcctggttgattgttgggagcgaagaaggcatgataccttctgtgaggatctctcctggctatgcagccttctctggctccagcctacgcttaaaattacattcaattccatccatctctagtctcaaaccctccaaatatgtggtctcctcgctgaaaccactctacctagcaccgctagatggtccacacacttnctgagcttaagtcttggagacaaccacttggagttccgttgtgctgcttctgctgccgatgacaaggagtcaagaactcgggtggntgccagtttcagttggagggcgccagnaaggttaaagatctccatctatttcgncgacctggtgggcgc

SEQ ID NO: 29581 - protein, 55 aa, Zea mays
  misc_feature: Ceres CLONE 1404630-F
MIPSVRISPGYAAFSGSSLRLKLHSIPSISSLKPSKYVVSSLKPLYLAPLDGPHT

SEQ ID NO: 29582 - DNA, 639 bp, Zea mays
  misc_feature: Ceres CLONE 1404634-F
  misc_feature: Encodes the peptide sequence at SEQ ID NO. 29583
  misc_feature (420)..(420): n is a, c, t, g, unknown, or other
cgtggatcccccgggctgcaggaattcgcacgagaccattacctagaacatcctaatcgaaaaagagcagagctgcctccagacgagacgaggaggacgcggcgccgctcgggcttggcagcaaccagcgtcgagcgcagtgcccttctgtctcctatctccccgctgcccagccgggtctcactttccagtctccgagactctgagtctcgctcgcaccccgtcccccgcagcctgtgctctgggttggagggaggtgagctgcgagggagcgcggagggggcgaggagatggaggcagattcggcgaggaagagacttgcattgctggccctgcttctcctggcggcgcccgtccgcccggcctcggcggctccgggtggaggatggcctgctcagcaatggtgactttgagacagancaaagtggtggttttgtaaaatctgcgtctgttgctgagggtgcatcgtcaatcccctggttggacgatcaacgggcacggttgaactccatttcagcaggccaacaccaggggtgccatgggatcctggattgttccccagggggacccttgcataaagggctaggggaatgatggctaccgtttgcgcaacgtggttgacccccccccacaaaaagg

SEQ ID NO: 29583 - protein, 197 aa, Zea mays
  misc_feature: Ceres CLONE 1404634-F
  misc_feature (140)..(140): Xaa is any aa, unknown, or other
RGSPGLQEFARDHYLEHPNRKRAELPPDETRRTRRRSGLAATSVERSALLSPISPLPSRVSLSSLRDSESRSHPVPRSLCSGLEGGELRGSAEGARRWRQIRRGRDLHCWPCFSWRRPSARPRRLRVEDGLLSNGDFETXQSGGFVKSASVAEGASSIPWLDDQRARLNSISAGQHQGCHGILDCSPGGPLHKGLGE

SEQ ID NO: 29584 - DNA, 687 bp, Zea mays
  misc_feature: Ceres CLONE 1404642-F
  misc_feature: Encodes the peptide sequence at SEQ ID NO. 29585
  misc_feature (413)..(413): n is a, c, t, g, unknown, or other
  misc_feature (467)..(467): n is a, c, t, g, unknown, or other
  misc_feature (544)..(544): n is a, c, t, g, unknown, or other
  misc_feature (619)..(619): n is a, c, t, g, unknown, or other
  misc_feature (636)..(636): n is a, c, t, g, unknown, or other
tccccgcggtggcggccgctctagaactagtggatcccccgggctgcaggaattcgcacgagaccattacctaaacatcctaatcgaaaaaacgggacgacagttcgtctccgcccgcatcgattgttgtccgctgttctccttcctcctcgtcctccttcaggccagcgggcaagaagaagaagaagaaaaatcaaggcttgcggcgagaggctgtgcccggccgaccggcgagcgaacttcgtacgcgcgtcatgggtggcggcagcaacagaggcggcgccggcgccggcgaggagagcggcagcgaccacgacggtgtgctgcggaggccgctgctcaacacggggagctggtaccggatgagctcgcggcagtccagctttgccccggggaccccctccatggccgtncctgcgcgagtcccacgtctccgccttcctctgcacgctcatcgtcgcgtcggncccaattccagttcggcttcaccagcggcttctcctcccgaccaggaagcccctggggttcgggacctcaacctccntatctcgagggtttccgggggttccggatcgctgtccaacgtccgggggcaatggttccgggggcgatcgccagncgggcaggatggccgangtacattgggccggaaaagagggtccgtttgatggattggctgcaatccca

SEQ ID NO: 29585 - protein, 137 aa, Zea mays
  misc_feature: Ceres CLONE 1404642-F
  misc_feature (97)..(97): Xaa is any aa, unknown, or other
  misc_feature (122)..(122): Xaa is any aa, unknown, or other
  misc_feature (128)..(128): Xaa is any aa, unknown, or other
MGGGSNRGGAGAGEESGSDHDGVLRRPLLNTGSWYRMSSRQSSFAPGTPSMAVPARVPRLRLPLHAHRRVGPNSSSASPAASPPDQEAPGVRDLNLXISRVSGGSGSLSNVRGQWFRGRSPXGQDGRXTLGRKRGSV

SEQ ID NO: 29586 - DNA, 701 bp, Zea mays
  misc_feature: Ceres CLONE 1404643-F
  misc_feature (468)..(468): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (510)..(510): n is a, c, t, g, unknown, or other
  misc_feature (516)..(516): n is a, c, t, g, unknown, or other
  misc_feature (555)..(555): n is a, c, t, g, unknown, or other
  misc_feature (574)..(574): n is a, c, t, g, unknown, or other
  misc_feature (608)..(608): n is a, c, t, g, unknown, or other
  misc_feature (610)..(610): n is a, c, t, g, unknown, or other
  misc_feature (612)..(612): n is a, c, t, g, unknown, or other
  misc_feature (613)..(613): n is a, c, t, g, unknown, or other
  misc_feature (618)..(618): n is a, c, t, g, unknown, or other
  misc_feature (619)..(619): n is a, c, t, g, unknown, or other
  misc_feature (631)..(631): n is a, c, t, g, unknown, or other
  misc_feature (633)..(633): n is a, c, t, g, unknown, or other
  misc_feature (653)..(653): n is a, c, t, g, unknown, or other
  misc_feature (657)..(657): n is a, c, t, g, unknown, or other
  misc_feature (675)..(675): n is a, c, t, g, unknown, or other
  misc_feature (686)..(686): n is a, c, t, g, unknown, or other
  misc_feature (700)..(700): n is a, c, t, g, unknown, or other
aaagctggagctccccgcggtggcggccgctctatcatagtggatcccccgggctgcaggaattcgcacgagaccattacctagaacatcctaatcgaaaaccgcagttcccacccaccaaaccaaactctcctccacaaccacaacctcccccgccgcccctcctcttctcggcttctcccctgccttgttcggccccaaaacggcaagagccgacgccagcaaaccctcgggttcgggagggaaggaaggcacgagcagtgcggctgcctacccgcagctaaccccaaacagcaacgtcgtagccgacgagagcctccgccacctacccaccaactcccgcccgtcgtcgcctccgcttgggttctcgtcgagcagttggtgggcacctaccgcatccagccacagagagagagtgagccactgagccagggcggcaagggggagatgaagaagctgaccagggcnaaaagggggggcgggcgnnncccccgggcgccggctgacgcntcggcngccggggcgctgccggcccgccgggctggcccctggcgnccgcgctgccggccgcggngccggcggggcgggcccgcccccgggccggcggngncnncccgnncccccccccggncngcggccgcccccgcccgggncccncccggccgggccggggcngcccccccgcnccggccgggccgcng

SEQ ID NO: 29587 - DNA, 760 bp, Zea mays
  misc_feature: Ceres CLONE 1404644-F
  misc_feature: Encodes the peptide sequence at SEQ ID NO. 29588
aaagctggactccaccgcggtggcggccgctctagaactagtggatcccccgggctgcaggaattcgcacgagaccattacctaagaacatcctaatcgaaaaaggctggatttgagcctgtttagcagcgctatccgcttggcccaattcgtctactgctcctccagctcctccgctgcgccgccggtcgccgcccgacaccgccgaagaagagcagacgccgagtccaggacgtcgccgcggggctcgaggaacgcggtgttgccatcgcgaggaaggtcggaagttcgctgttcgcccgccggatcggcaccgtcgccaccgcccatggcaaccgtcgcccccgtcgtctccgacctcgtcgacttcctcaacgcgtcgcccaccgcctttcacgccgttgacgaggcgaagcggcggctgaaggcggcggggttcgtgcacctgtcggagcggtaggagtggacgggtctcgagcccgggcgcaagtacttcttcacacgcaaccactccactattgtcgcttttgccatcggcgcaaaatacgttgctggcaatgggttccacatcatcggtgcacacactgacagcccttgcctgaagctcaaggctgtctccaaggtaaccaaaggaggttaccttgaggttgcggctcaaacgtatggtggtgcgttgtggtacacatgctttgaccgtgatcttactgtagctgccagagtgattatacgggacgagaatgatggcgtgctctcttatgca

SEQ ID NO: 29588 - protein, 43 aa, Zea mays
  misc_feature: Ceres CLONE 1404644-F
MATVAPVVSDLVDFLNASPTAFHAVDEAKRRLKAAGFVHLSER

SEQ ID NO: 29589 - DNA, 654 bp, Zea mays
  misc_feature: Ceres CLONE 1404647-F
  misc_feature (264)..(264): n is a, c, t, g, unknown, or other
  misc_feature (356)..(356): n is a, c, t, g, unknown, or other
  misc_feature (374)..(374): n is a, c, t, g, unknown, or other
  misc_feature (389)..(389): n is a, c, t, g, unknown, or other
ggtggcggccgctctagaactagtggatcccccgggctgcaggaattcgcacgagaccattacctagaacatcctaatcaaaaaacgcaacgcaacaccgcccacgtctctgatcactgtacgatcgaagtggtaggcagcgctactggaagcacagccgccgatgagtcgcctcctctcgcggcagcaccttgccgccgtccgtcgatctgcaccctttgcgtgcgtgtccaggtgactgcacacgccgtcattcgcgacggnttctccgcatgaggtttcaggttccagcccagcggaagtgcagaattttgtgcagggcagctggacagcatctgcttactggaactgaatangtcgatcccctgtacggngaataaatcatcaangttggcctgagttccgggaaaagaaataaaggccattcccgggaaaggttaatcttaatgcccaaaaggattgggtttcccaaccccctttaaaggttccgaaaagggagcctcctggggtggggggaattatttgggaaaaactgtgcaaattggtgggggcaaacccggggggctaaaaattttttttggaaaatttattccccgaggggaatttccccaaagaatcaaaaaaattttttggggaaaaatttatattttttca

SEQ ID NO: 29590 - DNA, 649 bp, Zea mays
  misc_feature: Ceres CLONE 1404650-F
  misc_feature: Encodes the peptide sequence at SEQ ID NO. 29591
  misc_feature (387)..(387): n is a, c, t, g, unknown, or other
  misc_feature (483)..(483): n is a, c, t, g, unknown, or other
  misc_feature (530)..(530): n is a, c, t, g, unknown, or other
  misc_feature (581)..(581): n is a, c, t, g, unknown, or other
  misc_feature (618)..(618): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
cgctctgaactagtggatcccccgggctgcaggaattcgcacgagaccattacctagaacatcctaatcgaaaaaaaaagctggcagtgtcggtgtcggtgtcgtcgtcggcgtcggtgctggggagcgggcgagcggcgcgtcgcatgattctgtcctcctgacgtggcagctaacgattccgattccctttggttgcagtgcgacgacattgacatggacatggcgcagctggagtggctgtcggggctcttcgacgacgcatccatcccgcacgagccggcgttccccggcgcggcgcccatcatcaagagctccgcgctggcggccggcgcgctgctgccgccggacaagatgggggacgcgctgctgttccgcagctccagncccatctcggtgctggagcacggcagcttcaacaacgccaacggcggtggcggcggctggctccgcgtcgtcggagtccgtcctcggcgcctcggntcctcggagtctttctccggcagcggaaagcgcgagggcattggtgngggctcggcgcccgtgtcgccgccacccgtgctcgtcataccggcgcgcgncgcggagcaagcgctcccgcccgtccgcgtcacgcgngnnnccgggggggaaggcgcccaccatcctc

SEQ ID NO: 29591 - protein, 144 aa, Zea mays
  misc_feature: Ceres CLONE 1404650-F
  misc_feature (57)..(57): Xaa is any aa, unknown, or other
  misc_feature (105)..(105): Xaa is any aa, unknown, or other
  misc_feature (122)..(122): Xaa is any aa, unknown, or other
  misc_feature (135)..(135): Xaa is any aa, unknown, or other
  misc_feature (136)..(136): Xaa is any aa, unknown, or other
MDMAQLEWLSGLFDDASIPHEPAFPGAAPIIKSSALAAGALLPPDKMGDALLFRSSXPISVLEHGSFNNANGGGGGWLRVVGVRPRRLGSSESFSGSGKREGIGXGSAPVSPPPVLVIPARXAEQALPPVRVTRXXGGEGAHHP

SEQ ID NO: 29592 - DNA, 642 bp, Zea mays
  misc_feature: Ceres CLONE 1404651-F
  misc_feature: Encodes the peptide sequence at SEQ ID NO. 29593
  misc_feature (393)..(393): n is a, c, t, g, unknown, or other
  misc_feature (508)..(508): n is a, c, t, g, unknown, or other
  misc_feature (529)..(529): n is a, c, t, g, unknown, or other
  misc_feature (536)..(536): n is a, c, t, g, unknown, or other
cgctctagaactagtggatcccccgggctgcaggaattcgcacgagaccattacctagaacatcctaatcgaaaagccaagctttcctcaaaaactcgaaaaaggaacggagaaggcgtcctcgacgactgcccatggccgccgcccggacctagccagggattgttgtctcctgagtcccgacctaccaaggcggaaagggagagggggcgctgtggcgtcaggaaataactggaagccgagggctgagggcgagcgcagagtcgggtggttatcgctttctttttcgttttctttttccggaggggagagtattagggatgccggttgctaggccggagccgcaggagccccgggtgatcgcccatgtcgacatggactgcttctatgttncagtcgagcagcggaggaacccggcgctcaggagacagccgaccgccgtggtgcagtacaacggctggaaaggcggcggcttgattgtcgtcagctacgaggctcgtggattcgntgtgaagaggtccatgcgcgnagatgangccaagagtatgtccctgcaattaatctttgtcaagtcccagttggcccggggaaagggtgaacctaatcttttaaaaaaagggtgggggcctaaagttttttcac

SEQ ID NO: 29593 - protein, 107 aa, Zea mays
  misc_feature: Ceres CLONE 1404651-F
  misc_feature: SWISSPROT Homolog: EC 2.7.7.7 DNA-directed DNA polymerase
  misc_feature (25)..(25): Xaa is any aa, unknown, or other
  misc_feature (63)..(63): Xaa is any aa, unknown, or other
  misc_feature (70)..(70): Xaa is any aa, unknown, or other
  misc_feature (72)..(72): Xaa is any aa, unknown, or other
MPVARPEPQEPRVIAHVDMDCFYVXVEQRRNPALRRQPTAVVQYNGWKGGGLIVVSYEARGFXVKRSMRXDXAKSMSLQLIFVKSQLARGKGEPNLLKKGWGPKVFS

SEQ ID NO: 29594 - DNA, 513 bp, Zea mays
  misc_feature: Ceres CLONE 1404653-F
  misc_feature (316)..(316): n is a, c, t, g, unknown, or other
ggcggtggcggccgctctagaactagtggatcccccgggctgcaggaattcgcacgagaccattacctagaacatcctaatcgaaaaagtgcagcactgctactgcctccactccagtcccaggctcccatctcagagctctcagcggtggcggccggcgaccggcgagctcctccggcatcggatcccctggagtggagcgtgaccacgctggggctgcttcacacctcgtgcttcgtcgtctctccgctcactggtgctcggtcaggatggcgtgacatacatgcgaatcctgctgaaaaatgcagttataggnatgaaattgaaaaagtgaggaggccgtggcagggccctttatcagttgaaccggaaggccttgagtgccaaccgaggaaagtggcccaagaactaacttcaagggacccccggaccaggggggggagggcccaaagaagaaattggtagggttttttttcggcccccggaaaaaaagtttttggaaaaaccccggaa

SEQ ID NO: 29595 - DNA, 614 bp, Zea mays
  misc_feature: Ceres CLONE 1404658-F
  misc_feature: Encodes the peptide sequence at SEQ ID NO. 29596
tggagctccccgcggtggcggccgctctagaactagtggatcccccgggctgcaggaattcgcacgagaccattacctagaacatcctaatcgaaaagcattgcattgcataaacctctcgtgggaagtgcaaacaccaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggcaccgtccccttctacccgtccgcggagtccgccgccgccgcgcactgcgacggcacgctgtacccggagctctgcctgtcgacactcgcggacatcccggacctacccagaagcccgctccgggacgtcatctgcgccggccgtgaaccgcacccaaggaacggtggtgggccgcccacgtccaagcaaactggttccgaactaaccctgaaaggaaaagggccccttgtgtcgggcccggggaaccccccccgggcccattacaaaaacatgcccccgggaaacctctctcttccc

SEQ ID NO: 29596 - protein, 127 aa, Zea mays
  misc_feature: Ceres CLONE 1404658-F
MPPIPKRGEHLLVLLIVACAATAATAAGTVPFYPSAESAAAAHCDGTLYPELCLSTLADIPDLPRSPLRDVICAGREPHPRNGGGPPTSKQTGSELTLKGKGPLVSGPGNPPRAHYKNMPPGNLSLP

SEQ ID NO: 29597 - DNA, 675 bp, Zea mays
  misc_feature: Ceres CLONE 1404660-F
  misc_feature: Encodes the peptide sequence at SEQ ID NO. 29598
  misc_feature (293)..(293): n is a, c, t, g, unknown, or other
  misc_feature (310)..(310): n is a, c, t, g, unknown, or other
  misc_feature (336)..(336): n is a, c, t, g, unknown, or other
  misc_feature (342)..(342): n is a, c, t, g, unknown, or other
  misc_feature (343)..(343): n is a, c, t, g, unknown, or other
  misc_feature (352)..(352): n is a, c, t, g, unknown, or other
  misc_feature (358)..(358): n is a, c, t, g, unknown, or other
  misc_feature (359)..(359): n is a, c, t, g, unknown, or other
  misc_feature (407)..(407): n is a, c, t, g, unknown, or other
  misc_feature (415)..(415): n is a, c, t, g, unknown, or other
  misc_feature (416)..(416): n is a, c, t, g, unknown, or other
  misc_feature (418)..(418): n is a, c, t, g, unknown, or other
  misc_feature (424)..(424): n is a, c, t, g, unknown, or other
ggagctccccgcggtggcggccgctctagaactagtggatcccccgggctgcaggaattcgcacgagaccattacctagaacatcctaatcgaaaacagtaccaccaacaaacttctttctcgccttgcatcggccgccggccctccatccaccgcaccagctagcaacgacgacacgctagccaggtagcgtagccgaccagcctccgcgcgcgcgggcactcagttcgccatggcgcgcctgctccgcgccgccgccggcctcgcgctcctcctggccgtccttgccccgncggcgtcggcgggcggngaactgggccagctgggcgccgccgncgtganncggcgcggnggcggnnggacgacgtgccgcggaagcacggggggcgagggcatggagtacccgnacttgganncnaagggngaagcccactgggcggccatggccacccgagagaaaaaaaaggcttgaggctgaaggggggtctccggtacgccggggtacgaacacaatgacaaaaaaacaatgctgcctttgtccctcagcaacgggcggtgtcaaaaaaaaaacatgtcagccccggtgcccgaagccccacccccttaacccaccccgggctgtaggggaccatccgacccaagtaggaagggcgcttggaatggcctagccacgca

SEQ ID NO: 29598 - protein, 79 aa, Zea mays
  misc_feature: Ceres CLONE 1404660-F
  misc_feature (21)..(21): Xaa is any aa, unknown, or other
  misc_feature (35)..(35): Xaa is any aa, unknown, or other
  misc_feature (37)..(37): Xaa is any aa, unknown, or other
  misc_feature (43)..(43): Xaa is any aa, unknown, or other
  misc_feature (59)..(59): Xaa is any aa, unknown, or other
  misc_feature (61)..(61): Xaa is any aa, unknown, or other
  misc_feature (62)..(62): Xaa is any aa, unknown, or other
MARLLRAAAGLALLLAVLAPXASAGGELGQLGAAXVXRRGGGXTTCRGSTGGEGMEYPXLXXKGEAHWAAMATREKKKA

SEQ ID NO: 29599 - DNA, 695 bp, Zea mays
  misc_feature: Ceres CLONE 1404663-F
tggcggccgctctccaactagtggatcccccgggctgcaggaattcgcacgagaccattacctagaacatcctaatcgaaaactgataggcagatactaaatcctactatcttctctttgctacctctctctctctccccctgcgcgcctgtctgtctgcctgtcttgtagcctcatcaatggataccatcatatatcactcacgactacgacagcactcggtcctcgctgacgtccccggacggatcccgccgaaactagatcatcgacattggcaacatcaactcgcactcgctgaactccaagatacactgagactggtacaagcacaagtgccagaaccttcacaagaatatcaaagggaaccactccgagtgcaatgacatcgacaaccaccaggcctccgcgacgcgcgatcgtgcagtagcacatccttatgatgaaggctcctgagcagcggcaagcatcgcggacgtgtacctctagcaatgcgcgagccctgcacaccacgagtgcctgaatcgccatgaggagaagcacaacgaccgctgaccatcaccagaacatcggcagaacagagtgaagtgccaatctctcgaggatgcgacaaccatacatcaacgatgtacgaggatccgaggatcaagtacgactgctcgtctggagtctgctcagggctcaatgcttgagacccc

SEQ ID NO: 29600 - DNA, 698 bp, Zea mays
  misc_feature: Ceres CLONE 1404665-F
aaagctggagctccccgcggtggcggccgctctagaactagtggatcccccgggctgcaggaattcgcacgagaccattacctagaacatcctaatcgaagaattcactcctccctctgcctgtattcttcggttcgcccctgggatcctcgtcacgactcatgccatccgcccccaccgccaccaccagccacaccatctctgttctccagtcacgcccgacggccagaacccacaattttcatcacaccaaaccatccactcctcacctttccccccgaacaagacctatctttacgacgacgttgtcgccaactacaacccctttcccttctgggtgcctcaccagattacccactcacatcctgctaccaagcacaaaagctgcgacatttgccatactgtttcatccgcggaacccaatcttgccgcccgatccttcgcagaatccaccgtacgtgcttgctgcccctgatccagtccagactctagacgatgctggctgcgccgtgcaatccgagcgttgcctgctaattccgctcgggaacacgcacgaggagatccgccaagtcgcaagaagcgatctccatccacggcgttgccctggctgctcgcgctccggcagctcccatgtcggacacggagctgtcccagagcacggtggtgtttgggctccgcatgtgggtgctcgacggcat

SEQ ID NO: 29601 - DNA, 589 bp, Zea mays
  misc_feature: Ceres CLONE 1404666-F
  misc_feature: Translation starting site: 203
  misc_feature: SWISSPROT Homolog: EC 2.3.1.41 Beta-ketoacyl-acyl-carrier-protein synthase I
cgctctagaactagtggatcccccgggctgcaggaattcgcacgagaccattacctagaacatcctaatcgaaaaagccagcaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggcggaatctcccgggacgcctctccgtccgcgcctccgcgaacgtggtagcggcaccgcggcgggagacggatcccagaaagcggtgtgatcacggggatggggctggtcttcgtttcgggaacgatgtaaacgctactacgaccgctgctagtcggggagagcggatccggccatcgaccggtcgaagcttcttagttcccaacccgctttgcggtcaaaatcgggggtttcccttcccagggataactcaccggaaaaaacaacgccccccttgataattgccccccaaatggaacccccaggggaaaaaaggtctccaggccccc

SEQ ID NO: 29602 - DNA, 647 bp, Zea mays
  misc_feature: Ceres CLONE 1404669-F
  misc_feature: Encodes the peptide sequence at SEQ ID NO. 29603
cgcggtggcggccgctctagaactagtggatcccccgggctgcaggaattcgcacgagaccattacctagaacatcctaatcgaaaactcgggccgtccgccgtcggtgggcacgaccctggcgtaatctgctccatacgtggtggcgcctgcaaaagccacgctgctgccagtgccagccatggatgcattggcgttcagcgacgccgtactcctccttgctactgtagttatctccctgctcatcactgccaatttctggagcaggtatggtccccatgtccaaacgacgagactatcgtcgctactgttgatgcgccacctacacctgctcggtaaggtgaaggcgctgcatcgcagacaagacctctctgccgatgccatcggcgaaattggaacaccaagaagacgacgactgctacctaatcgatcaggaggacgatgccctagaagagtccgttctccatgtcctcgaggacgagcacctcgaggactgccattggtccgcctcatgcgtgatcaccaaggaatccctcttggcagcgcagaaggaggatcttaggaaggtgatggagctgctagggttgagggagcaccatgcccggacgctcctcatccactaccgctgggacgtggagagcattttt

SEQ ID NO: 29603 - protein, 90 aa, Zea mays
  misc_feature: Ceres CLONE 1404669-F
MPSAKLEHQEDDDCYLIDQEDDALEESVLHVLEDEHLEDCHWSASCVITKESLLAAQKEDLRKVMELLGLREHHARTLLIHYRWDVESIF

SEQ ID NO: 29604 - DNA, 681 bp, Zea mays
  misc_feature: Ceres CLONE 1404670-F
  misc_feature (409)..(409): n is a, c, t, g, unknown, or other
  misc_feature (662)..(662): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (670)..(670): n is a, c, t, g, unknown, or other
  misc_feature (671)..(671): n is a, c, t, g, unknown, or other
tccccgcggtggcggccgctctagaactagtggatcccccgggctgcaggaattcgcacgagaccattacctagaacatcctaatcgaaaaatagcctcctcgtctcctcgagaactgtagcatcacgcgccgcctttgattgagcagggactgggagagaggagaagagagggtgaaagggggcaagaaaacgcttcttgttgcctttgtgcttcagcggatccgcggtggctgcgcacgccggcggggaagaggagtcgcgggcggcgcgcctccagtctttcttcgcctccgtgctctccgggctcttcggccaggccgaggccgaggacgaggacgaggacgaagagatgcccacgcgcaaccacaacgctgccgcggctgccgctccgcagcatcaccatcacnaaccgaggtgtgctccctctcttggaaggagcaaggccgtgcccggccgagctgatcccatgaaccggcgagccccccctcggcgatattggcaacctcgtcagcgtccggccagcccgaagggaagcctcagctggcaggagcagatcaatcgccccatcacgcgaagcttcggcggctcagctcgtgaaagaacgtggcaggcgaatgccgcaatcaagaatgccgcaatcctacccgcgaggacgcgcgnagnnnngnngaaaggaagg

SEQ ID NO: 29605 - DNA, 640 bp, Zea mays
  misc_feature: Ceres CLONE 1404672-F
  misc_feature: Encodes the peptide sequence at SEQ ID NO. 29606
  misc_feature (299)..(299): n is a, c, t, g, unknown, or other
  misc_feature (351)..(351): n is a, c, t, g, unknown, or other
  misc_feature (398)..(398): n is a, c, t, g, unknown, or other
cgcggtggcggccgctctagaactagtggatcccccgggctgcaggaattcgcacgagaccattacctagaacatcctaatcgaaaacacgctagtagaaatccctccaaacccaacgcctacaattacaaagatacaccgcctcccgcttccttctccgccatacctcgtgtccgacgagccctagggaacgcgagaccggccgtcggcgagagaaggactcgaatggagtgcgcaagggagttgcgggttcgctccacgtttacggcggcggccatggcgtccaagaagcaggtggngctgggaggcgcggttcccgctcaggaacagatgaaacggcggcgatgccgncagactggtcaggaaagccatggatacatttccacagccagcggcgncaagaagcccgtaggcaccttggtcgacggtggcaatcctaatgaatgggcgggccctttccttgggaacatcaaaaacaaggggtttggggaaaggggaacccagcattaacccactccacgggcgggaaaaaaaaaaccctttggttcctccgggaaaaaaaaaaagggtctggaccccctttgggcgggggtttaaaaattttttgggttcaaaagaccggggggtgtcctggaaaata

SEQ ID NO: 29606 - protein, 94 aa, Zea mays
  misc_feature: Ceres CLONE 1404672-F
  misc_feature (25)..(25): Xaa is any aa, unknown, or other
  misc_feature (58)..(58): Xaa is any aa, unknown, or other
MECARELRVRSTFTAAAMASKKQVXLGGAVPAQEQMKRRRCRQTGQESHGYISTASGXKKPVGTLVDGGNPNEWAGPFLGNIKNKGFGERGTQH

SEQ ID NO: 29607 - DNA, 640 bp, Zea mays
  misc_feature: Ceres CLONE 1404673-F
  misc_feature: Encodes the peptide sequence at SEQ ID NO. 29608
  misc_feature (406)..(406): n is a, c, t, g, unknown, or other
  misc_feature (435)..(435): n is a, c, t, g, unknown, or other
  misc_feature (446)..(446): n is a, c, t, g, unknown, or other
  misc_feature (455)..(455): n is a, c, t, g, unknown, or other
ggagctccccgcggtggcggccgctctagaactagtggatcccccgggctgcaggaattcgcacgagaccattacctagaacatcctaatcgaaaaagcagagggccatcttctactcttctctcccagccaacccccttgtccaacggttcagcctgctcaattttagtgaccagttacggcaaatgcagccctcggcggacagcaggaagaagaagcggcggcggcggaggaggaggaggctggcggcatgctactcatcgagacctgctgccggcgccgctcaaggccagtgtcagtgcggctcctctagccccggtggcggcggcggaagcggcagcctcgtggcaagaacaccgcgcgcgttctcgagctgctccagctacgccgccctcgtctgcctgcngcgcgcgacgacgtcatctcgggaccagnacagctgacgnggttctcgncggttcgggctcctcctggtctccgtgggctcctttttaagggtcccggggtgtccccccacagtgggaaggatccccaccccctggagaggattaaaagaccccccggggttccctggaacccggaagggaaccctttattgggtggggggaaaaaaaaaaaggcttgacaacccccttccagg

SEQ ID NO: 29608 - protein, 85 aa, Zea mays
  misc_feature: Ceres CLONE 1404673-F
  misc_feature (74)..(74): Xaa is any aa, unknown, or other
  misc_feature (84)..(84): Xaa is any aa, unknown, or other
MQPSADSRKKKRRRRRRRRLAACYSSRPAAGAAQGQCQCGSSSPGGGGGSGSLVARTPRAFSSCSSYAALVCLXRATTSSRDQXS

SEQ ID NO: 29609 - DNA, 693 bp, Zea mays
  misc_feature: Ceres CLONE 1404679-F
  misc_feature: Encodes the peptide sequence at SEQ ID NO. 29610
  misc_feature (517)..(517): n is a, c, t, g, unknown, or other
  misc_feature (580)..(580): n is a, c, t, g, unknown, or other
  misc_feature (595)..(595): n is a, c, t, g, unknown, or other
aagctggagctcaccgcggtggcggccgctctagatctcgtggatcccccgggctgcaggaattcgcacgagaccattacctagaacatcctaatcgaaaactaccgagttttccttccccacctccccgccccacccgtcgccgaatcggagtcccgctcgcgtccacccttgccagagctcaagagctacctcctggtccggttggacagatcccttcgggcgctgcgtccaccgggattcaggcaaagtggtgtaacataagatgcaagggggaagaggtgggaggcagggtttgttcggttttggggacccttttgttggtttcggcggctttggacagccagggaacataatgtccggtttctttggtggcgcaaatccctttgatgaccctttcttcacaaacccctttggtggcatgatgcaacctagtttctcaacccctttcagcggcatgatgcaacctagcttcatgaacccctttggtagcatgatgcaacctagcttgcttggnatcagtatgtttgcagcccatggcaaatctcatggaggcacttttggaaagcagacacatctncatcaaggcatgagncatggcagtggtttcattcagcaagcctctgaatcgagcaggcctaaaaggccattattcaaggagttggcttcagatgacgggataaagcagagatg

SEQ ID NO: 29610 - protein, 142 aa, Zea mays
  misc_feature: Ceres CLONE 1404679-F
  misc_feature (110)..(110): Xaa is any aa, unknown, or other
MQGGRGGRQGLFGFGDPFVGFGGFGQPGNIMSGFFGGANPFDDPFFTNPFGGMMQPSFSTPFSGMMQPSFMNPFGSMMQPSLLGISMFAAHGKSHGGTFGKQTHLHQGMXHGSGFIQQASESSRPKRPLFKELASDDGIKQR

SEQ ID NO: 29611 - DNA, 679 bp, Zea mays
  misc_feature: Ceres CLONE 1404682-F
  misc_feature (316)..(316): n is a, c, t, g, unknown, or other
  misc_feature (345)..(345): n is a, c, t, g, unknown, or other
cgcggtggcggccgctctagaactagtggatcccccgggctgcaggaattcgcacgagaccattacctagaacatcctaatcgaaaaagcggagcactgtgcaggcgaccgcggcgcgctatcacttacggggggatacggcggcatcgtccccctcggcccctcctccatccctggtgcggcggcgccagcctgcaggtgttgaatgctgatttgttgtggctgattaatcgggttgatcgtcgattaatcgtgattagtcggctgatcgcccttctggcgatcagaaacgataagggcatctgaaaacattggnccgccaacctccagagcgactcctgcgangcgtgaccacccataggctaatcacgcaccagaagctttcacggagctgcctcgcccacgagggtccaagtgactctattccctggggaaatggaagttcggaaaggaaaggggggggggggggggcccttggcccccggggaacccgtgggttttttacaaaagggccccccccccccccccccgaaaaatggggcccctttggggggccgcggggaaaaaaaaaaacaaaggggtttttgggaggggacccccctcccccggggggggggggtttgggggctcttcgggcccattttggggggggaaaaaaaaaaaattttattttgggtgg

SEQ ID NO: 29612 - DNA, 717 bp, Zea mays
  misc_feature: Ceres CLONE 1404683-F
  misc_feature: Translation starting site: 258
  misc_feature (403)..(403): n is a, c, t, g, unknown, or other
  misc_feature (410)..(410): n is a, c, t, g, unknown, or other
  misc_feature (466)..(466): n is a, c, t, g, unknown, or other
  misc_feature (519)..(519): n is a, c, t, g, unknown, or other
  misc_feature (543)..(543): n is a, c, t, g, unknown, or other
aagctggagctcaccgcggtggcggccgctctagaactagtggatcccccgggctgcaggaattcgcacgagaccattacctagaacatcctaatcgaaaaaaaaaaaactccaaaaacgcaacacatcgcgtcgcgattcgcgagggctccccccaaccccatcaagtctggccaggtctctcccatatcgggttctcccttcctcttcctgtttccgcgcgcgagatcgccgccccgggtgggctctagatcccgatggcctcgcgccgccgcaccctgctcaaggtcatcatcctcggcgacagcggggttgggaagacgtctttgatgaaccaatatgtgaaacagaagttcagcaaccagtacaaggctacgattggggcggatttcctcaccaaggnagtgcangttcgaggacaggctcttcactctgcaaatatgggacactgctggtcaggaaaggnttcagaggtctgggcgtgcattctaccggggagcaaaattgtggggccctagnctatgaagtaaattctatgaaatncgttggaaaatcttcccaactgggcggggaaagtttctaattcgggggagcccatcaaacctggaaaattcccttttgttcggtggggaacaaaattgaaggaaaggggggaaaacccggggggggtcaaaaaaaaggaaagggttggggcgcccttaagggaaaatcccccat

SEQ ID NO: 29613 - DNA, 700 bp, Zea mays
  misc_feature: Ceres CLONE 1404694-F
  misc_feature: SWISSPROT Homolog: EC 2.7.11.1 Non-specific serine/threonine protein kinase
cgctctgaactagtggatcccccgggctgcaggaattcgcacgagaccattacctagaacatcctaatcgaaaaacagaacagggagggaggtagagaggactagaggagtcggagcctcggaggagggagagggcgaagagcatggggaaccaaatgcttggaggggaaacgtagagttctttcgtggaggaagcgggtgcaactggagtgagggtagcaggtagctcaatagatctactgctgtcgggggagctattggatagctgagttgctgcacgttggctttcttcagagatggattcagatggcgtagccccatctggctacaaaaacagcaccatcactaccattggtgccgagaagttgcaagatcagatgaacgagctaaagattagagatgattaggaagttgaagcaaccataattaatgggaaagggactgaaactgggcacataattgtcaccactactggcggcaagaatggtcaaccagaacagactgagagctacatggctgagcgcattgtaggtcaaggttcttttgagattgtcttccaggctaactgtgtggagacgggtgagactgttgtcataaagaaggatcttcaggataagcgttacaagaaccgtgagttgcagaccatgcgccttcttgaccaccctaatgttgttgctttgaagcattgcttcttttcaac

SEQ ID NO: 29614 - DNA, 685 bp, Zea mays
  misc_feature: Ceres CLONE 1404695-F
  misc_feature: Encodes the peptide sequence at SEQ ID NO. 29615
  misc_feature (257)..(257): n is a, c, t, g, unknown, or other
  misc_feature (359)..(359): n is a, c, t, g, unknown, or other
  misc_feature (425)..(425): n is a, c, t, g, unknown, or other
  misc_feature (483)..(483): n is a, c, t, g, unknown, or other
  misc_feature (487)..(487): n is a, c, t, g, unknown, or other
  misc_feature (522)..(522): n is a, c, t, g, unknown, or other
  misc_feature (685)..(685): n is a, c, t, g, unknown, or other
tacccgcggtggcggccgctctagaactagtggatcccccgggctgcaggaattcgcacgagaccattacctagaacatcctaatcgaaaacgttccaggtcgtggtctttgccaaattcccacgcccctgcccaccctgcccgaatcctctcgccctttacccccgcccgcgaccccattcacactctcgctgctccactccgctccgctcagctcgtcgggacgcgcccccgcctcccatcccatgcccgccccncgcgctcgtcggaggccgctcgcggcggcctcccatcccgccgcgctgacgagagggcctctcggtgggggcgcttcgggtggttcattttgtccgttcggnggaaggggagtgcggcgatggggaagcagcaggaggggaagcggcggcgcggggagaaggacgggncagcggaaggggaagggggaagacagctgcagcggcggtgccggaggagcgggccagntggnccgggtgctggatccgcttcccgcgcctccgcggntgcatgccgtcgcgcgccaaggtcgactcctccaccagcgcgccgtggcggcggccgggaaaccaaaccatctacttgatgatgcttgccaggaccaatcagtaccgccaagcctctggttccgcaacaaccagaaaacactggaagtatctcaccttcttcn

SEQ ID NO: 29615 - protein, 53 aa, Zea mays
  misc_feature: Ceres CLONE 1404695-F
MPSRAKVDSSTSAPWRRPGNQTIYLMMLARTNQYRQASGSATTRKHWKYLTFF

SEQ ID NO: 29616 - DNA, 687 bp, Zea mays
  misc_feature: Ceres CLONE 1404696-F
  misc_feature: Encodes the peptide sequence at SEQ ID NO. 29617
  misc_feature (580)..(580): n is a, c, t, g, unknown, or other
  misc_feature (589)..(589): n is a, c, t, g, unknown, or other
ggcggccgctctataactagtggatcccccgggctgcaggaattcgcacgagaccattacctagaacatcctaatcaaaaaattcgaacggaggtccttttcttctttctcgtctgcttcctccttccctcgtcgtcctcgcgtcgcctccttcggccctccctattaatacctgcctcctcacaaccaggtcctgtcctcggggagccgaatccacacggaccacaccagaggacgcgggggacgccccggattcttcggattccaggatggaactacacagaaatagcactaatggttcctgcctcagtgcatgtgggccactgacagactactacattcctgattacatactgaagccggcctatgaaccggtcactgttgataatgtgccatgttgtcctgtggtagtcttcatcaactctagaagtggtggccaactgggaagcagtctgataaaaacataccgtgaacttctcaatgaagcgcaggtttttgatctctcagaagagtctcctgataaggttctacatagattatacagcaactttgaaagggctcagtctagtggtgaccatgntgctactcnaattcagaagagcttaaggctaattgttgctgggggggaccgaccaacaagtttggctgctttggggaaattagggccccgaaatattcccccccccc

SEQ ID NO: 29617 - protein, 139 aa, Zea mays
  misc_feature: Ceres CLONE 1404696-F
  misc_feature: SWISSPROT Homolog: EC 2.7.1.107 Diacylglycerol kinase
  misc_feature (104)..(104): Xaa is any aa, unknown, or other
  misc_feature (107)..(107): Xaa is any aa, unknown, or other
MELHRNSTNGSCLSACGPLTDYYIPDYILKPAYEPVTVDNVPCCPVVVFINSRSGGQLGSSLIKTYRELLNEAQVFDLSEESPDKVLHRLYSNFERAQSSGDHXATXIQKSLRLIVAGGDRPTSLAALGKLGPRNIPPP

SEQ ID NO: 29618 - DNA, 696 bp, Zea mays
  misc_feature: Ceres CLONE 1404697-F
aagctggagctccccgcggtggcggccgctctatactagtggatcccccgggctgcaggaattcgcacgagaccattacctagaacatcctaatcgaaaaatccgattcactccaatacagattcatcgccttaaacccctctttaaatccattaactacgatctacccttcaattcgagtttctcatctgcaaggcggtctatctgcgattagccttcctccaataaaattcatcttcccagttcgttaaaacaacaaagtaaatttatttaccgacaaatggctgatttcaaagttcttctttctgatttgaagtcaatcgcggttgggaacttatatgctcttactagatgcaaagttgctttgttgatgacatagaagaaaagaagggagggagcagaaggagagtattgttaatggtatcagagagactgtcaaaaatataactctgtccatgtttctcttttgaaaacatgaaaaatatcaaattcaaggagtttagacaacagtttagacacaacgaaaggttcttcctcggctagaacaaattgatgcagtttgctcttgggccttctgcttgggatgaaatccatcctgccatctttaaagcttccagattcttcatgctgagatgactgcttattacagatatgccaaaggaagaggtggaaagcttatttgactcctatggaaat

SEQ ID NO: 29619 - DNA, 682 bp, Zea mays
  misc_feature: Ceres CLONE 1404698-F
  misc_feature: Encodes the peptide sequence at SEQ ID NO. 29620
  misc_feature (524)..(524): n is a, c, t, g, unknown, or other
  misc_feature (529)..(529): n is a, c, t, g, unknown, or other
  misc_feature (625)..(625): n is a, c, t, g, unknown, or other
  misc_feature (636)..(636): n is a, c, t, g, unknown, or other
aaagctggagctccccgcggtggcggccgctctagaactagtggatcccccgggctgcaggaattcgcacgagaccattacctagaacatcctaatcgaaaaacacacgcgggcgcgctagctagtgagagtcggagatgtcgtcgccgcggccacacttcctcgtgctcaccttccctttccagggccacatcgccccggctctccgcctcgccaggcagctgctcgcggcggcgcccgacgcgctcgtgaccttctccaccaccgaggtcgcgcacaggcgcatgttcccggcaaagcccaacgacggcgccaaggactccgacgaagacggccgcctcgagttcctcccgttctccgacggcacggaggccgggtacgtccggagcgccgacctgggctcgttcaacgcctacatgacgtctttccacgccgcgggggcgcgcagcgccgcggagatcgtgacggtccgcgcgggggcggggccgccccgtgtcccgcgtcgtgtaccgctgctcctcccngtggncggccgacgtcgcgcggaaaccgcgggatcccgtccgcgctctatgggatccagcggggtctccgtgttcgccatctaccaccactacttcacggncacggcccggnggtcgtcgccgaccacttcacgaacgtggtttttttttgtgggggg

SEQ ID NO: 29620 - protein, 181 aa, Zea mays
  misc_feature: Ceres CLONE 1404698-F
  misc_feature (131)..(131): Xaa is any aa, unknown, or other
  misc_feature (163)..(163): Xaa is any aa, unknown, or other
  misc_feature (167)..(167): Xaa is any aa, unknown, or other
MSSPRPHFLVLTFPFQGHIAPALRLARQLLAAAPDALVTFSTTEVAHRRMFPAKPNDGAKDSDEDGRLEFLPFSDGTEAGYVRSADLGSFNAYMTSFHAAGARSAAEIVTVRAGAGPPRVPRRVPLLLPVXGRRRAETAGSRPRSMGSSGVSVFAIYHHYFTXTARXSSPTTSRTWFFFVG

SEQ ID NO: 29621 - DNA, 699 bp, Zea mays
  misc_feature: Ceres CLONE 1404703-F
  misc_feature: Encodes the peptide sequence at SEQ ID NO. 29622
aaagctggagctccccgcggtggcggccgcttcttacataaaggatcccccgggctgcaggttttcgcacgagaccattacctagaacatcctaatcgaaaagtgccacagtccctttcctcttccagtctcgccgccaattagtactcaccccctcccttgcatccgctcccctcccccctcctctcttccccccccgacctcggcgccgaggcatgctgttgccgtgagtgagcaagggatctttccggcgatcttggaggcggcgagcctggtgccgcatgctggctgtccggccggccggaggctagctagctctcgcctctcgaccgagaagtgaagtgaagtgaagcgagatgtatctggtgccgcacccggacagcccgcactccgacaacagcggcggtggcggcggctcggcgtccggggcgctgtcgtcgggggcgtcatccgcgggcgcggcgtctgcgctggcgtcgccgagccggtacgattcgcagaagcggcgctactggaacacgttcgggcagtacctgaggaaccaccggccgtcgttgtacatggcgcgatgcaacggtgcgcacgtgctggagttcttgcggtacctcgaccagtacggtaagaccaatgagcacaccccggcctgaccccatcatcggctatccggcgacagtcgggtctctgtccgagcccggatag

SEQ ID NO: 29622 - protein, 96 aa, Zea mays
  misc_feature: Ceres CLONE 1404703-F
  misc_feature (26)..(97): Pfam Name: DUF640 Pfam Description: Protein of unknown function (DUF640)
MYLVPHPDSPHSDNSGGGGGSASGALSSGASSAGAASALASPSRYDSQKRRYWNTFGQYLRNHRPSLYMARCNGAHVLEFLRYLDQYGKTNEHTPA

SEQ ID NO: 29623 - DNA, 695 bp, Zea mays
  misc_feature: Ceres CLONE 1404706-F
  misc_feature: Encodes the peptide sequence at SEQ ID NO. 29624
  misc_feature (468)..(468): n is a, c, t, g, unknown, or other
  misc_feature (470)..(470): n is a, c, t, g, unknown, or other
  misc_feature (471)..(471): n is a, c, t, g, unknown, or other
  misc_feature (503)..(503): n is a, c, t, g, unknown, or other
  misc_feature (507)..(507): n is a, c, t, g, unknown, or other
aaagctggagctccccgcggtggcggccgctctagaactagtggatcccccgggctgcaggaattcgcacgagaccattacctagaacatcctaatctaaaactcttcgtcgtcctatcttataatcgcatttcgaaatccccaaacggaggcctcgccactcttccgaacctgaacaatcaccaccgttattaagaagatgatgcgctgcgctgcaacgggcggcgggtgcgtcgcttcgtggagcggcgattggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggntnncagttaatcctcaggacatggtctgccatatngtgncgttgcttggttggggggctattctggttgggttacccatcttgtgggggcaatgccggcacttgaattacctcgggaaggaaccttggaatggcttaaaaagggtgtctttggaaggggtgggggggtaaacaccacccctggggtgggggggcaaccaaaggtcttttttaagggggggggtcctt

SEQ ID NO: 29624 - protein, 92 aa, Zea mays
  misc_feature: Ceres CLONE 1404706-F
  misc_feature (90)..(90): Xaa is any aa, unknown, or other
  misc_feature (91)..(91): Xaa is any aa, unknown, or other
MMRCAATGGGCVASWSGDWRLPAVNPCSVRMPTGNDGWCAGLRSRAADLAGLEMANLRGGVGGLFRASPRYGRLQATAAVDPEDIPLEKXXS

SEQ ID NO: 29625 - DNA, 695 bp, Zea mays
  misc_feature: Ceres CLONE 1404707-F
  misc_feature: Encodes the peptide sequence at SEQ ID NO. 29626
aaagctggagctccccgcggtggcggccgctctagaactagtggatcccccgggctgcaggaattcgcacgagaccattacctagaacatcctaatcaaaaaagccctggcaaagcgcttgccgctgctcccctcttccgtttccagcgccgccgccctccttcctgttcctgttctccagcaccgccgttgaacctcctcccctctccctcgtgcttccctctctcatcctctctgccgcttccccgctctccccaaactactctgtgccccgtcagatcgacctggactttggcggcagctacttcttctcgacgggcggcacggcagcaagccagcaaggagaacgcggcggcacgggcctgctgctacttctgcttcctctcccacgcttgctgttgagcagttcaagcagagctgatggctacatcagagccagtacaagagagtttggtggtgcactactcacaacctagtaggccccgggtcctccttgctgcttcaggaagtgtagccgctataaaatttgagagcctttgccgtagcttctctgagtgggcggatgtccgagctgtggccaccacgtcatccttgcacttcgttgatagatcatctctaccaagtggcatcgttctttacactgatgatgatgaatggtcaacctggaagaagataggagatgaagtcttacacat

SEQ ID NO: 29626 - protein, 91 aa, Zea mays
  misc_feature: Ceres CLONE 1404707-F
  misc_feature: SWISSPROT Homolog: EC 4.1.1.36 Phosphopantothenoylcysteine decarboxylase
MATSEPVQESLVVHYSQPSRPRVLLAASGSVAAIKFESLCRSFSEWADVRAVATTSSLHFVDRSSLPSGIVLYTDDDEWSTWKKIGDEVLH

SEQ ID NO: 29627 - DNA, 667 bp, Zea mays
  misc_feature: Ceres CLONE 1404708-F
  misc_feature: Encodes the peptide sequence at SEQ ID NO. 29628
aaagctggagctccccgcggtggcggccgctctagaactagtggatcccccgggctgcaggaattcgcacgagaccattacctagaacatcctaatcgaaaaacttccaccccggaccgacaaagcagagcacgcgctggcagccaagtgcacacagacacgtctctctgttcgttctcagcttgctatagcaacctctagtaggtagccatggagatggtcctggactggcgctcgctgggctccctgctggcgaccgtcgtggtgttccgcaccgcgctgcgtaacttcctgccgccggaggccgagatgctcctgcgccgcttcctcgcgtgggtcgccgccgcgttccgcccgcccagcgacaccatcctcatcgacgaggcggacgggcccacggggagcgccaacgacctctacgagtcggcgcagctctacctcagcgcgcgctgcctcgccaccgcgcccgccgtgcgcctgcacaagccgcgccagtcgccgcgccccgtggcgtcgctcccggactcgcacaccaccgacgacaccttccgcggggtccgcgtcaagtggacctccaccacgcgcaccgtcgaccgcagcggcagcggcggcggcggtaacccgtacaacatattcggccgcggcggcgaccagcgcggcctcgagc

SEQ ID NO: 29628 - protein, 152 aa, Zea mays
  misc_feature: Ceres CLONE 1404708-F
MEMVLDWRSLGSLLATVVVFRTALRNFLPPEAEMLLRRFLAWVAAAFRPPSDTILIDEADGPTGSANDLYESAQLYLSARCLATAPAVRLHKPRQSPRPVASLPDSHTTDDTFRGVRVKWTSTTRTVDRSGSGGGGNPYNIFGRGGDQRGLE

SEQ ID NO: 29629 - DNA, 674 bp, Zea mays
  misc_feature: Ceres CLONE 1404719-F
  misc_feature: Encodes the peptide sequence at SEQ ID NO. 29630
  misc_feature (483)..(483): n is a, c, t, g, unknown, or other
  misc_feature (601)..(601): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
tccccgcggtggcggccgctctagaactagtggatcccccgggctgcaggaattcgcacgagaccattacctagaacatcctaatcgaaaaaggccgcagctactccacggtgacggccgccatgagagccctcctctccctctcccgtctcgcccgacggcttccagcttctctcagccctgtaagggcgccgacaacattactcctccggcacatccatgcggatgcccctccgccgccgccatctcatgactcgacgcccttcgtctcccgcatcctcgaatcggagccgtgcctgaccccgaacgacgagtcggagccggcatccgatccgaccctcgacgagttcctcgcgcgcttcgtggctgccttccgcccgcgactggcggctgccttccccaaccatgaccgtgacgtgctcgacgagatgctccgcctcgtcgcggacgccgtgctgtgccgcctcaccgggaccgaccggnggggcgatgctattgagctcaatgacgacctctgggcggccggtatgggaggtcagcgcctccgtgcgcgagctatggccccgggatcaggtccgcgccgaccttcgccaatacttcnctgcgacgaggtgagaaaaaaaagaccccggtcccccctgtcgatgccnnnnaatccgcggttccattgctcc

SEQ ID NO: 29630 - protein, 184 aa, Zea mays
  misc_feature: Ceres CLONE 1404719-F
  misc_feature (121)..(121): Xaa is any aa, unknown, or other
  misc_feature (160)..(160): Xaa is any aa, unknown, or other
  misc_feature (177)..(177): Xaa is any aa, unknown, or other
MRALLSLSRLARRLPASLSPVRAPTTLLLRHIHADAPPPPPSHDSTPFVSRILESEPCLTPNDESEPASDPTLDEFLARFVAAFRPRLAAAFPNHDRDVLDEMLRLVADAVLCRLTGTDRXGDAIELNDDLWAAGMGGQRLRARAMAPGSGPRRPSPILXCDEVRKKRPRSPLSMPXNPRFHCS

SEQ ID NO: 29631 - DNA, 695 bp, Zea mays
  misc_feature: Ceres CLONE 1404724-F
  misc_feature: Encodes the peptide sequence at SEQ ID NO. 29632
  misc_feature (455)..(455): n is a, c, t, g, unknown, or other
cgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcggtggctggtgtgcggcgcccgagctgggcagcctcagccgcgacgagctggncgccaagtgggggggggggagggccacctacgacctcgccaccgtgctcgcctttcctcgccgtcctcgccttcaccatctccgttctacatcatgtccaggccccaaggcccgtgtaacctcttgggacttcgcatgctacaaggccggcgacgagaggctcaggtggtcccagagggggggagctcatcgacctgggggcgcaagatcccggaaaaggttccgacaggcacatgcctg

SEQ ID NO: 29632 - protein, 167 aa, Zea mays
  misc_feature: Ceres CLONE 1404724-F
  misc_feature: SWISSPROT Homolog: EC 2.3.1.119 Icosanoyl-CoA synthase
  misc_feature (88)..(88): Xaa is any aa, unknown, or other
MAREEQALLSTEIVNRGVEPSGPDAGSPAFSVRVRRRLPDFLQSVNLKYVRLGYHYLISHGVYLATIPVIGGWCAAPELGSLSRDELXAKWGGGRATYDLATVLAFPRRPRLHHLRSTSCPGPKARVTSWDFACYKAGDERLRWSQRGGAHRPGGARSRKRFRQAHA

SEQ ID NO: 29633 - DNA, 672 bp, Zea mays
  misc_feature: Ceres CLONE 1404725-F
  misc_feature: Encodes the peptide sequence at SEQ ID NO. 29634
  misc_feature (500)..(500): n is a, c, t, g, unknown, or other
  misc_feature (508)..(508): n is a, c, t, g, unknown, or other
  misc_feature (509)..(509): n is a, c, t, g, unknown, or other
  misc_feature (603)..(603): n is a, c, t, g, unknown, or other
  misc_feature (672)..(672): n is a, c, t, g, unknown, or other
aagctggagctccccgcggtggcggccgctctagaactagtggatcccccgggctgcaggaattcgcacgagaccattacctagaacatcctaatcgaaaagtcggaagctcccttcatttctttcacctccgattcgattccttgtcccctcttgatccgagccgccaccaaaccctaactatctaaaacccccgtctcgctgtccgatggccgccgcctcgccgttgccctccccaccccacgcaaagcgccccaagatgtcctcctcctccgacccggaagccgatgctgagcccacctcggcctccgccgccgttgagggcgccgatcctgcgcagcgtcgtcccaggtacaagcgccgcaaggtcgccatccttctcgggtactgcggcgcggggtatcagggcatgcagaagaatccgggcgcgcgcaccatcgagggggacctcgaggaggcgtcctaccaggcgggcgccgtgcccgaggccgaccggtcgncgccgcgnncgttacgattgggcacgtgctgcgcgcaccgacaagggcgtcagcgcccgcggcgcaggtggtgtccgggcgcttctacgtcgacccgccgggntttcatcgatcgctttgaacgcgcagcttcgcgccgcagatccgcgccctacggcttacgttgcgcgtn

SEQ ID NO: 29634 - protein, 154 aa, Zea mays
  misc_feature: Ceres CLONE 1404725-F
  misc_feature: SWISSPROT Homolog: EC 5.4.99.12 tRNA-pseudouridine synthase I
  misc_feature (98)..(98): Xaa is any aa, unknown, or other
  misc_feature (101)..(101): Xaa is any aa, unknown, or other
  misc_feature (132)..(132): Xaa is any aa, unknown, or other
MAAASPLPSPPHAKRPKMSSSSDPEADAEPTSASAAVEGADPAQRRPRYKRRKVAILLGYCGAGYQGMQKNPGARTIEGDLEEASYQAGAVPEADRSXPRXLRLGTCCAHRQGRQRPRRRWCPGASTSTRRXFIDRFERAASRRRSAPYGLRCA

SEQ ID NO: 29635 - DNA, 642 bp, Zea mays
  misc_feature: Ceres CLONE 1404727-F
  misc_feature: Encodes the peptide sequence at SEQ ID NO. 29636
  misc_feature (587)..(587): n is a, c, t, g, unknown, or other
  misc_feature (597)..(597): n is a, c, t, g, unknown, or other
aagctggagctccccgcggtggcggccgctctagaactagtggatcccccgggctgcaggaattcgcacgagaccattacctagaacatcctaatcgaaaaacaccttccctcggtcccttccatctcctagccgccgccgccgccgccgctgcccaaaaccctacctaccctcttcttcccctcactctcctttcatctccattctaatggcggcccaacccgtccggcgaagctgctagtgcttgtatctactatcttcatcaggtacttcgcgatcctactgaagtattccccgccgccgctgccatggccaccctcaaccctttcgaactccttggcgccgacgacaacgacgacccgacgcagctgattgcggcggcggcggctgctgctcagaaagccgagacgaagaagtccgccgtggcgcctgctgggaaggctgcccagcctgcggcgaccaccaagttcccgaccaagcccgctccctcctcgcagacgggtcgggatgcacgcggcggtggctcatcagctcgtggaggctttggccgtgtgaaacgtggcgtgtcaaagtggacggggaatggncagaacgtgnctcagtgtgacatggcatgactccaagaagttatggtggcgagct

SEQ ID NO: 29636 - protein, 102 aa, Zea mays
  misc_feature: Ceres CLONE 1404727-F
  misc_feature (97)..(97): Xaa is any aa, unknown, or other
MATLNPFELLGADDNDDPTQLIAAAAAAAQKAETKKSAVAPAGKAAQPAATTKFPTKPAPSSQTGRDARGGGSSARGGFGRVKRGVSKWTGNGQNVXQCDMA

SEQ ID NO: 29637 - DNA, 660 bp, Zea mays
  misc_feature: Ceres CLONE 1404731-F
  misc_feature: Encodes the peptide sequence at SEQ ID NO. 29638
  misc_feature (440)..(440): n is a, c, t, g, unknown, or other
  misc_feature (450)..(450): n is a, c, t, g, unknown, or other
  misc_feature (475)..(475): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
ggagctccccgcggtggcggccgctctagaactagtggatcccccgggctgcaggaattcgcacgagaccattacctagaacatcctaatcgaaaaaacagcacgctctccctctccccgacggctgctagctagcgacaacagatcgacggctacaccgatgggcgaggccaacgccacaggcacgccagccaccgcgacggtgcgcgtgctggccgtgtcgcgcgtcgcgccggcgccggcgccggcagcggcggaccccgtcgtcgtcaagctgtccttcttcgacacgccctgggtcgtgctgccgcccatccagcgggtgttcctgtacgagctgcctggtggcgacggtgagttcacggcggcagtgacgcgcctcaagagctccctcgccgccacggctggcggtgaacctgccgctgcccgggagcctgggntagtcgccgnaaccgggggaaccgtgctcgtggcntgcgtcacgaatcccccggggtgggcattcgtccagggcgcaggtgggacgcctgtatcgcnnncccatgaacagttcgccagtctgcaggagcgacgttgtctgcttaaatccccggtgttcctagcggctgcaaaccgtgtctccacaactatgtgatacccggacgcctggttcatgttcta

SEQ ID NO: 29638 - protein, 157 aa, Zea mays
  misc_feature: Ceres CLONE 1404731-F
  misc_feature (94)..(94): Xaa is any aa, unknown, or other
  misc_feature (97)..(97): Xaa is any aa, unknown, or other
  misc_feature (126)..(126): Xaa is any aa, unknown, or other
  misc_feature (127)..(127): Xaa is any aa, unknown, or other
MGEANATGTPATATVRVLAVSRVAPAPAPAAADPVVVKLSFFDTPWVVLPPIQRVFLYELPGGDGEFTAAVTRLKSSLAATAGGEPAAAREPGXVAXTGGTVLVACVTNPPGWAFVQGAGGTPVSXXHEQFASLQERRCLLKSPVFLAAANRVSTTM

SEQ ID NO: 29639 - DNA, 643 bp, Zea mays
  misc_feature: Ceres CLONE 1404735-F
  misc_feature: Encodes the peptide sequence at SEQ ID NO. 29640
ctggagctccccgcggtggcggccgctctagaactagtggatcccccgggctgcaggaattcgcacgagaccattacctagaacatcctaatcgaaaaatgaccgactagcccatggtctctctccgctccgacgcgcccgacccaccaccacatccctcatggctgccctcgccgacatcgactcctcggcacttccgccgtccgagtcatccaaaggcaagggcaagatggacaaggaggaggaggacgaggcgaagggcgcggagaagatgtgcggcatctgctatctcgacggccggcgggccatccgcggcgagctcgactgctgcgcccatttcttttgctttgtctgcatcatggcttggggccgcgtcgagtcccgctgtcccttctgcagggcccgcttcacaccatccgccgcccgcccgtcgcccggcggttccccgacgagcgaatcgtctcgatccaagagcgcaaccaggtacacatcctcagggcaacgggagcagcatagtgggcggagatccttacgtgaacaccatatgcaccgtttgcagcagctccggcgatgactagctgctgctactctgcgagctctgcgactcagctggacacacttacggggtcggggctggggacac

SEQ ID NO: 29640 - protein, 137 aa, Zea mays
  misc_feature: Ceres CLONE 1404735-F
MAALADIDSSALPPSESSKGKGKMDKEEEDEAKGAEKMCGICYLDGRRAIRGELDCCAHFFCFVCIMAWGRVESRCPFCRARFTPSAARPSPGGSPTSESSRSKSATRYTSSGQREQHSGRRSLREHHMHRLQQLRR

SEQ ID NO: 29641 - DNA, 711 bp, Zea mays
  misc_feature: Ceres CLONE 1404739-F
  misc_feature: Encodes the peptide sequence at SEQ ID NO. 29642
cgcggtggcggccgctctagaactagtggatcccccgggctgcaggaattcgcacgagaccattacctagaacatcctaatcgaaaaacaccaaagatttcctcttccgcgtgcgcttccctttgccccgctctcccccagcctcgctcgccatataatacgggccggccggccggccagctgggtccccgcggatgggctcggtctcgcgaggctagggtttggtcggtcgtctcgccggcgtcgaggccgccagcgctgctagctagctctctcgcgttagggttccccgtagccatggtgctgcagcgcttctcgtggccgtacggcggccggagcgccaccttctgcggtagcttcaccgggtgggagagagtgccccatgggggctgggtcgggggcccgggttccaggtcggtcttcgatcggcccccccggagtttaccagtacccggtttttggggttgaatgggggccggaagggggggatgaaacaaaaaccctttgtacggggatgaatatggactgatcccgcaaggaaaggggtttgtggaaaaacaatgaaccaacccgggtgggcagccaggagcccttttatcagaggaactattattgggataagggtacccatttttgaaaaacaaggcccccggaagccatctatcctcagaaccccaagatggcaaataagcagtattccccccttgtggg

SEQ ID NO: 29642 - protein, 56 aa, Zea mays
  misc_feature: Ceres CLONE 1404739-F
MVLQRFSWPYGGRSATFCGSFTGWERVPHGGWVGGPGSRSVFDRPPRSLPVPGFWG

SEQ ID NO: 29643 - DNA, 678 bp, Zea mays
  misc_feature: Ceres CLONE 1404740-F
  misc_feature: Encodes the peptide sequence at SEQ ID NO. 29644
  misc_feature (599)..(599): n is a, c, t, g, unknown, or other
  misc_feature (602)..(602): n is a, c, t, g, unknown, or other
  misc_feature (621)..(621): n is a, c, t, g, unknown, or other
  misc_feature (645)..(645): n is a, c, t, g, unknown, or other
  misc_feature (673)..(673): n is a, c, t, g, unknown, or other
tggagctccccgcggtggcggccgctctagaactagtggatcccccgggctgcaggaattcgcacgagaccattacctagaacatcctaatagaaaaactgccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatctagatggtggcgcgctccgtgctccccaggttctacgcgggcgacgtgcacccggagagctggagggtgttcagctccttcggcaggcgctacgtcgtcacggccagccccagggtcatggtcgagcccttttcgcagggcttnccntagcgcgacaaggtcgtcnggaccgagctggagggtcgcaggnacggcaaggcacgggcttcatgggcagncaggg

SEQ ID NO: 29644 - protein, 93 aa, Zea mays; identical to SEQ ID NO: 24566
  misc_feature: Ceres CLONE 1404740-F
  misc_feature: SWISSPROT Homolog: EC 2.3.1.15 Glycerol-3-phosphate O-acyltransferase

SEQ ID NO: 29645 - DNA, 700 bp, Zea mays
  misc_feature: Ceres CLONE 1404742-F
  misc_feature: Encodes the peptide sequence at SEQ ID NO. 29646
  misc_feature (211)..(211): n is a, c, t, g, unknown, or other
  misc_feature (214)..(214): n is a, c, t, g, unknown, or other
  misc_feature (220)..(220): n is a, c, t, g, unknown, or other
  misc_feature (235)..(235): n is a, c, t, g, unknown, or other
cgcggtggcggccgctctagaactagtggatcccccgggctgcaggaattcgcacgagaccattacctagaacatcctaatcgaaaaccggaatggtatcgtgcgacctgtagtcgtcgccagccacctcgctccctcctagacgacacccagctagtgctcccttccacacccaggaaccagccacctaaccccgcccgccatgccgggnccntttcgnccgcctccgacaacntcgcccccggcgccggcgccgccgccgcgccggctctcgtcgccgctaccccgtcgcgcgccgtcgtccccgtcgcctgccgcctcctcgtgcggcaagcctcggaaggccctcgccctccccccgcgcacttccccaccggacgtcgacgacttcgctcgacaaacccggatctggggggaccttcctccctcaaagaaggcgcgacgacccccttggccaacaaccccaaggccccgaggcccacccaccagtgaacaaccccgcgtggcgtagatggtggccctcaagcgtccccccctacaagaagcgggggggggggcggaccaacgctttccacccccccacccctcacctcccgcgccatgatttacacacacacccccacgcgcgcggggagggacacgtccgcagtcgactaaaatccgtcaaactatcactactttttaatcagcctaggcggag

SEQ ID NO: 29646 - protein, 102 aa, Zea mays
  misc_feature: Ceres CLONE 1404742-F
MPGPFRPPPTTSPPAPAPPPRRLSSPLPRRAPSSPSPAASSCGKPRKALALPPRTSPPDVDDFARQTRIWGDLPPSKKARRPPWPTTPRPRGPPTSEQPRVA

SEQ ID NO: 29647 - DNA, 684 bp, Zea mays
  misc_feature: Ceres CLONE 1404752-F
  misc_feature: Encodes the peptide sequence at SEQ ID NO. 29648
  misc_feature (599)..(599): n is a, c, t, g, unknown, or other
  misc_feature (643)..(643): n is a, c, t, g, unknown, or other
cgcggtggcggccgctctagaactagtggatcccccgggctgcaggaattcgcacgagaccattacctagaacatcctaatcgaaaaacaccccggtcggctagtcccaaggctgctgccgccgcctgctgctaggggatcgcttgctttcctcggaccactctgccgaccacatctacaccgcatcaacggtccttccaagtgagctccaatcccctgtctgtagatggagagggtgctcaaggatgacgccgtcgaggagaagggcgagcgcgccaggatggcatcgtttgttggggccatggcaatctcggatttggtgaagaccacattgggcccaaaaggaatggacaagatcctgcaatcaactggcagaggacgtaatgttactgttacaaatgatggggctaccattttgaagtcacttcacattgacaatcctgctgcaaaggtccttgttgacatctcaaaagttcaagatgatgaagtttggtgatggacaactttcccggttggtgttctagctggagaactttttgagaagggctggagaagttaattaacatgaaaattcatccagtgactatttattgcagggntacagatgggcttctcgagtgtgcccagaagattctttgctaanaaaagacatggacaacaagaaatacggaataatttcagatc

SEQ ID NO: 29648 - protein, 89 aa, Zea mays
  misc_feature: Ceres CLONE 1404752-F
MERVLKDDAVEEKGERARMASFVGAMAISDLVKTTLGPKGMDKILQSTGRGRNVTVTNDGATILKSLHIDNPAAKVLVDISKVQDDEVW

SEQ ID NO: 29649 - DNA, 731 bp, Zea mays
  misc_feature: Ceres CLONE 1404753-F
  misc_feature: Encodes the peptide sequence at SEQ ID NO. 29650
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (691)..(691): n is a, c, t, g, unknown, or other
  misc_feature (699)..(699): n is a, c, t, g, unknown, or other
aaagctggagctccccgcggtggcggccgctctagaactagtggatcccccgggctgcaggaattcgcacgagaccattacctagaacatcctaatcgaaacaccaccacacaagaagaggcccccagccagccagtccacagctctccactcgagaaacctccagtccagctccacccttcgtccagaggcacaccacacacaccatggctcccagcaagcttgcggtggtcgtcgccttgatagcgtcgctcctcctgctcaccaccagcaacaccaagcttggcctgttcgtgctcggccaggctgctccgggcgcctacccaccacgggctcctccgccgcaccagatcgtcgaccccgccaaagactgcgggggcgcgtgcgacgtgcggtgcggcgcgcactcgcgcaagaacatctgcacccgggcgtgcctcaagtgctgcggcgtctgccgctgcgtgccggcgggcacggccggcaaccagcagacctgcggcaagtgctacaccgactggaccacgcacggcaacaagaccaagtgcccgtgactccttgtccttgatgagagcagatgccctttgnnnnnnnnngggggccgccccactgcccacactgggcgcgcacggttttgtatgatccgaccccgtccggcgtagatgtgcgagcctgtagctatttagctaanatgtaccnaggttgatgggctccggctgtttgtttggtgc

SEQ ID NO: 29650 - protein, 115 aa, Zea mays
  misc_feature: Ceres CLONE 1404753-F
  misc_feature (4)..(115): Pfam Name: GASA Pfam Description: Gibberellin regulated protein
MAPSKLAVVVALIASLLLLTTSNTKLGLFVLGQAAPGAYPPRAPPPHQIVDPAKDCGGACDVRCGAHSRKNICTRACLKCCGVCRCVPAGTAGNQQTCGKCYTDWTTHGNKTKCP

SEQ ID NO: 29651 - DNA, 738 bp, Zea mays
  misc_feature: Ceres CLONE 1404754-F
  misc_feature: Encodes the peptide sequence at SEQ ID NO. 29652
tcaccgcggtggcggccgctctagaactagtggatcccccgggctgcaggaattcgcacgagaccattacctagaacatcctaatcgaaaaagcaaatcactacacacaccttgtctctaatcagatatcaaagaagtagccattaagttaacgatggcttccgccgacctcgcagaggccatcgagcccagcaggaagaagaagagcaacgtcaagtatgcctccatctgcgccatcctcgcctccatggcctccgtcatccttggctacgatattggggtgatgagcggagcggccatgtacatcaagaaggacctgaagatcacggacgtgcagctggagatcctgatagggatcctcagcctctactcgctcatcgggtccttcgcgggcgcgcggacgtccgacaggatcggccgccgcctgactgtcgtcttcgccgccgtcatcttcttcgcgggcgcgctgctcatgggtttcgccgtcaactactccatgctcatggtgggccgcttcgtggccggagttggcgtgggctacgggggcatgatcgcgcccgtgtacacggccgagatctcgccggcggcgtcccgcggcttctcacgtccttcccggaagtgttcatcaacgtcggcatcctgctcggctacctgtcgaactttgcgtttgcgcgcctaccgctccggctcggttggggcgtcatgctcggcatcgggggggggccgggccggcctgtt

SEQ ID NO: 29652 - protein, 194 aa, Zea mays
  misc_feature: Ceres CLONE 1404754-F
MASADLAEAIEPSRKKKSNVKYASICAILASMASVILGYDIGVMSGAAMYIKKDLKITDVQLEILIGILSLYSLIGSFAGARTSDRIGRRLTVVFAAVIFFAGALLMGFAVNYSMLMVGRFVAGVGVGYGGMIAPVYTAEISPAASRGFSRPSRKCSSTSASCSATCRTLRLRAYRSGSVGASCSASGGGRAGL

SEQ ID NO: 29653 - DNA, 701 bp, Zea mays
  misc_feature: Ceres CLONE 1404755-F
  misc_feature (359)..(359): n is a, c, t, g, unknown, or other
  misc_feature (425)..(425): n is a, c, t, g, unknown, or other
  misc_feature (426)..(426): n is a, c, t, g, unknown, or other
  misc_feature (432)..(432): n is a, c, t, g, unknown, or other
  misc_feature (472)..(472): n is a, c, t, g, unknown, or other
  misc_feature (473)..(473): n is a, c, t, g, unknown, or other
  misc_feature (476)..(476): n is a, c, t, g, unknown, or other
  misc_feature (482)..(482): n is a, c, t, g, unknown, or other
  misc_feature (508)..(508): n is a, c, t, g, unknown, or other
  misc_feature (558)..(558): n is a, c, t, g, unknown, or other
  misc_feature (608)..(608): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
ggagctccccgcggtggcggccgctctagaactagtggatcccccgggctgcaggaattcgcacgagaccattacctagaacatcctaatcgaaaactgctagtgctcagtcctcgccctctcgctttccgagggagcctttgcctttcccctccgcccgccagccattaatggcggcggcatctccatccactcccccctcgcccccctcccactgctgctacttctagaagcgctggtggcagggcaggcggtatcccggccgctggcgctggcgcgagagttggttgggtggtggtgttcagcccccctccctcttcaggtttaggggtggagcgatccgtgcaggccaacgcggngtgcgtgacccagaaagggaaccgccgccttttttctcttctgccgccccgctttttccatccctnnctcaanctcattccggcccgccgcacattcaccaaaaagtccccgnnctnctcttncctctctcctctgcccctggcttgtncgttggctcgtgctcccccaccccctttctgatattcagcaggtttcttncccgcggggcgggcgtcgcatggggaaaaatggtgggggggggcaaaaanagtttcgaggcctccgggcgcctcccgtaaagacggggtcagtgnnnaaaaaaaaaaaaaaaaaggcgcgaaaaccccctggagggtgcacaa

SEQ ID NO: 29654 - DNA, 669 bp, Zea mays
  misc_feature: Ceres CLONE 1404757-F
  misc_feature: Translation starting site: 215
  misc_feature (466)..(466): n is a, c, t, g, unknown, or other
tggagctccccgcggtggcggccgctctagaactagtggatcccccgggctgcaggaattcgcacgagaccattacctagaacatcctaatcgaaaaatctcctttctctctctacacatactcagacgagcagaagcagctagggacaccataggcaaactacttcagcaagaaattaaactatctcctacgcacgatcagaagaaactgtgtatggagcaagaagaggttggcctcgccctgggcctctccctcgggtccggccaccaccaccaggagctcaggccccaacatccgtcgcatccgtgtgcggcgttgttggatgcttctctgtcgctcagcggtccggtgaccaaggatgatggatccgaccgcaccggtaaggaggttcgctgccgtcgagagcgagctgcagacgatggaggggtacgacgactaggccaccgggaggtacttgctaccccngggggcgtcgtacggagctgtctactggcgagcactagaaaggtcgcaacagcagcgataagaagctgatgctgtccaaggacccagcggtgctgctggaggactccttcagggagcacagccccctcaacccgtagcaggacgctggctttgggcaggagactggaactgagccaaaggcaagggggagggtttgttgccaa

SEQ ID NO: 29655 - DNA, 622 bp, Zea mays
  misc_feature: Ceres CLONE 1404758-F
  misc_feature (354)..(354): n is a, c, t, g, unknown, or other
  misc_feature (382)..(382): n is a, c, t, g, unknown, or other
  misc_feature (399)..(399): n is a, c, t, g, unknown, or other
  misc_feature (407)..(407): n is a, c, t, g, unknown, or other
  misc_feature (412)..(412): n is a, c, t, g, unknown, or other
  misc_feature (413)..(413): n is a, c, t, g, unknown, or other
  misc_feature (434)..(434): n is a, c, t, g, unknown, or other
  misc_feature (435)..(435): n is a, c, t, g, unknown, or other
  misc_feature (491)..(491): n is a, c, t, g, unknown, or other
  misc_feature (492)..(492): n is a, c, t, g, unknown, or other
  misc_feature (526)..(526): n is a, c, t, g, unknown, or other
  misc_feature (561)..(561): n is a, c, t, g, unknown, or other
  misc_feature (562)..(562): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (594)..(594): n is a, c, t, g, unknown, or other
  misc_feature (595)..(595): n is a, c, t, g, unknown, or other
  misc_feature (597)..(597): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (621)..(621): n is a, c, t, g, unknown, or other
tggagctccccgcggtggcggccgctctagaactagtggatcccccgggctgcaggaattcgcacgagaccattacctagaacatcctaatcgaaaagttcccctttccctcctgcgcacccgtcttctcctccccgcgtcaaaccccagcacaaaaagcaaccgcccgccgcctcctcgctcctctcccgaatcagccgtcgcggtgcctaatccggccgatcccccctccgatccgcgggtgcccgccgcagaggcggcgcctccgggcctcccccgatgtatagcaacttcaaggagcaggcgatcgagtacgtcaagcaggcggtccaggaggacaatgccggcaataancgtcaaggcgttccctctctacatgaancgcgctcgagtacttcnaaacccanctcanngtacgagaagaaacccaaggnnatcagggagggccattcaccggccaagttcccccgggaaaacccccccccgggggnnggaaaaaagaaaaaaaaatacggggggggggggncgcccctccacaaaaaaggaggggagggggggggnngnnnnnnnnnnnnnnnnggggggtgggtgtcnncncccnnnnnnnnnnnccgcggaggna

SEQ ID NO: 29656 - DNA, 705 bp, Zea mays
  misc_feature: Ceres CLONE 1404761-F
  misc_feature: Translation starting site: 178
  misc_feature (350)..(350): n is a, c, t, g, unknown, or other
  misc_feature (380)..(380): n is a, c, t, g, unknown, or other
tccccgcggtggcggccgctctagaactagtggatcccccgggctgcaggaattcgcacgagaccattacctagaacatcctaatcgaaaacccttttttcctgcgaccaatccgcgcgcttttgtttttgttcctgctcctcggccctcgcaccgcgcgccgccgacgccgcatccatgaacggtgacggcagcaaggaggacgccaacaggcgcctcgagtgggccaccttgaacatggagcgcgccgtcgtcgtgagcgagacgacgaagggcgacggcaatggcaatgcaggccggaaggcgccgataagcatcgtccggctcttcttggcctgcatggtctccgncggctccaagtacgggctgggcgctgcagntctccctcctctcgccaactctcagaattcttgggatctcgcacagctacgtgtctctgacatggaatctgcggcctaatcccccggaattggtggtgcaacccatcgtgggctactacgggggacgggaccctccaaaaaaggggccccggaggaggcctcccctccccccgggagggacatctccggccccccggggggggggggaaaggggttccccggggggaattgggggggggccccgggagacccaggggaacgggggaaaatttcccgggtcccccgtggccccccgccccccctaaaatgttggggaatttttggg

SEQ ID NO: 29657 - DNA, 697 bp, Zea mays
  misc_feature: Ceres CLONE 1404768-F
  misc_feature: Translation starting site: 293
  misc_feature: SWISSPROT Homolog: EC 2.7.11.1 Non-specific serine/threonine protein kinase
  misc_feature (549)..(549): n is a, c, t, g, unknown, or other
  misc_feature (550)..(550): n is a, c, t, g, unknown, or other
  misc_feature (655)..(655): n is a, c, t, g, unknown, or other
  misc_feature (692)..(692): n is a, c, t, g, unknown, or other
  misc_feature (697)..(697): n is a, c, t, g, unknown, or other
ggagctccccgcggtggcggccgctctagaactagtggatcccccgggctgcaggaattcgcacgagaccattacctagaacatcctaatcgaaaagacatcagacatcaccaactcgtcgacggtagagagagcaagctcttcggcgatttgagaagaatcgaggagcgagcgagcggagcgagcgagagaggaggaggaggagctggggcttgagcctgcgcccgggggccccgggtcacggaatcctaccattaccaaccctagccttcgttgatcgccgtctcaggtcatggcagggccggcgccggatcgggccgccctgactgtggggccgggcatggacatgccaatcatgcacgacagcgaccggtacgagctcgtgcgcgatatcggctccggcaacttcgcgttgcccgcctcatgcgcgaccgccgcaccagcgaactcgtcgccgtcaagtacatcgagcgcggcgagaagaaggatgagaatgtccagcgtgagataattaaccatagatcattgaagcacctaacattattaggnntttaaggaggttattttaacaccgacccatcttgctattgtcatggaaatgcccttctgggcggtgagctttttgagaggatattgtaagacgggtgcgatcccnggggaagatgaggctcgctacttcttccagcagcttnatttn

SEQ ID NO: 29658 - DNA, 661 bp, Zea mays
  misc_feature: Ceres CLONE 1404771-F
aaagctggagctccccgcggtggcggccgctctagaactagtggatcccccgggctgcaggaattcgcacgagaccattacctagaacatcctaatcgaaaagattcaaaccgtcgccgccgtcgccgagagagttgtgactcccccagcggcggcctgcgaccgcccgttccccagtcgtctcttctctccggaccgcatttgcgcccgtcccgtcccctcccctctccctcggcgaggtccgagagcagagctgcctcgggagggtcgtagtccagtccacccgtccgctgcggcggcggttacgaggcggggaattccggcgcgggttgccgcgatccccgcagtgatgtgcggatcgggtcatgggtgtgacccagccgggaagtagtggaggctgctggaggactagggccgggactgggagctgcggccacgacgatgtacgtcgccccgggagtctaccaagctgtggaaggagggtgtgcgcggaagacgacagcggagcttgcaggtttctgttcgagaagtggccaattgctccctggcagcgggtgggtgattccaacaccaaatccttggcaatgggccggctctgccgaatcccgcattaacttgccctttctggtccgcggatacctgtgccccctccgccctattt

SEQ ID NO: 29659 - DNA, 956 bp, Zea mays
  misc_feature: Ceres CLONE 1404775-F
  misc_feature (875)..(875): n is a, c, t, g, unknown, or other
ttccccccctctcccccccccccctttcttttttattaggagggaaaaaacaaagctggcgctccaccgcggtggcggccgctctactactagtggatcccccgggctgcaggaattcgcacgagaccattacctagaacatcctaatccaaaaagagcagagcaagaagctttgcagtgaacgagtgagtatgtgcggcatacttgttgtgctcggctgcgccgatgaggcccatggcaccagccagaggcgccgggtgcgggaactgaggaggggcttgaagaaccgggcacccgactgcagcgacccccgccaccccctcattctgcaaactatccttcctttcgcctccccatctgcgtccccggtcatttggttgtaatatcgccctctaagacaaatgcagtagagatcgagcgcatgccacacgatccatcgccaaagcagattacactccaccttgacccctcacaatagcgcacacgtgtcgccgggcacattccccacccccacccgctccccgtctaattcacacacaacaattgcggccacgtgctctctaagtcgtattaccctcaccccacccccaccacccccccccgcccagcaacccccccaccgattgcgattcgacccgtataggggagcccccccttcccgcgtgcccaccaccgcgatgcaacgacacatatttccgcccgctaagccacacccgccccataacagatctcgccaccccgccccccgccccactgccgccctcacacacacacgccctaccgcgacacccgcccccaccccccctctcctctccctccagaaccattgttacgcgctacccccgcgtatagcggttcctggttgccgcgcccantattagctatattttgtggtgcgtaggaaaatagtatacccacccaccccgcttttgaccttgtcgtcgacaggtgttccc

SEQ ID NO: 29660 - DNA, 676 bp, Zea mays
  misc_feature: Ceres CLONE 1404777-F
  misc_feature: Encodes the peptide sequence at SEQ ID NO. 29661
  misc_feature (389)..(389): n is a, c, t, g, unknown, or other
  misc_feature (416)..(416): n is a, c, t, g, unknown, or other
  misc_feature (444)..(444): n is a, c, t, g, unknown, or other
  misc_feature (445)..(445): n is a, c, t, g, unknown, or other
  misc_feature (447)..(447): n is a, c, t, g, unknown, or other
  misc_feature (449)..(449): n is a, c, t, g, unknown, or other
  misc_feature (462)..(462): n is a, c, t, g, unknown, or other
  misc_feature (463)..(463): n is a, c, t, g, unknown, or other
  misc_feature (468)..(468): n is a, c, t, g, unknown, or other
  misc_feature (482)..(482): n is a, c, t, g, unknown, or other
  misc_feature (515)..(515): n is a, c, t, g, unknown, or other
aagctggagctccccgcggtggcggccgctctagaactagtggatcccccgggctgcaggaattcgcacgagaccattacctagaacatcctaatcgaaaagatccgccactacgccacaaaatcctctcctactccggcagttctgctcgccgccgcctccacgatgacggaagacgtgcagatgaacgactcggagccccagcctgcggcctcagctcccgccgtcggggcgccggcgctctccacactacaccatctgaaggagatcgcgtccgtgatcgaggccggttctctgtccaaggaggtccgccggatctcccgcgccttccgcctcaccgtcgcgctccgtcgccgcctcgccgcgcgggacgtctcccgcttcctcgncttcgcgctacccgcgtcctccgaagnctacggacgcctcactgccctggtgccnnangnagatgatactgannatggnatgtgatgctgcanctccagcaactcagattttcaatcaacatgggnctccctgagaatgaaataatatgctacttggctcgaactgatttttcctaaatgatcctaaaaaaaattgatggaggctaagggatggcccaggggggaccattgctcgccctgaagatctaaaccggaaaaattggtgaatgtttttggaatccccaact

SEQ ID NO: 29661 - protein, 102 aa, Zea mays
  misc_feature: Ceres CLONE 1404777-F
  misc_feature (75)..(75): Xaa is any aa, unknown, or other
  misc_feature (84)..(84): Xaa is any aa, unknown, or other
  misc_feature (94)..(94): Xaa is any aa, unknown, or other
  misc_feature (95)..(95): Xaa is any aa, unknown, or other
  misc_feature (99)..(99): Xaa is any aa, unknown, or other
  misc_feature (100)..(100): Xaa is any aa, unknown, or other
MTEDVQMNDSEPQPAASAPAVGAPALSTLHHLKEIASVIEAGSLSKEVRRISRAFRLTVALRRRLAARDVSRFLXFALPASSEXYGRLTALVPXXDDTXXGM

SEQ ID NO: 29662 - DNA, 670 bp, Zea mays
  misc_feature: Ceres CLONE 1404779-F
  misc_feature: Encodes the peptide sequence at SEQ ID NO. 29663
  misc_feature (321)..(321): n is a, c, t, g, unknown, or other
  misc_feature (337)..(337): n is a, c, t, g, unknown, or other
  misc_feature (449)..(449): n is a, c, t, g, unknown, or other
  misc_feature (543)..(543): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
tggagctccccgcggtggcggccgctctagaactagtggatcccccgggctgcaggaattcgcacgagaccattacctagaacatcctaatcgaaaagcgccgtccttccccttctccttgcgcaggttcaggcctgaccgcctgagaaactggaaggtggcggcgacctcgggggttgatcggcgacttgggtcggattagtttccggaagagcactggaggagaaggcctgtttggagcaaatttcgatggcaaccggcgagaccgccgtggatcgtcgcaaggaccctctcggcccccgcgacatggatttgtcaggngaggagcacgtccccnaggcgcggaagccgtacacgatcacgaagcagcgggagaagtggacggaggacgagcaccggcggttcctggaggccctgcagctgcacggtcgcgcctgggcgcacatacnagagcacatcggcaccaagactgccgtgcaaatccggagccacgcgcagaagttcttcaccaaggttgtccgagagtcatcgtcaggatgtacngcctctgcgggcgccgcgccggcgatccaggtccccgccgcccgcgcccaagaggaagccgcgcacctacccgnnnaaagggggggagacggcgcggccaagaatccccgcgccggagctcaagctg

SEQ ID NO: 29663 - protein, 140 aa, Zea mays
  misc_feature: Ceres CLONE 1404779-F
  misc_feature (41)..(86): Pfam Name: Myb_DNA-binding Pfam Description: Myb-like DNA-binding domain
  misc_feature (30)..(30): Xaa is any aa, unknown, or other
  misc_feature (67)..(67): Xaa is any aa, unknown, or other
  misc_feature (123)..(123): Xaa is any aa, unknown, or other
  misc_feature (124)..(124): Xaa is any aa, unknown, or other
MATGETAVDRRKDPLGPRDMDLSGEEHVPXARKPYTITKQREKWTEDEHRRFLEALQLHGRAWAHIXEHIGTKTAVQIRSHAQKFFTKVVRESSSGCTASAGAAPAIQVPAARAQEEAAHLPXXRGGDGAAKNPRAGAQA

SEQ ID NO: 29664 - DNA, 687 bp, Zea mays
  misc_feature: Ceres CLONE 1404781-F
  misc_feature: Encodes the peptide sequence at SEQ ID NO. 29665
agagctggagctccccgcggtggcggccgctctagaactagtggatcccccgggctgcaggaattcgcacgagaccattacctagaacatcctaatcgaaaagaatcgttattatcagtgggctagaacatactaatgcgagtgctgtgctgctaaatctaatctgcgtgcgattggtcgatgggcaggttcggtggagatcgccgccgttggcgtttcgatcgccatatttaaccaagtctccaaggtctgcatctaccctctcgttagcgtcacaacgtcgttcgtcgcggaggaagacgcgatcatcagtaaggccgtccgaggaaacagcagccaggaggaggacgtggagaaagcctcccacgtgggctttgatccggagaccagcaatctgcatgcatctggccctgcaggtatggcagaatgcgtgaactcgtgtatccctacggagtgcgcagcagatccctctggcaggcaagggcggtgcgagaagaggtacgtgccgtcggtcacgtcggcgctaatagtcggttccattctcggcctgcttcaggccgtcttcctgggcctttcggcccgattcgtgctcaccatcatgggcggtaagtcccgatcccccgatgaaagggtctggggaagtgctacccaaccgtaagggccccccccgcttcggttgcagcccct

SEQ ID NO: 29665 - protein, 79 aa, Zea mays
  misc_feature: Ceres CLONE 1404781-F
MAECVNSCIPTECAADPSGRQGRCEKRYVPSVTSALIVGSILGLLQAVFLGLSARFVLTIMGGKSRSPDERVWGSATQP

SEQ ID NO: 29666 - DNA, 671 bp, Zea mays
  misc_feature: Ceres CLONE 1404782-F
  misc_feature: Encodes the peptide sequence at SEQ ID NO. 29667
  misc_feature (530)..(530): n is a, c, t, g, unknown, or other
  misc_feature (536)..(536): n is a, c, t, g, unknown, or other
aagctggagctccccgcggtggcggccgctctagaactagtggatcccccgggctgcaggaattcgcacgagaccattacctagaacatcctaatcaaaaagaggcaaagccgttagccaatctgctgttgcgtgttgcaccgatcaacgtcggttcccagcgcttgctcgtcaagcgtgtcctgctgctgttctctgctcctgcttgccgcgagagctcctctcgctcatctacccaaggtccgacagcaacgacttcgtcgagctgctatgggagaacggccaggcggtggtgcacgggaggaggaagcagcatccccaggccgccttcccgcccttcacctgcggcgcggccagcagcagtagagctcaagaaaaccagccgggtactaccgacccgggtctcgctgttcaagacgggaggcctcttcgccgacttctcgtccggctagacgccgcccgtggcaacggtgaccttgacgacaccgtgccctggaccactgccccatcgtcgaggaagacaggggcgnaaccgnactgcccttggggaggctacagcccagatttcttctcggagctcatggacggcgttaaccacggcgggcggaaaaaagaaactcagccctctggcaccaccggtcagaaaaaaaaaaaccccccggtggcaccac

SEQ ID NO: 29667 - protein, 30 aa, Zea mays
  misc_feature: Ceres CLONE 1404782-F
MDGVNHGGRKKETQPSGTTGQKKKNPPVAP

SEQ ID NO: 29668 - DNA, 656 bp, Zea mays
  misc_feature: Ceres CLONE 1404785-R
  misc_feature (536)..(536): n is a, c, t, g, unknown, or other
caattgggtaccgggccccccctcgaggtcgacggtatcgataagcttttttttttttttctttcttttttttttaaccgcaaatgcgatcctactaacgtgtattgccgaaacatattacacacatccacatatatacatgcattgtccgacatcaaccaaggcatatgtattataaactataaattaatcaacctgaacgggatcatatctgagttgtgcatgcatgtggttcgcccgactggcgttgtatcggacacgcggtgagcgatggatggcgtcgacgactagggtgtcgtggatggggcttcgcagatccgacgaagtgagacatgtagacggttgaattgcgcagatcgacggtacaacctgggctgtcccaaacaccattgcgacggcgcggttgggggctacgcagatccggtgaagcacgcagtgcggaggggatccggggccgctgttttggatcgacactgctgcgcagcgaagttggacgccaaggccgcgagcaggggcttcttgctgctgcacaaggngaaaaaaaggggggggggggcgagcagagctgctgctcggccatggagatgactggaaaaaatctaggcgccatttgggagctgctagcgtcttggacagaggcaggggcggcctaaatg

SEQ ID NO: 29669 - DNA, 688 bp, Zea mays
  misc_feature: Ceres CLONE 1404787-F
  misc_feature (475)..(475): n is a, c, t, g, unknown, or other
aaagctggagctccccgcggtggcggccgctctagaactagtggatcccccgggctgcaggaattcgcacgagaccattacctagaacatcctaatcgaaaagcgtttctttaccctaagcttttagctggtccaacgaaaggcacacagcccgacagccgccgctgtttcttcatcttcctcgcagcgccggcgctccttcttccgctccctctccgattcgcgctcggcacgcaggcgacggcggcggcgctcgtgctcgggctctcagcgacggcgggcagtcccagactcggtgtcggcgtcagcggtcccccttccgcctgtcaccaatcgcctcgcgccctcgcctccggtcctccgcacaccgaccggcgccctgcgtgcacgcctcccgctcccctcctgcctccggtggaccgtcgacggcgctcggacccggaggctgcactgcgcgccgcgtgcgaccggcggncagcgggagccagcagccgcgccgctttggtagcgcttatacccccaaatgaatccttaccgtccgcttagctcttcagcgcgctgaagcgtgcgcttagtgccgatttttggaaacctgaatgttgagtgttttgacataggaactgggaaatggggaaaccctattgcaatgatatatttttttctcggggatggctggaaacctgaataa

SEQ ID NO: 29670 - DNA, 654 bp, Zea mays
  misc_feature: Ceres CLONE 1404788-F
  misc_feature: Encodes the peptide sequence at SEQ ID NO. 29671
  misc_feature (523)..(523): n is a, c, t, g, unknown, or other
tggagctccccgcggtggcggccgctctagaactagtggatcccccgggctgcaggaattcgcacgagaccattacctagaacatcctaatcgaaaaagaacttccagcatcctatcagataccgaaatctccaactcccgcatcgcatcgcatcgcatcgaaccttcggcctgcaagcgaattcgtcctcccctctcctaccggcgcgaattcaaccgcccgcaaagccctaggccgatgcgtccgatccggctacccgagccgccgggcgtcgacggcatggagacgcccgagatcttctctggcagcggcactggtggcgccgccgtcgttcgccgcgccgtcctcataggcaacggctcccccggcgcagaaaaccagtgtctcggcctcgcccgcgccctcggccttgccgacaacctcacattctaccgtgtcacgaggccgagaggagggatcaatgagtggctgcactttctccccatttccatgcacaaagttatagacccaatactcaggcangtcttccggaaacacaggttcgcaatagtggttcaggggaggaagccgcgtgtgctgaatgtgcatcagttgggttgtctgcagttctgggagcaacgtcaagaagatgttactgtagcacgcgatacgat

SEQ ID NO: 29671 - protein, 138 aa, Zea mays
  misc_feature: Ceres CLONE 1404788-F
  misc_feature (95)..(95): Xaa is any aa, unknown, or other
MRPIRLPEPPGVDGMETPEIFSGSGTGGAAVVRRAVLIGNGSPGAENQCLGLARALGLADNLTFYRVTRPRGGINEWLHFLPISMHKVIDPILRXVFRKHRFAIVVQGRKPRVLNVHQLGCLQFWEQRQEDVTVARDT

SEQ ID NO: 29672 - DNA, 729 bp, Zea mays
  misc_feature: Ceres CLONE 1404790-F
  misc_feature (274)..(274): n is a, c, t, g, unknown, or other
  misc_feature (336)..(336): n is a, c, t, g, unknown, or other
  misc_feature (367)..(367): n is a, c, t, g, unknown, or other
  misc_feature (379)..(379): n is a, c, t, g, unknown, or other
  misc_feature (402)..(402): n is a, c, t, g, unknown, or other
  misc_feature (439)..(439): n is a, c, t, g, unknown, or other
  misc_feature (450)..(450): n is a, c, t, g, unknown, or other
  misc_feature (451)..(451): n is a, c, t, g, unknown, or other
  misc_feature (570)..(570): n is a, c, t, g, unknown, or other
  misc_feature (572)..(572): n is a, c, t, g, unknown, or other
  misc_feature (573)..(573): n is a, c, t, g, unknown, or other
  misc_feature (594)..(594): n is a, c, t, g, unknown, or other
  misc_feature (596)..(596): n is a, c, t, g, unknown, or other
tggagctccccgcggtggcggccgctctagaactagtggatcccccgggctgcaggaattcgcacgagaccattacctagaacatcctaatcgaaaaacacacgactaagaaccaggcaaccagctgcggagggaggaaacctagcggaacactgtgcaggtgacggcggcgcgctaccggtgacaggggatacggcggcatcgtcccctcctccatccccggcgcggcggcgccagcagccggcctgcaggcacacaagtggccacccttccnatggcgggtgggagaagtccagcagcggcacatcaactccctccaccacctccaccatgggnaccggtttcagaagattgtcctaaggctggnatttacctccgntctcatcgctgaaatccaagggncggcagcaagggccagggtggctgcaggcatgtgagnaaacctaacanntctcgggtggtgggaaacccctcttggggggtcttttgagccacgctcccctttttggagggaggtcaaaggcacagatcatccccggggacgcagttaacggacgaggagaatctctngnnattggacctgggggaaggggnanccaccccgggggggcctcgggcccgggatatttttctgggggggtttccaaaaagctctcttcgggggggggggggggaaagaacaatttttccggggaaaaatgggtgccaaaaccaatgggatctaactgg

SEQ ID NO: 29673 - DNA, 655 bp, Zea mays
  misc_feature: Ceres CLONE 1404795-F
tggagctccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaatcaatttcttcgtccgccttcgcccctgcttacgtccccgctactaaccctaggatcattctgtcttttctcgtttcttatccgactcttcttcgttttatgcctatcagttatgaggttgaacgccttcagaagcttctctactagattagtgtaaatagtagacttgttcgagtttagcttggctggaagaattagtctctggtccgtggttatatctgctagcaataatggctgcgatgaacggagaggtattgggtggaatgtggaagaacataaatagtctcaagagaaagcgggagagccccgctgcatatgctgctggcgtattctgcacctctg

SEQ ID NO: 29674 - DNA, 721 bp, Zea mays
  misc_feature: Ceres CLONE 1404797-F
  misc_feature: Encodes the peptide sequence at SEQ ID NO. 29675
  misc_feature (461)..(461): n is a, c, t, g, unknown, or other
  misc_feature (548)..(548): n is a, c, t, g, unknown, or other
  misc_feature (568)..(568): n is a, c, t, g, unknown, or other
  misc_feature (569)..(569): n is a, c, t, g, unknown, or other
  misc_feature (616)..(616): n is a, c, t, g, unknown, or other
  misc_feature (626)..(626): n is a, c, t, g, unknown, or other
aaagctggagctccccgcggtggcggccgctctagaactagtggatcccccgggctgcaggaattcgcacgagaccattacctagaacatcctaatcgaaaaccccaaataacaccaaggcaccaagcccagcgaggccaccagctgtccagctccacctcgtcgactcctccccgcacaagacaaaaaaaccctcgccttggagggtggaggcgcgtgagcccgacacccagagcgaaaaaagcaaggggtctgaccgccggcgatggcgtccatctccggagcggcggcggcgccatcttccgctgcgtgccggctgcggctgcgtaggcacatcctgctgcggccctcgcacctccgcctccgcgcgccccactccatcgccgacctctcccgctcctccagctcctctagttccgccccgacccgggcccagccgctgggctccaggccggagaacnggcggcggcgtccgcgcgggtggagaaggacccgatcaagctgtgggagcgctacgtcgagtggctctaccagcacaaggagctcgngcctcttcgtcgacgtcagnncggatgggggttcacggaggacttcctgcgccagatggagccgcggnatgcagcggnccttcgccgccatgcgggagctcgagaagggcgccatcgccaacccggacgaggctcgaatggtgggccactactggcttcgcgacccggccctt

SEQ ID NO: 29675 - protein, 152 aa, Zea mays
  misc_feature: Ceres CLONE 1404797-F
  misc_feature: SWISSPROT Homolog: EC 5.3.1.9 Glucose-6-phosphate isomerase
  misc_feature (66)..(66): Xaa is any aa, unknown, or other
  misc_feature (95)..(95): Xaa is any aa, unknown, or other
  misc_feature (101)..(101): Xaa is any aa, unknown, or other
  misc_feature (102)..(102): Xaa is any aa, unknown, or other
  misc_feature (121)..(121): Xaa is any aa, unknown, or other
MASISGAAAAPSSAACRLRLRRHILLRPSHLRLRAPHSIADLSRSSSSSSSAPTRAQPLGSRPENXRRRPRGWRRTRSSCGSATSSGSTSTRSSXLFVDVXXDGGSRRTSCARWSRGMQRXFAAMRELEKGAIANPDEARMVGHYWLRDPAL

SEQ ID NO: 29676 - DNA, 700 bp, Zea mays
  misc_feature: Ceres CLONE 1404801-F
  misc_feature: Translation starting site: 110
  misc_feature: SWISSPROT Homolog: EC 1.14.13.68 4-hydroxyphenylacetaldehyde oxime monooxygenase
  misc_feature (368)..(368): n is a, c, t, g, unknown, or other
  misc_feature (445)..(445): n is a, c, t, g, unknown, or other
cgctctagaactagtggatcccccgggctgcaggaattcgcacgagaccattacctagaacatcctaatcgaaaaagctccaggagcagcaccaatcccccaagccgccatggccgccgaccccacgctgctgcttctcgtacctttcctcgccatccccctctacttcttcttggccaccagacgtaggacgccacgcgggggcgcgcggctcccgccggggccgtgggcgctgcccgtggtcgggcacctgcatcacctagcccggggcctcccgcaccgcgtcatgcgcgacctggcgaggcgccacggtccgctcatgatgctccggttcggcgaggccccgtggtggtggcctcctcgccggncgcggcgcgcgaggtgatgcggacccacgacgcggcgttcgcgtcgcggcccatcggtcccgtgtcccggctctggntccagggcgccgagggcatcctcttcgcgccctacggggacgactggcgccacctccggagggtctgcacccagaagctcctcaccggcggcggggtccaatcttccgccccggggggaaggacgagtccgccgcctgctcgcctcggggccttgaagggggggcccgtaacctggccggaaaaatttgactaaattcccgattccgggggggggcatttttggaagccaacggtttaagcccgcaaaccgaacc

SEQ ID NO: 29677 - DNA, 675 bp, Zea mays
  misc_feature: Ceres CLONE 1404802-F
  misc_feature: Encodes the peptide sequence at SEQ ID NO. 29678
  misc_feature (415)..(415): n is a, c, t, g, unknown, or other
  misc_feature (515)..(515): n is a, c, t, g, unknown, or other
cacccgcgggtggcgggccggctctatcactagtggatcccccgggctgcaggatttcgcacgagaccattacctagaacatcctaatcgaaaaattcattgttgattgattgatcctccccgcctcactcctttgtctcctcgcctcgtgctcgctcgctcccctcgccctggcgaggagggcagcagaaaccctagcggctcaggccgggcgggggttagatgctccaaggttcgagagggaagggtaggttagtggtgcgccatcgactatgggctgcgtcttcggccgggcggctgcgtcgtcctctgcagcgccgaagaagaagggggcaaggggaggtcgtccccgcagttccgagcggggtcgccctccgcagtcgccgccaccgacggggacgggaggccgcggcgncggctcgggggccgcagggcgtcgggacccaggaagggttgcgtccccgcggctggcgcggcggaacaactccccccccggttggccaccgggggctccntgcaacccttggggaaagccctcccggggttgtgggccccgccccccccccaaaccttttcaaaaaatttaaaaaaaaagggttcgggccccaaaagacaacgtggtaccggggggaggggaaccccgtttttgggcgcgagaattcccctcctaaaaaa

SEQ ID NO: 29678 - protein, 104 aa, Zea mays
  misc_feature: Ceres CLONE 1404802-F
  misc_feature (48)..(48): Xaa is any aa, unknown, or other
MGCVFGRAAASSSAAPKKKGARGGRPRSSERGRPPQSPPPTGTGGRGXGSGAAGRRDPGRVASPRLARRNNSPPGWPPGAPCNPWGKPSRGCGPRPPPKPFQKI

SEQ ID NO: 29679 - DNA, 734 bp, Zea mays
  misc_feature: Ceres CLONE 1404807-F
  misc_feature: Encodes the peptide sequence at SEQ ID NO. 29680
  misc_feature (396)..(396): n is a, c, t, g, unknown, or other
acccgcggtggcggccgctctagaactagtggatcccccgggctgcaggaattcgcacgagaccattacctagaacatcctaaaaaaaaataaaaaaaaaaccccaccgaagccgaaaaagaaaaatcctcgccgacgttcctcaccacggcgacggccaccgcgacctcggccccgacgttgcctacggcagccaccatgtcggcgagctccgttgtccccatgctgctgccagatgagcggcccgacatcctctcgctgctcgacgccgccgcccgcccgctcgccgacgtcgtcgccgacttccttgctcggttcccccgcgagcgccgcctccgtgtctgcggcgccctctgcttcctcctcgaggacaagatgatgctccatcctactggncggttaattgcatttgcaattcttcatcagagttattcgccgcagacagcaaatccatatattcctatattggtaaatgcagcctgtgatgaaacgtcagagaaatcagaacggccgtttgtccaactatattgacttcatctagtggaaatagtaataacgaggtctgaatcaggctgcccttggatactaaatggatctgttccacatcctcagtctttttggcccggggaccactggaaagcaaacggcagaacgggggaattccccgccccaaaaaaaatttcccgtcccggggttaaaagggtataccaaaccaaaggcccgaaaagttggca

SEQ ID NO: 29680 - protein, 110 aa, Zea mays
  misc_feature: Ceres CLONE 1404807-F
MSASSVVPMLLPDERPDILSLLDAAARPLADVVADFLARFPRERRLRVCGALCFLLEDKMMLHPTGRLIAFAILHQSYSPQTANPYIPILVNAACDETSEKSERPFVQLY

SEQ ID NO: 29681 - DNA, 650 bp, Zea mays
  misc_feature: Ceres CLONE 1404808-F
  misc_feature: Translation starting site: 438
  misc_feature (232)..(232): n is a, c, t, g, unknown, or other
  misc_feature (233)..(233): n is a, c, t, g, unknown, or other
  misc_feature (245)..(245): n is a, c, t, g, unknown, or other
  misc_feature (248)..(248): n is a, c, t, g, unknown, or other
  misc_feature (350)..(350): n is a, c, t, g, unknown, or other
  misc_feature (542)..(542): n is a, c, t, g, unknown, or other
tccccgcggtggcggccgctctagaactagtggatcccccgggctgcaggaattcgcacgagaccattacctagaacatcctaatcgaaaaactcgcaccacgccaccgctgctgcctgctcctcacagtcctccccgcgctcgcattgcgattcgcgacctagcgcgagggtaccgggggggtggtgcgcgcgcgtgctcggtgatccgggaagcgccgcgagatggcggnnggtgggaggcgncgntgccgcgccgaagcacgacgacttcacgccgcaccccgtcaaggaccagctccctggggtctcctactgcatcaccagccctcccccgtggcctgaagccgnttcttcttgggttccaacattatctggtcatgcttggtaccactgtgatcataccaactgcacttgttccacaaatgggaggaaacaatgaggacaaagcagtggttatcaagacattgctggttcgttgcaggtatcaacaccctcctgcagagtttctttggtaccatgttgcctgcagtgatcggcggntcatacacctttgttctgcttaccatttcgatcatccttgctggacgttatgctaatgaacctaatccacatatttaatttctcggcatcatgcgtgggacacaaggt

SEQ ID NO: 29682 - DNA, 656 bp, Zea mays
  misc_feature: Ceres CLONE 1404809-F
  misc_feature (490)..(490): n is a, c, t, g, unknown, or other
tggagctccccgcggtggcggccgctctagaactagtggatcccccgggctgcaggaattcgcacgagaccattacctagaacatcctaatcaaaaattcttcatcaagttattttcttgctccacggattgcctgctctgatgatctggcccttgccaagatcacactcgtgttcataaactcaccaactcactgacacccccgtactctttcttcttcacccacggccaagatagaactcactggcatgataggcttcctctttttaattcaccaactccctcctccggcgtatccacatccgaatctcaatccccacgggtacgaatctgacgctgctgaaaacctttccgccatgaagcacgaggtgtggaggcggtaacaccaacaccaacaccacatgccgccgccgtgcctcgagctgtctatgtcgcacgtgcgcttcggcgcagtccacggctcactccacgaggaggaagcggaggcagncgtctgcttgcacagtgactccgagacgtcctgagctggaccacgaggcgtcgcgcgacgatgaggtactcattgtacgcccgctccatggaggcatagctccccgtctgctctatgtacacttcatcgccagtgacgtcgcacatcacacaggatcgtctcgacc

SEQ ID NO: 29683 - DNA, 686 bp, Zea mays
  misc_feature: Ceres CLONE 1404810-F
  misc_feature: Translation starting site: 285
  misc_feature (497)..(497): n is a, c, t, g, unknown, or other
  misc_feature (617)..(617): n is a, c, t, g, unknown, or other
  misc_feature (633)..(633): n is a, c, t, g, unknown, or other
  misc_feature (686)..(686): n is a, c, t, g, unknown, or other
tccccgcggtggcggccgctctagaactagtggatcccccgggctgcaggaattcgcacgagaccattacctagaacatcctaatcgaaaaaaaaccgaaaaggaggacaaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgatctccggcgaggtgccggacgagccggtcgtgtcgaagaagtcggggctactcttcgagcggcggctcatcgagcgctacattgaggaccatggcaagtgtcccgccaccaaggaggacctcaccatggatgatatcgtgccggtcaagaccaacacgatcgtgaagcccaggcctttgcaggctgcaagcattccaggnactccttgggatttttcagaacgagtgggatgctctcatgctttctaattttgctttggagcagcagcttcacacagcaagacaagaacttagtcatgcactctaccagcatgacgctgncctgccgtggtatagncagattaaagaaagaaagagatgacgctagagcacttttggctcagctgagan

SEQ ID NO: 29684 - DNA, 679 bp, Zea mays
  misc_feature: Ceres CLONE 1404814-F
  misc_feature: Encodes the peptide sequence at SEQ ID NO. 29685
  misc_feature (572)..(572): n is a, c, t, g, unknown, or other
  misc_feature (586)..(586): n is a, c, t, g, unknown, or other
  misc_feature (629)..(629): n is a, c, t, g, unknown, or other
aaagctggagctccccgcggtggcggccgctctagaactagtggatcccccgggctgcaggaattcgcacgagaccattacctagaacatcctaatcaaaaaacaccttgtgtcgtaccctccggatcgaaggctggacgacgcgaccgcgcggcggcggctcgacgcgaccggtggctttgacgcgaccggcacggcggcgacgcacagcccgacgacgaccctccccgctgccttctccccgggcatttgctggagctggaaggcggaagcgttcccgttggattacttcttgggctggaaagagtgaaagacccggatgcactaaatcctgtcttgcaacagttacggccctggaattgatcccatgctgccgaacgggccctaagttggaacctgttcaggcggtgggtcagctcgcagctgactggggatccggcaccgcatcgccagacgccaggaggggactatcagccatggcagcgaggcagccgccgtcttcgtccgcgtccgcgcccggatccgcggagggtctctccatgaaggactacctcaggaggtacgtgtcgggnccagggaccgacgncgaccagaagatgggcgagaagaagacgaagaagaagcccagncccgcaggcgtggtgctcatcgtcgacgaggacccagtgtggcacagccc

SEQ ID NO: 29685 - protein, 67 aa, Zea mays
  misc_feature: Ceres CLONE 1404814-F
  misc_feature (37)..(37): Xaa is any aa, unknown, or other
  misc_feature (51)..(51): Xaa is any aa, unknown, or other
MAARQPPSSSASAPGSAEGLSMKDYLRRYVSGPGTDXDQKMGEKKTKKKPXPAGVVLIVDEDPVWHS

SEQ ID NO: 29686 - DNA, 696 bp, Zea mays
  misc_feature: Ceres CLONE 1404815-F
  misc_feature: Encodes the peptide sequence at SEQ ID NO. 29687
  misc_feature (226)..(226): n is a, c, t, g, unknown, or other
  misc_feature (307)..(307): n is a, c, t, g, unknown, or other
  misc_feature (591)..(591): n is a, c, t, g, unknown, or other
aaagctggagctccccgcggtggcggccgctctagaactagtggatcccccgggctgcaggaattcgcacgagaccattacctagaacatcctaatcaaaaaaccctcccccaacgactttgcacaccagcactcataaagccacttctgacaaacagatggctcatttctgcttgctgcctagctggcgtgaaccctcgacgcatgcagccaacactaccacagnagcgatatggatgtgaacgacgtgctgctagtggtgctggcggcggcgctggctgccatgatggtggcgtcggtgctccanacaccggcggtgtcgacgggctcccgccgcgcactccgggttgtcccatgacgaacaaccttgcccacgtcatcctctacttacggcccgtcttctccaacttcctgcccctcctagacaacgacgctcccaactcccgcctcggacggttccgcgccatcaccctcggctcctgtcgtagcctctcctccatgagcctgttgtgaatgacggcccttcttccggagacgagaacaccacagacccacccgcctcctcttcgggatcgcgagtgcaccgtccantcggggctctactcaccctgggggcgtgctctgcgccgccccttcgtcgccaagatcctgcccccccacctcgtcaagggcttcacctgcaaccggcacccgcgc

SEQ ID NO: 29687 - protein, 102 aa, Zea mays
  misc_feature: Ceres CLONE 1404815-F
  misc_feature (8)..(8): Xaa is any aa, unknown, or other
  misc_feature (35)..(35): Xaa is any aa, unknown, or other
MQPTLPQXRYGCERRAASGAGGGAGCHDGGVGAPXTGGVDGLPPRTPGCPMTNNLAHVILYLRPVFSNFLPLLDNDAPNSRLGRFRAITLGSCRSLSSMSLL

SEQ ID NO: 29688 - DNA, 858 bp, Zea mays
  misc_feature: Ceres CLONE 1404815-R
aaggggtattttccgattgggtaccgggccccccctcgaggtcgacggtatcgataagcttttttttttttttttttcactgtgagttctctctacctcctatttcggaagagagattgcctgctgaatttacgacacactactcgacagcacttaccgtgccaatattaacattccaagattagctccccttgggatgacaccgtactgattaacgtgtgttcgagggccacactacaagcctgtatatctatcccaagatcaacgctcttctgaaccctgtgcactgctcaaagtcgcatcacggggactaaccctagactgatgcccgcccttgagcccctcctactcgcctgggacgtcgtgtaccctccgcgcctgcggccaccacccagtttggaccatgaaccgattatgccctgcctcccactgctaatgaccacacgtcggccgcgcggaccaactcatgtaccaaggtgaattattccgaataccgcctgaccaagttgacccccaacgacacgcacggggtggcaactttcccggcctgcccgatcacggagaaagagtaagcgctgcccataactgcgcccagccctatgtcaagcgccagcagggacacccatacggttgacatgcgtctccgggaagtgcccgctcgacgaaggctgcccggcagcagggggcttcatgcaccacggtgaaacgccaagggcgtcgggtgggggtccacccgggttccttggcccggacggggcgggcagcgcggcgctaaactccggtcacaccaaggttttgggagtagcccatgaaagctccgcgaatgtgggaaagcaccgacccagaattcgcttgcgg

SEQ ID NO: 29689 - DNA, 698 bp, Zea mays
  misc_feature: Ceres CLONE 1404816-F
  misc_feature: Encodes the peptide sequence at SEQ ID NO. 29690
  misc_feature (521)..(521): n is a, c, t, g, unknown, or other
  misc_feature (652)..(652): n is a, c, t, g, unknown, or other
aaagctggagctccccgcggtggcggccgctctagaactagtggatcccccgggctgcaggaattcgcacgagaccattacctagaacatcctaatcaaaagtcccgatgccatatggatttctctatcgacacagttcgcaataatcaactcgtttctctccgattgctcctccgagtccgagactccgttctctcccgcatccaccgccgtctcatccccaatccgagcaacgcctcccctcgcctccaaaaccctacccctcctgtcaccggcgggggcatgaaccggtgatcgcttacctggtctcgtctgtctgcgcacgcgcgaggtcagtgagtgagcattgcggtggtccgatcgcccgcggggggccatggcgtctgtggcgggatcgggcggcggggcaagcgcgggggccggtgggttgaagacttacttcaagacccccgaggggcggcacaagctgcagtacgagaagacgcactcccccgccgtcgtgcactacaaccacaacggcnagaccgtcgcccagatgacggtggcatatttgaaggagaagccagcaggccagggttccacgccttcaacaccaagtgctggtagtgggaagcggtctggagctgggagactgcttggcactggcaaagantaccggacacttagtttcgggggcaaaggaaccaggagggttggcc

SEQ ID NO: 29690 - protein, 107 aa, Zea mays
  misc_feature: Ceres CLONE 1404816-F
  misc_feature (49)..(49): Xaa is any aa, unknown, or other
  misc_feature (92)..(92): Xaa is any aa, unknown, or other
MASVAGSGGGASAGAGGLKTYFKTPEGRHKLQYEKTHSPAVVHYNHNGXTVAQMTVAYLKEKPAGQGSTPSTPSAGSGKRSGAGRLLGTGKXYRTLSFGGKGTRRVG

SEQ ID NO: 29691 - DNA, 677 bp, Zea mays
  misc_feature: Ceres CLONE 1404819-F
  misc_feature: Encodes the peptide sequence at SEQ ID NO. 29692
  misc_feature (508)..(508): n is a, c, t, g, unknown, or other
  misc_feature (563)..(563): n is a, c, t, g, unknown, or other
  misc_feature (599)..(599): n is a, c, t, g, unknown, or other
cgcggtggcggccgctctagaactagtggatcccccgggctgcaggaattcgcacgagaccattacctagaacatcctaaaaaagggcaggtgaaaggaagaggaaagagggcgagtgcgacgggaggcgcaatgcggtggagatctcccgccgtgctgcggctgcagctgtggctgctcgccgtctccgcgtcgttggctgccctcggtgttctcgcggctgatcttagcaaagaaccatttactatccgtataagctgtggaagctttgacgatgtccggacggagcctacgaacacattgtggtacagagactttggttatactggaggcaggttcgctaatgccacccggccaagctttatcgttcctcctcttaaaacgcttcgatatttcccgctatctgatggccctgaaaattgctacacatcaacaatgttcccaatggccactatcaagttagactttttctttgcgttactggacaaccctaatcttgacgtgagcnaattttcgatgttcttggtgaagagggaactctgttcagctctttgccttctggnctggagccaacgacgatgatagacattgagaaaaanctttttgggttttttgtcagactccaagtttttatcagttggcttcctaagaaagagggggggggggggggatccatc

SEQ ID NO: 29692 - protein, 149 aa, Zea mays
  misc_feature: Ceres CLONE 1404819-F
  misc_feature (126)..(126): Xaa is any aa, unknown, or other
  misc_feature (144)..(144): Xaa is any aa, unknown, or other
MRWRSPAVLRLQLWLLAVSASLAALGVLAADLSKEPFTIRISCGSFDDVRTEPTNTLWYRDFGYTGGRFANATRPSFIVPPLKTLRYFPLSDGPENCYTSTMFPMATIKLDFFFALLDNPNLDVSXFSMFLVKRELCSALCLLXWSQRR

SEQ ID NO: 29693 - DNA, 709 bp, Zea mays
  misc_feature: Ceres CLONE 1404820-F
  misc_feature (332)..(332): n is a, c, t, g, unknown, or other
  misc_feature (368)..(368): n is a, c, t, g, unknown, or other
  misc_feature (369)..(369): n is a, c, t, g, unknown, or other
aaagctggagctccccgcggtggcggccgctctagaactagtggatcccccgggctgcaggaattcgcacgagaccattacctagaacatcctaatcaaaaaattgattggttgcttggttgcttgcttcgtttcacgctttccccttcctttgctgagatccaaaagctgagactcagcttgtcgatccatctgttctgtgcgcctactcgtatcttaggatccatctgtatgttgtttacttgttttcctgattgaatcgcgcattggatgcgctggtggttggccttgctcctagtcttttcatttacacgagctttcgacgaagccgncgtctggtctgtctgctccatcacaagagcacgcannatggttcgatctgccgtgccagatgattgctgcattcagtgggacgtcatgcacatccacgatggattgtagcgtcagcactctgatctttccttgtcgatttgtttgtcgcagctgagttcccccaccccccaacaaacaattactagagtagctgcattggcggggaaattaaagcgctagaagctcagcagcatgggcggagcaggcggccgccgggaaggtactggtgccacaggtgcgccgcggccgttagccccgcgggaggcgaggtgggagaatgaagtgcccgttctgccacagcggcttcctcgaggagatggagaccgcccgcggggcc

SEQ ID NO: 29694 - DNA, 659 bp, Zea mays
  misc_feature: Ceres CLONE 1404821-F
  misc_feature: Encodes the peptide sequence at SEQ ID NO. 29695
tggagctccccgcggtggcggccgctctagaactagtggatcccccgggctgcaggaattcgcacgagaccattacctagaacatcctaatcgaaaaactccagtgctggctgccggccagctccgcccccggggtccttgagctggaggtggcggtggatgaccaggtctcggagttttctgaggcgaggatcggagggcgttgcgttaggtccgcggttggtgagcggcggtcggagcggtctcgcgcgcggcggagtcgttcgatgacgcacgaatcgcgctctgggagggtgggaatacctcgcgctcgcgctcaaggtgctcgattaatttactgcctgaggctgagggagggcgcgcctgtgagctgaaccgttcccgctgcactgactcctgagctcgggaaatggttgagagcgtgcacatcactggatcggtccacggcggctatggcacgtccacggaggagcggctggacgagctgcgccggctgctcgtgcagtcagagggggaccttctctagatcgtcagcgtcggcgatgtcgcgtggggcagcgtcttcgccgcgctcctacaggacgcgtacggacatgtccgggacgagtgcacatcaggatctggcgtcgcccgggccggacggtggactgctccacgtg

SEQ ID NO: 29695 - protein, 38 aa, Zea mays
  misc_feature: Ceres CLONE 1404821-F
MVESVHITGSVHGGYGTSTEERLDELRRLLVQSEGDLL

SEQ ID NO: 29696 - DNA, 666 bp, Zea mays
  misc_feature: Ceres CLONE 1404822-F
  misc_feature: Translation starting site: 406
  misc_feature (283)..(283): n is a, c, t, g, unknown, or other
  misc_feature (296)..(296): n is a, c, t, g, unknown, or other
  misc_feature (300)..(300): n is a, c, t, g, unknown, or other
  misc_feature (301)..(301): n is a, c, t, g, unknown, or other
  misc_feature (313)..(313): n is a, c, t, g, unknown, or other
  misc_feature (319)..(319): n is a, c, t, g, unknown, or other
  misc_feature (596)..(596): n is a, c, t, g, unknown, or other
aaagctggagctccccgcggtggcggccgctctagaactagtggatcccccgggctgcaggaattcgcacgagaccattacctaaaacatcctaatcgaaaaatccaattcacaggctcaccacaccaaccaacaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccgggattccggangcttgggcgcggncggnngcggcgtgaagncgcatnctcggggctcatctacgaggagacccgcggcgtgctcaagatcttcctgggagaacgtcatccgcgacgccgccccaccacgcccgatggccgccgtaaggtcgctgctccgctcgtcggcctcccttcttcgcgccgcccccgccctcgcgagatcctcggctaccacgcgtccgtctcttcggcgcgcattggctgctcctcctcgcctcctcaggtcgcccgtcgagtcgagcttctgcgtggagtcgcttctgcctctgcacaccgccaccgncggtgcacgcatgacgtccatgctcgccgctcctggcaagggcctcggctggctcacccagctgaaactg

SEQ ID NO: 29697 - DNA, 607 bp, Zea mays
  misc_feature: Ceres CLONE 1404824-F
  misc_feature: Pfam Name: Mem_trans Pfam Description: Membrane transport protein
  misc_feature (290)..(290): n is a, c, t, g, unknown, or other
  misc_feature (323)..(323): n is a, c, t, g, unknown, or other
  misc_feature (382)..(382): n is a, c, t, g, unknown, or other
  misc_feature (383)..(383): n is a, c, t, g, unknown, or other
  misc_feature (395)..(395): n is a, c, t, g, unknown, or other
ccccgcggtggcggccgctctagaactagtggatcccccgggctgcaggaattcgcacgagaccattacctagaacatcctaatcgaaaagatcgaccggacgcacccggccgccatgatctcgtggacgacctgtacacggtgctgtgcgcggtggtgccgctgtacgtggcgatgatcctggcgtacggctccgtgcagtgtgggcgtgctgacccggaccagtgctccggatcaccgcttcgtcgccgtcttcgccgtgcgctctctcttcactgcattcttcccgnccagcacccgtacgtgatgaactccgctcatcngcgcgaacgctgcagaaggtctcgtctcgcgcgctcgcgtttggtcggacttcccgcgnngggggtgggggngcgaacgaactgcgggagccgtcgactggccatcaggtcttctccctgtcaccctgccaaaaagttatttggggataccgttctcgggccatggagggcggtactcggcgacctcctggggaaggggggggcccccgggatcggggggaaaaagttcggttggcttttaaaattccggccccgggggttcttcccggggaaggcccgaccgg

SEQ ID NO: 29698 - DNA, 731 bp, Zea mays
  misc_feature: Ceres CLONE 1404826-F
  misc_feature: Encodes the peptide sequence at SEQ ID NO. 29699
  misc_feature (602)..(602): n is a, c, t, g, unknown, or other
  misc_feature (637)..(637): n is a, c, t, g, unknown, or other
  misc_feature (672)..(672): n is a, c, t, g, unknown, or other
gctctagaactagtggatcccccgggctgcaggaattcgcacgagaccattacctagaacatcctaatcgaaaaaacgccaaacatctggtctcgctgccccgattcgccacgaagccgcactgtgagagagggacgcggcccgttgtccccggcttgtacgcaatccttccgtcgctgcgaagttgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctgtgacgttcttcagggaggttcttgctctttgtgatcatccatgcctcttggaaaaagaggaaaccaaatcattgttcagtgctgatgctatttctcgagcaaagcagattcttgcaactattcctggacgggcaacaggtgcatatagtcacagtcagggtatcaaaggattgcgtgatgcaattgctgctgggatcacctcacgtgancgattccctgcaaatgcagatgacattttcattancagacgagcaagtcctggggtccacatgatgatgncattactgattaggaatgagaaagatggcattctgtgcccaattcctcagtacccttgc

SEQ ID NO: 29699 - protein, 176 aa, Zea mays
  misc_feature: Ceres CLONE 1404826-F
  misc_feature: SWISSPROT Homolog: EC 2.6.1.2 Alanine transaminase
  misc_feature (133)..(133): Xaa is any aa, unknown, or other
  misc_feature (145)..(145): Xaa is any aa, unknown, or other
  misc_feature (157)..(157): Xaa is any aa, unknown, or other
MAPSVAVENLNPKVLKCEYAVRGEIVIHAQRLQQQLQTQPGSLPFDEILFCNIGNPQSLGQQPVTFFREVLALCDHPCLLEKEETKSLFSADAISRAKQILATIPGRATGAYSHSQGIKGLRDAIAAGITSRXRFPANADDIFIXRRASPGVHMMMXLLIRNEKDGILCPIPQYPC

SEQ ID NO: 29700 - DNA, 682 bp, Zea mays
  misc_feature: Ceres CLONE 1404827-F
  misc_feature: Encodes the peptide sequence at SEQ ID NO. 29701
  misc_feature (441)..(441): n is a, c, t, g, unknown, or other
  misc_feature (443)..(443): n is a, c, t, g, unknown, or other
tccccgcggtggcggccgctctagaactagtggatcccccgggctgcaggaattcgcacgagaccattacctagaacatcctaatcgaaaaagcactgcactgcacgcctccgccatactgcgacgccgccgtgcatcgcttcacgcagagcagtgatggaatcccatcacggcggcgacgggaaggcgcgggacaagttctcggtgtaccagaacccgtccctcacccgcgccctagactcccgcagcgcccgcccctccgtcacagtcctcctcgtcctcgcggtcatatccgtcgcctccgcatcctccttcctcgccctcacctcccgggaggagcagctcaccaagctcgccggacgagcgggtatctctgtccttgctgctgtttttgtcattaggttggtggaagcagcactcgggtcttgttgtacttttccnanctgctggggttcttcagggcactgatgttatacaatgggcagaaggcactggccaaggccgacaagggttgtcttgtctgatcgccaactgggggcttcttggggtaaaagatggcaggttcagaaggaaggtgggaaaggtgagcaaatcaaaaggcctcccaagaccaagccatcaacaccatcggaaccaatggtgcctatcagggaggtcttcgttcagctatacccatctcggg

SEQ ID NO: 29701 - protein, 103 aa, Zea mays
  misc_feature: Ceres CLONE 1404827-F
  misc_feature (96)..(96): Xaa is any aa, unknown, or other
MESHHGGDGKARDKFSVYQNPSLTRALDSRSARPSVTVLLVLAVISVASASSFLALTSREEQLTKLAGRAGISVLAAVFVIRLVEAALGSCCTFPXCWGSSGH

SEQ ID NO: 29702 - DNA, 761 bp, Zea mays
  misc_feature: Ceres CLONE 1404828-F
  misc_feature (634)..(634): n is a, c, t, g, unknown, or other
  misc_feature (716)..(716): n is a, c, t, g, unknown, or other
  misc_feature (726)..(726): n is a, c, t, g, unknown, or other
  misc_feature (748)..(748): n is a, c, t, g, unknown, or other
  misc_feature (758)..(758): n is a, c, t, g, unknown, or other
aaagctggagctccccgcggtggcggccgctctagaactagtggatcccccgggctgcaggaattcgcacgagaccattacctagaacatcctaatcgaaaaaccaacagccaatccacacctcgcttgcgttgtcctcgccgcggcctcgccctgattcggttcccccgttcctcgcctctgtcatcgtctcctctgacccaaattgagccaagcgaagccgtggccgtgatccggtccatgcgcggagcgtggtagccggattctatcgccgtcgcctccccttcgccgctattttccagtcgccgggatcagccgagttggatctcgaggcataaagcgttgcgggcgcccggcgaggatacgatgcctgcggtgctcgccgcattcgctacccttcgagccgccgctgccatcgcctccggggactcctccttcccctgttcccatcgtctcaagcatcgttttagtagtagtaattttagtagtagtaattgtcattaacctttgcgttccctccgtcgcgcacgctcctcggctcggcctcaccttcgcatttcggttttgggtctggttgtgctcgatccgaggctttactttggttttgcggcttctctccttgtcgaaagctggntgtctggattcgacctgcagatcggaaggaaacaaggtggtcattatcaccctacagataagagaatttctcttttgtattngggatcaagnctgtggatgacgaaccctcggntgacttcagntgg

SEQ ID NO: 29703 - DNA, 722 bp, Zea mays
  misc_feature: Ceres CLONE 1404830-F
  misc_feature: Encodes the peptide sequence at SEQ ID NO. 29704
agagctggagctccccgcggtggcggccgctctagaactagtggatcccccgggctgcaggaattcgcacgagaccattacctagaacatcctaatcgaaaaatcctcagtgctctctctctcctactcctgtgattctcctcttcagctcttctcgcccattccagctccgactgcgccggtgggggaccgcgcaccccagcggcgccaggcgtccacgggatggtggttcttgtggctactgccgctcggtggcccgggggaagcacggctgcccgggcgcgcccgccggctgcgaggggcagggcccccctccgcgtcgccgccgagcccgagcacaaggcggccacggtcaggtttggtacgcgccattggaagaaaaccagtagctgtcgcgaccttttttgatgtttcgattgcttcgttcacctgcgcactagatcaccgccttccttcaggtcgctggacctccattatgttatgcctgacaggcgcaaccataagcaattctaattgcatcttgatagaccaattccaggctaagatagcgcgagaattagggacactgtggcagcaagttatggatactgaacactagtgttgcagcttctttcccactacttgatgtaaaatttggttaacaatccttttgttttgcgagcataacagtcagaggagcaccctgttaacttgctaaacatatcatacttaagcactctagt

SEQ ID NO: 29704 - protein, 61 aa, Zea mays
  misc_feature: Ceres CLONE 1404830-F
MVVLVATAARWPGGSTAARARPPAARGRAPLRVAAEPEHKAATVRFGTRHWKKTSSCRDLF

SEQ ID NO: 29705 - DNA, 722 bp, Zea mays
  misc_feature: Ceres CLONE 1404834-F
  misc_feature: Encodes the peptide sequence at SEQ ID NO. 29706
aaagctggagctccccgcggtggcggccgctctagaactagtggatcccccgggctgcaggaattcgcacgagaccattacctagaacatcctaatcgaaaaatcatcacactcgaaacccaacagcttccttcctggcgatccaattaacggcttctcttctgagctcagcacgaacaatggccaccatcctcaccgtcgcaagcttcttcgcacttgtgtgcatctctcaacaagcgcgggctgcgaactacacgttcatgaaggacgcggtgcacgcgccgcggacgggcttctacgactacatcatagtcggcggcggcacggcgggctgcccgctggcggccaccctgtcggcccgcgcgcgggtgctgctgctggagcgcgggggctctccgtacgaggacgcgcgcgtcctgaacatggcccacttctcggacgtgctggcggacacgtcggcgtcgtccccgtcgcagcggttcgtgtcggaggacggcgtgatcaactcccgcccgcgcgtgctgggcggcgcgagctgcatcaaccgccgatttcttcacgccgggcggtggggcatcagtcaggtccggcccctgggaccccagcgcggggcggcctgttgcacaccgcaccgcccggccaggaaggcgttccgttgatgagtgccggtagatatgcggacatggtccgaagggggcccaccgcgcccgtctcccgcccct

SEQ ID NO: 29706 - protein, 159 aa, Zea mays
  misc_feature: Ceres CLONE 1404834-F
  misc_feature: SWISSPROT Homolog: EC 4.1.2.10 Mandelonitrile lyase
MATILTVASFFALVCISQQARAANYTFMKDAVHAPRTGFYDYIIVGGGTAGCPLAATLSARARVLLLERGGSPYEDARVLNMAHFSDVLADTSASSPSQRFVSEDGVINSRPRVLGGASCINRRFLHAGRWGISQVRPLGPQRGAACCTPHRPARKAFR

SEQ ID NO: 29707 - DNA, 715 bp, Zea mays
  misc_feature: Ceres CLONE 1404835-F
  misc_feature: Encodes the peptide sequence at SEQ ID NO. 29708
  misc_feature (550)..(550): n is a, c, t, g, unknown, or other
  misc_feature (551)..(551): n is a, c, t, g, unknown, or other
  misc_feature (630)..(630): n is a, c, t, g, unknown, or other
  misc_feature (683)..(683): n is a, c, t, g, unknown, or other
  misc_feature (687)..(687): n is a, c, t, g, unknown, or other
cgctctgaactagtggatcccccgggctgcaggaattcgcacgagaccattacctagaacatcctaatcaaaaggtggttgacggccgcttacccgcaccggcgccatgcgcgcgcgcggctaggtggtcgaggtcaagccaaacgctgcccaccgcctctgcctctgcctcgcatatatcctcgcgcacgttctttgctcgtctcgcactcgcttccttcgacgactcatcgccgatcacaccaggctagctagcccacccacagtcgtagggccaggaccgatcggaggagctcggtttttcgaccaggaccgccgccgccacacccgaagaagccgacgatgcagacgacgacgtcctcggcggcggcgtcgccgcgcccgcgcgcgcgggcgccgcagtccgtggtggccgagctggagggcgcgctgctccggagcgcggacacgttcccgtacttcatgctcgtggcgttcgaggcgtccgggctgccgcgcttcgcgctgctgctggcgctgtggccgctgctgcggctgctggaggtggcgnnccggcgcggcctggcgctgcgcgccgccgcgttcgtggccaccgcgggcgtgccgcgcgccgaggtggaggcagtgtcncgcggcgtgctgcccaagtcatgggccgacgacgtcgtccccggccgggtggngggncctcgggaactgcgaggggacccccgcc

SEQ ID NO: 29708 - protein, 124 aa, Zea mays
  misc_feature: Ceres CLONE 1404835-F
  misc_feature: SWISSPROT Homolog: EC 2.3.1.15 Glycerol-3-phosphate O-acyltransferase
  misc_feature (70)..(70): Xaa is any aa, unknown, or other
  misc_feature (114)..(114): Xaa is any aa, unknown, or other
MQTTTSSAAASPRPRARAPQSVVAELEGALLRSADTFPYFMLVAFEASGLPRFALLLALWPLLRLLEVAXRRGLALRAAAFVATAGVPRAEVEAVSRGVLPKSWADDVVPGRVXGPRELRGDPR

SEQ ID NO: 29709 - DNA, 700 bp, Zea mays
  misc_feature: Ceres CLONE 1404837-F
  misc_feature: Translation starting site: 165
  misc_feature: SWISSPROT Homolog: EC 1.6.99.5 NADH dehydrogenase (quinone)
  misc_feature (449)..(449): n is a, c, t, g, unknown, or other
  misc_feature (484)..(484): n is a, c, t, g, unknown, or other
  misc_feature (553)..(553): n is a, c, t, g, unknown, or other
aagctggagctccccgcggtggcggccgctctagaactagtggatcccccgggctgcaggaattcgcacgagaccattacctagaacatcctaatcgaaaagatctccccaatccgaccagaccggcaggtaccttcgactcaagcggagcaggagaggcaaagatggggctgcgacggccgctcctcaaatcggccaacttctcccccgacagtaaggctggaattgagtacttgtattctttctcaagggcacagtctgcttgatctctcgatggagctggactttgccctgctagtagatcatttagcacccaggctgccactacgtcgagcacaccacagcctccacctccaccaccccctccagagaagactcagctttggaggtctcaaagatgaggatgcgcatttttcaccaacctctatggtctgcatgacccttttctnaaaggcgcgagtgaagaagaggtgactggtaaggnaccaaggatttggtgatgtaagggggcagactggatagctaatgaatgaagaataggggcctttcgggncgggggagaggacagtttttcccctcgggctcggaaatgctctttaaatgccaagggtttctgaggacgccttcccttatcttggtgtaaaggctgatgagagtgagcctggaacttgcaaagatagagaaatcatgcgccaagacc

SEQ ID NO: 29710 - DNA, 680 bp, Zea mays
  misc_feature: Ceres CLONE 1404839-F
  misc_feature (506)..(506): n is a, c, t, g, unknown, or other
  misc_feature (523)..(523): n is a, c, t, g, unknown, or other
cgctcttaactagtggatcccccgggctgcaggaattcgcacgagaccattacctagaacatcctaatcgaaaactctctcgcgcgtccgcgcccgcgcccgcggcctcgttcaatccgccagcgctcccccgccccccggtggtagcgggctctacggcagcgctcctctccggttcccctgcgctccgcgtcttcatctgtggcggccgacgctccgtcggtgtctcgtcggacggagcgagcggagctagggttccgtttcatgctcaggatcggcgagatctagggtctcgatttcagggtgattgtactggatagctgctgctgatattgcaagacaatgaaagctcatcagcagcaaggtaatgcatctggcacaggagcaaagaccaaatctttttttgataagatacaaagcctgaaagctggtgcacatatcaacaaatcatcaggcaatgtggctgcaaagcgtagaaaggtctctccttttgaatcacataccanaagcaagatagcatcanagactggcagtcttatggaagcgccagcaagtgatgctaaagtgtctgctcggccactaatcactctggaaagatcaacttcacttttcccattatatgaacccattcagagatatgcagcaagaaaacacatccttaccttgaattgactttgctc

SEQ ID NO: 29711 - DNA, 663 bp, Zea mays
  misc_feature: Ceres CLONE 1404841-F
  misc_feature: Encodes the peptide sequence at SEQ ID NO. 29712
  misc_feature (443)..(443): n is a, c, t, g, unknown, or other
  misc_feature (453)..(453): n is a, c, t, g, unknown, or other
  misc_feature (454)..(454): n is a, c, t, g, unknown, or other
  misc_feature (464)..(464): n is a, c, t, g, unknown, or other
  misc_feature (514)..(514): n is a, c, t, g, unknown, or other
  misc_feature (535)..(535): n is a, c, t, g, unknown, or other
  misc_feature (583)..(583): n is a, c, t, g, unknown, or other
  misc_feature (586)..(586): n is a, c, t, g, unknown, or other
  misc_feature (587)..(587): n is a, c, t, g, unknown, or other
  misc_feature (598)..(598): n is a, c, t, g, unknown, or other
  misc_feature (601)..(601): n is a, c, t, g, unknown, or other
  misc_feature (602)..(602): n is a, c, t, g, unknown, or other
  misc_feature (631)..(631): n is a, c, t, g, unknown, or other
  misc_feature (656)..(656): n is a, c, t, g, unknown, or other
gctggagctccccgcggtggcggccgctctagaactagtggatcccccgggctgcaggaattcgcacgagaccattacctagaacatcctaatcgaaaagatcaaactttagtctactcgtcctcggtcctcctcttctcgcagcagccagcagaccaatcgggacaagcaaactcccccgattagtttaagcagcccgggcccggcgacgaccagctccgttccgcgcggggatttaaacgcgcgaagcgagaaggcacgcagcaggcggcagcggcaagcaacgaacgcgatcgcgcgccgacgacgacgcgcggtgccggcgcctggtggtgccgtgttgcggactccgctgcatcgtctcggtcggtcgtcgtcgttatcatgggtgtccggctggcggtggcgtggtccgccgtcctcgtcctcctcgtgcgggcggncgtggcgcgnnagtacgcggncatcttcaacttcggggactccctggtggacgcggcaacctgggtgtggnacggcatccggactacctggncacggcgcgcctgccctacggcatgacccacttcggctacccaccggncgnntgctcgacggncgnncctcgtcgttgatttcatcgcgcaggaanctgggcgtgccgctgctgccgcgtncaaggca

SEQ ID NO: 29712 - protein, 58 aa, Zea mays
  misc_feature: Ceres CLONE 1404841-F
  misc_feature (20)..(20): Xaa is any aa, unknown, or other
  misc_feature (24)..(24): Xaa is any aa, unknown, or other
  misc_feature (27)..(27): Xaa is any aa, unknown, or other
  misc_feature (44)..(44): Xaa is any aa, unknown, or other
  misc_feature (51)..(51): Xaa is any aa, unknown, or other
MGVRLAVAWSAVLVLLVRAXVARXYAXIFNFGDSLVDAATWVWXGIRTTWXRRACPTA

SEQ ID NO: 29713 - DNA, 653 bp, Zea mays
  misc_feature: Ceres CLONE 1404845-F
  misc_feature: Encodes the peptide sequence at SEQ ID NO. 29714
cgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtgggaacctgttcaggtgatcctgcagcgacggccttcatgtacgtggtgcgcgacctccgggagagtacgggcccatcttcccatgcggatgggcagcgcacctcatcgtggtcacctcggcggaactcatccaccaaggggcttggcgaaacaaggccccccagtgttcccgaaaccccgccccccaaaaaaaaagggccccaacccgggtttttttttttttttatagaggggggaaaagagaggaccccccttaaattttttggggggcccccattaaaaaacccccccccctgggggggggggtggggc

SEQ ID NO: 29714 - protein, 146 aa, Zea mays
  misc_feature: Ceres CLONE 1404845-F
MDVNDVLLVVLAAALAAMWWRRCSKTGGVDGLPPGPPGWPVVGTCSGDPAATAFMYVVRDLRESTGPSSHADGQRTSSWSPRRNSSTKGLGETRPPSVPETPPPKKKGPQPGFFFFFIEGGKERTPLKFFGGPPLKNPPPWGGGWG

SEQ ID NO: 29715 - DNA, 664 bp, Zea mays
  misc_feature: Ceres CLONE 1404848-F
  misc_feature: Encodes the peptide sequence at SEQ ID NO. 29716
  misc_feature (495)..(495): n is a, c, t, g, unknown, or other
  misc_feature (511)..(511): n is a, c, t, g, unknown, or other
  misc_feature (561)..(561): n is a, c, t, g, unknown, or other
  misc_feature (575)..(575): n is a, c, t, g, unknown, or other
  misc_feature (576)..(576): n is a, c, t, g, unknown, or other
aaagctggagctccccgcggtggcggccgctctagaactagtggatcccccgggctgcaggaattcgcacgagaccattacctagaacatcttaatcgaaaaataaactagacgagaagagagagagagggagagaggggaaagttgattctctctctgacccgcccactccctccttccctgctccggtcgcactccgtcgttcctccgcgcacgtacgtacagcagccagacacgagatcgagtggtacagggcccgccagaaacctcacgagctagctggttcctgatcggcggcctgtgccgcgcgccgatccacgcatggcgccgccgctcctgcccgcgcgcttcgtcgccgcctccgtcgcgctgctcgccgtcgccttctcctcctctctaacgcgtccgtcaggtgcatacgatccgctcgatccgaacgggaacataacaatcaagtgggacgtgatacagtggactgcggatgggctatgtggncgtcgtttcgctatancactaccagcagtaccgccacatccggcgccgggggtggaggctagggcntgggtggggcgaannaagggaggtgatctggggcgatgaccggcggccaggccaccgagcagggcgactgctcccaggtcaaagccagcgtcctcccccctgg

SEQ ID NO: 29716 - protein, 92 aa, Zea mays
  misc_feature: Ceres CLONE 1404848-F
  misc_feature (64)..(64): Xaa is any aa, unknown, or other
  misc_feature (85)..(85): Xaa is any aa, unknown, or other
MAPPLLPARFVAASVALLAVAFSSSLTRPSGAYDPLDPNGNITIKWDVIQWTADGLCGRRFAIXLPAVPPHPAPGVEARAWVGRXKGGDLGR

SEQ ID NO: 29717 - DNA, 733 bp, Zea mays
  misc_feature: Ceres CLONE 1404849-F
  misc_feature (378)..(378): n is a, c, t, g, unknown, or other
  misc_feature (401)..(401): n is a, c, t, g, unknown, or other
  misc_feature (402)..(402): n is a, c, t, g, unknown, or other
  misc_feature (454)..(454): n is a, c, t, g, unknown, or other
  misc_feature (457)..(457): n is a, c, t, g, unknown, or other
  misc_feature (484)..(484): n is a, c, t, g, unknown, or other
  misc_feature (512)..(512): n is a, c, t, g, unknown, or other
cagagctggagctccccgcggtggcggccgctctagaactagtggatcccccgggctgcaggaattcgcacgagaccattacctagaacatcctaatcgaaaaaccctacccctctctctctctctcctctacctccttttcctctaacctttagctttcctccctccctctcctctctcccccctcctctaacaagaactactcccagccattcagatcctaagttgctgaccttgctgctgcttgttggagatagatttgttggttctaagttcgaagtaccatgagtccaccgagtgtgatgggggcagtttggggacacaacctacaccaaggttttttgttgggggactcgcgtgggaaacccagaaggagangatgaggaagtacttcgagcagnnttggggagatcctgggaggctgttgtcatcactgacaagaacactggcagantcnagggctacggatttgtacccttccggnatccggacgcggcgatgagagcttgcgntgatcccgcacgggtgattggatgggaggagggctaactgaaatctggcttcccttgggggtcaagaacttagcctcctaaccccccaggatgggggggctaaaaattttaggggaagggaatcttttcgcccggagggggggaacccgggggggactggggcaaagtttttcttttcatggcccttttccctatttggccccccccaaggggcttttctt

SEQ ID NO: 29718 - DNA, 715 bp, Zea mays
  misc_feature: Ceres CLONE 1404850-F
  misc_feature: Translation starting site: 201
  misc_feature (715)..(715): n is a, c, t, g, unknown, or other
gctctagaactagtggatcccccgggctgcaggaattcgcacgagaccattacctagaacatcctaatcaaaaaaattgcgacgccgccgccgtcactgtcgccgcaggagtgcgaaccacgctgccgcccgctcccgccgcccaaacagctttatccgagccccgattcgccggatcacatgctgcggccacctctcaaatgacctctcaactccagagcactttgctcctgctcccgctcttcgccgccgctgctttgggccgcggcggcgacgcctcgactgcgccgtcgctggagttccaccatcggttctccgcaccgctgcggcggtgggtggaggcccgagggcgcgcgctccctggcgggtggccggctcccggcagcgccgcgtacgtcgccgcccttgccgggcacgatcgccaccgggcggtgtcggcagcagggggtagtagcagcgacgcaccaccgctcactttcgccgagggaatgccaccctcaagtcagcaacctcggatttttgcactatgctcttgtgaccgttggcacaccgggccagacgttcatgggtggcgctggacacaggcagcgatctcttctggctgccttgccagtgtgacggctgcacgccctcagccactgctggctctggatcagctacatttacattcccctggatgtcgtcacctagaaaagcagttccgtgcacagccacn

SEQ ID NO: 29719 - DNA, 667 bp, Zea mays
  misc_feature: Ceres CLONE 1404856-F
  misc_feature: Translation starting site: 220
  misc_feature (341)..(341): n is a, c, t, g, unknown, or other
  misc_feature (360)..(360): n is a, c, t, g, unknown, or other
  misc_feature (411)..(411): n is a, c, t, g, unknown, or other
  misc_feature (417)..(417): n is a, c, t, g, unknown, or other
  misc_feature (495)..(495): n is a, c, t, g, unknown, or other
  misc_feature (642)..(642): n is a, c, t, g, unknown, or other
tccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatggtggtggcgtcggtgctccaagaaccggcgggtgtcgacggcctcccgccggggccctccgggttggncgggtggtggggaacctgnttccaggtgatcctgcagcgacggccccttcatgtacgtggtgcgcgactncccggnagaagtacgggcccatcttcaccatggcggatggggcagcgcaccctcatcgtggtccacctcggcggagctcatccncgaggcgttggttgaagcagggccccatgttcgcgagcccggcccgaggacagccccacccgcctcctccttcagcgtcggcaagtgcaccgtcaactcggcgcctaggcccccccctggggcgtgctctgcgccgcactccgtcgnccgagatcgtgtcccgcaccgcgtc

SEQ ID NO: 29720 - DNA, 702 bp, Zea mays
  misc_feature: Ceres CLONE 1404859-F
  misc_feature: Encodes the peptide sequence at SEQ ID NO. 29721
  misc_feature (356)..(356): n is a, c, t, g, unknown, or other
  misc_feature (360)..(360): n is a, c, t, g, unknown, or other
  misc_feature (453)..(453): n is a, c, t, g, unknown, or other
  misc_feature (500)..(500): n is a, c, t, g, unknown, or other
gctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccacctttgtccagacnaggncacgaacacgctctccatcatcgacagcggcatcggcatgaccaagtccgaccttgtcacaacctcggtaccatcgccaggtcggggacgaangagttcatggaaagccctgctgcccgcgctgatgtggccatgatggnccaatgtcggggcgggttctactctggctacctcgcccccaatggagtttcgggacccccagcccacgtatgcgagcataacggggggattcccaaggggggggtcttcctggttacctcggaaccccaggggaaaaatttgtgaggggccaaaaaatcccccggtccctaaagggaaaaacggggaaaccctggggggggc

SEQ ID NO: 29721 - protein, 117 aa, Zea mays
  misc_feature: Ceres CLONE 1404859-F
  misc_feature (72)..(72): Xaa is any aa, unknown, or other
  misc_feature (73)..(73): Xaa is any aa, unknown, or other
  misc_feature (104)..(104): Xaa is any aa, unknown, or other
MASETETFAFQAEINQLLSLIINTFYSNKEIFLRELISNSSDALDKIRFESLTDKSKLDAQPELFIHLCPDXXTNTLSIIDSGIGMTKSDLVTTSVPSPGRGRXSSWKALLPALMWP

SEQ ID NO: 29722 - DNA, 687 bp, Zea mays
  misc_feature: Ceres CLONE 1404860-F
  misc_feature: Encodes the peptide sequence at SEQ ID NO. 29723
  misc_feature (459)..(459): n is a, c, t, g, unknown, or other
  misc_feature (491)..(491): n is a, c, t, g, unknown, or other
  misc_feature (569)..(569): n is a, c, t, g, unknown, or other
  misc_feature (657)..(657): n is a, c, t, g, unknown, or other
ggtggcggccgctctagaactagtggatcccccgggctgcaggaattcgcacgagaccattacctagaacatcctaatcgaaaaatcacaccaccaaacggaccaggcgaggcgtcctccaggccctagctctgtggtgtgcgcctcgatactgcgactgcggggcgccggtgcccgtcccatcggccgccgaactgtgcgccccggttgcccactaggccactactgcagtctgcactctgcagataacacagaggaaggcggaagccgatggccgccgtggcaagccccgccctccggctccgcccgagagccgcctctacgtcggcgacctcctcctccgcccctcctcgctgtcgcttcggctccttctctcactcctggtttcaagtttgggaggtcatttccagttcagagagtcaatggaagcacgatgccagcatttcggtactctaaaangctcaagtttttagcagcactggcgaccatgnatggacgatttcaatattaagaggactatatgctttgctgctacggacagcaggggagcccggtcgtttcacgttatnagaaaaaatggccgggttttgcatgaggggaaaaagtggggtactaaagttaccccctgcatctgaaaactccctactccccctgggnaaaaaggtgcctggaaaaacccaggattct

SEQ ID NO: 29723 - protein, 61 aa, Zea mays
  misc_feature: Ceres CLONE 1404860-F
MAAVASPALRLRPRAASTSATSSSAPPRCRFGSFSHSWFQVWEVISSSESQWKHDASISVL

SEQ ID NO: 29724 - DNA, 666 bp, Zea mays
  misc_feature: Ceres CLONE 1404861-F
  misc_feature: Encodes the peptide sequence at SEQ ID NO. 29725
  misc_feature (315)..(315): n is a, c, t, g, unknown, or other
  misc_feature (344)..(344): n is a, c, t, g, unknown, or other
  misc_feature (492)..(492): n is a, c, t, g, unknown, or other
aagctggagctccccgcggtggcggccgctctagaactagtggatcccccgggctgcaggaattcgcacgagaccattacctagaacatcctaatcaaaaaaccatcaccgcctcgtgtgcagcgtgctcgcccacctcctctgtcgacactcagggtactgacgcaccaccccgaagccctcccgccgcgctcgcagggtgttcgacccttcgcccgcgcgccctcacgacatgcctcctccgtctccgccgccgccaaggccgccgcggcgttcgcgcacaaggtccagaaggagctggccgcgccggcgagncgccgcgcgggcttgacccgccggacagnccggtgcagcgtgcgcgccgtcgcttcgcccgcgcgcgccctgtcgtccaccggcttcggtgaagagcgcgatgacgatgacggagaaataactgggcgcgggcgtcggagcgcgcggcgctgcagcccggagagaacgtgtgggtcnacgacgacgtgctcatgacgcacgacggctgcgggcccggcgccttcgatatcttccagaaggagttcgggcaggaccccggggtcgggcaacgcgagaaactcgtcgtcatcccggaccactacttctttaccagggacggccgtgcaaaaggaatgtcaacatccccggggt

SEQ ID NO: 29725 - protein, 53 aa, Zea mays
  misc_feature: Ceres CLONE 1404861-F
MTHDGCGPGAFDIFQKEFGQDPGVGQREKLVVIPDHYFFTRDGRAKGMSTSPG

SEQ ID NO: 29726 - DNA, 796 bp, Zea mays
  misc_feature: Ceres CLONE 1404862-F
  misc_feature: Encodes the peptide sequence at SEQ ID NO. 29727
  misc_feature (1)..(1): n is a, c, t, g, unknown, or other
  misc_feature (21)..(21): n is a, c, t, g, unknown, or other
naaccccccccctcccccccncccccctataaataaagggggggagtggaagtactgagctccccgcggtggcggccgctctagaatagtggatcccccgggctgcaggaattcgcacgagaccattacctagaacatcctaatcgaaaactcttcgtcgtcctatcttataatcgcatttcgaaatccccaaacggaggcctcgccactcttccgaacctgaacaatcaccaccgttattaagaagatgatgcgctgcgctgcaacgggcggcgggtgcgtcgcttcgtggagcggcgattggagattgccggcggtcaacccctgcagcgtgcggatgctgacgggcaacgatgggtggtgcgccggcctgaggtcgcgggcggcggatctcgccggcctcgagatggccaacctgcgcggcggcgtcgggggggtctttccgggcgagcccggggctacggggggtttggaagccaccggggggagtttgaccccggaagaaaattccatttggaagaaaaggttcaaggttaaaatccccccggggaattggttcttgccaataatgggtgggcgggttcccttggggttggggggcgctaatttccgggttggggttacccccctctgtgggggggggggccaaaaggggcgccactggggaaaatttcccggggaaggggaaccccgggggaagtgggggaaaaaagggttgcttctggaaacgggagggggggggggcgtaaacacccctccggggggggggggggaaacaaaagggatttttttattc

SEQ ID NO: 29727 - protein, 183 aa, Zea mays
  misc_feature: Ceres CLONE 1404862-F
MMRCAATGGGCVASWSGDWRLPAVNPCSVRMLTGNDGWCAGLRSRAADLAGLEMANLRGGVGGVFPGEPGATGGLEATGGSLTPEENSIWKKRFKVKIPPGNWFLPIMGGRVPLGLGGANFRVGVTPLCGGGGQKGRHWGKFPGEGEPRGKWGKKGLLLETGGGGGVNTPPGGGGETKGIFLF

SEQ ID NO: 29728 - DNA, 676 bp, Zea mays
  misc_feature: Ceres CLONE 1404869-F
  misc_feature: Translation starting site: 303
  misc_feature: SWISSPROT Homolog: EC 2.7.11.1 Non-specific serine/threonine protein kinase
tccccgcggtggcggccgctctagaactagtggatcccccgggctgcaggaattcgcacgagaccattacctagaacatcctaatcaaaaaagcgaggcagacagcggctgtcccgagctgtcgaaagcgaggcgcggcggcagtcctcgcagggccgaccggtcaaaagcactgctgctccacaccacccccaccatctctttccccaacccccgaagccgagccagcgaatcaccccgcccgcagccgcaagcaagcagccaagcagtgtgaactgaccgtccgttccgtccagcccaccatggaggcgccgccggtaccggagctcatggatctggacgcgccccctcccgccgcagccgacgccgcagccgcggcgccggttccccccgccgtcagcgacagaaagaaggaaggggaagggggagacactgttacgggccacatcatctccaccaccatcggtggggaagaacggcgagccgaagcggaccatcagttacatggcagaacgtgttggtgggtacgggctcattttgggatcgtcttccagggctaagtgttttggagactggagagacctcgcccattaagaaggggctgcaagggatcggcgttacaagaaaccgggagctgcaaactaatgcggggccatgggagcaccccaaccgtcat

SEQ ID NO: 29729 - DNA, 741 bp, Zea mays
  misc_feature: Ceres CLONE 1404870-F
  misc_feature: Encodes the peptide sequence at SEQ ID NO. 29730
  misc_feature (729)..(729): n is a, c, t, g, unknown, or other
  misc_feature (735)..(735): n is a, c, t, g, unknown, or other
agagctggagctccccgcggtggcggccgctctagaactagtggatcccccgggctgcaggaattcgcacgagaccattacctagaacatcctaatcgaaaagtcgagttaacaaagtcacctcatccaatcttgcatccccatctctgtctttgctcctccatggccatggccatggcccgaccttgtgctttccttctcttcttcctagttcttttctcctacgacggatccggtcctgggagcagcagcaggaggagtggcgtcgctcaggccacgcagagagtcttcctgtatccacaggctcccaaggtctcctccatcgtgagcagcaagtacaggaccgcgtaccacttccagcctcccaagaactggatcaacgatccaaatggaccaatgtactacaatggtatctaccaccagttctaccagtacaacccaaacggctcgctctggggcaacatagtctgggcgcactcgttctccacagatctcgtgaaactggatccggctcgcgccggcgatagagcggacgactccgagcgacatcaatggctgcctggacaggttcagccaccatcctcaagaagcggccggcctgccatcatatacaccggcgccgacaccgaagaagcgtcaggtccagaaacttggcgttccccaagaacctgtccgatccgtaacctgcggggaatgggtgaagccaccgaacaaacccggtggatccangccggntcggaa

SEQ ID NO: 29730 - protein, 193 aa, Zea mays
  misc_feature: Ceres CLONE 1404870-F
  misc_feature (64)..(193): Pfam Name: Glyco_hydro_32N Pfam Description: Glycosyl hydrolases family 32 N terminal
  misc_feature: SWISSPROT Homolog: EC 3.2.1.26 Beta-fructofuranosidase
  misc_feature (189)..(189): Xaa is any aa, unknown, or other
MAMAMARPCAFLLFFLVLFSYDGSGPGSSSRRSGVAQATQRVFLYPQAPKVSSIVSSKYRTAYHFQPPKNWINDPNGPMYYNGIYHQFYQYNPNGSLWGNIVWAHSFSTDLVKLDPARAGDRADDSERHQWLPGQVQPPSSRSGRPAIIYTGADTEEASGPETWRSPRTCPIRNLRGMGEATEQTRWIXAGSE

SEQ ID NO: 29731 - DNA, 726 bp, Zea mays
  misc_feature: Ceres CLONE 1404874-F
  misc_feature: Translation starting site: 105
  misc_feature: SWISSPROT Homolog: EC 2.3.1.91 Sinapoylglucose--choline O-sinapoyltransferase
aagctggagctccccgcggtggcggccgctctatcctagtggatcccccgggctgcaggaattcgcacgagaccattacctagaacatcctaatcgaaaagaggatgccttgccgcctctgctgcttcctgctcgtcgtcgccgcctccgccgtctccgggcgggggcgggtggtcaccaccctcccgggctacgagggccgcctccccttccacctcgaaacagggtatgtggaggtggacgaggacgccggcgcggagctcttctactacttcgtccgggccgagtccggcgccgacgacagcgacaccccgttcgtcctccggatccccggcggccaacgctgctccgccttcagcggcctcgcctacgagataggtcccatcatttgtcgtggagccctacaacggcagcttgccgcgcctgcgctacaacccaaactcgtggacaaaggtggcgcatattctttttgtggattcgccagttggggccgggttttccttctccagagatgccaaaggctacaacgctggagcggtatcaaccacgctgcacttggcgaagttcctcaacaagtggttcaacgaccatcctgagtaccatggaaatcctttctacatcgatggagaatcatacgctggaaaaattgtaccattccttgcccagatgacttccagaaggattggccgcaggaatgaagtccgcaacctctcgcaaggggtattt

SEQ ID NO: 29732 - DNA, 641 bp, Zea mays
  misc_feature: Ceres CLONE 1404875-F
  misc_feature: Encodes the peptide sequence at SEQ ID NO. 29733
  misc_feature (343)..(343): n is a, c, t, g, unknown, or other
  misc_feature (353)..(353): n is a, c, t, g, unknown, or other
  misc_feature (354)..(354): n is a, c, t, g, unknown, or other
  misc_feature (383)..(383): n is a, c, t, g, unknown, or other
  misc_feature (485)..(485): n is a, c, t, g, unknown, or other
  misc_feature (546)..(546): n is a, c, t, g, unknown, or other
  misc_feature (568)..(568): n is a, c, t, g, unknown, or other
cgcggtggcggccgctctagaactagtggatcccccgggctgcaggaattcgcacgagaccattacctagaacatcctaatcaaaaaactcattctttcacttctccagccgtcacagacaaccggccgccaggaagcatggccgaccgtgccctgctaatctcctccttttttttcttttttctgtttgcctacgcgcagcatagttctgttcttttcgtatgcgtgttcttttcgcatgcctgttgcatgcatgttacttctctctctgtttctgtttcttttttttgggcgcagtctcatcggaccgcagggagcaccggcgcttgggcggtggcgctcnggcagagcgnncttgcagccgcgctcgggtagaggagcgncctgcacccctcccgcctgctacgagatactacaggacattcagctacagtgtgatctgatctatacctcctactcgattcccctatgtgatggctgtacgnatgtattatctgtatttttggatcgagtttgaggtactatacgtgattgtttccctatggnggtctctgttaattttgatgcngtcaaacagctctgggcgttggacatactgatgcctttgattttaaggattatagtgcactttttactcggaa

SEQ ID NO: 29733 - protein, 78 aa, Zea mays
  misc_feature: Ceres CLONE 1404875-F
  misc_feature (69)..(69): Xaa is any aa, unknown, or other
  misc_feature (72)..(72): Xaa is any aa, unknown, or other
MADRALLISSFFFFFLFAYAQHSSVLFVCVFFSHACCMHVTSLSVSVSFFWAQSHRTAGSTGAWAVALXQSXLAAALG

SEQ ID NO: 29734 - DNA, 866 bp, Zea mays
  misc_feature: Ceres CLONE 1404878-F
  misc_feature: Encodes the peptide sequence at SEQ ID NO. 29735
  misc_feature (866)..(866): n is a, c, t, g, unknown, or other
cccccaccccctctatcgtccttaacgccccgcccccgccactttgtgactttattaggtgtcggtcgctctttaatagtggatcccccgggctgcagggattcgcacgagaccattacctaaaacatcctaatcgaaaatcctctccccgagtcctctcctctccggggtattgaattcgaaccaaaaaatcaaaagaactcagcgattcgattcgcggcgagtcaagcgggatgccgaccgcgcacgggtcgggcggtgacctcaaacccgccgcggaaggtgcccctccggaagctgctgagtgcggcgtccctcgactgcgcggtgcaattcgggtgggcgctggagctgacgttcttggacccccgacgcgcaggaagcggggcattcccgaacgccttttgggcagtctcgtccctgcctggggcggccccgcttgcccggccctccttggtggagccccccccgtgggaagctcttccaagagcggcctcttatccggccttttcaccgtgcgcgacgcctgaacacacgttgctccgcccctggcgggccggcgcagatcgccgccagggcacgccccccccgaacgaataactccgttaccgcccccgcccgagactttcaggaaggtagattccaccccaccggagccccaaacccaacataaggtgggcgtccgtcgcgtccccctgtgaaaaaatttagacgccgtcgcacgaggggaacccattcagcgggcatccggtgctgctctgcgcggggggagtcccctccctccctccgggaagtatgcccccacgccagagccgctcattggtcacatccgaccacccttggcctcgctgcgctagccacgctcn

SEQ ID NO: 29735 - protein, 98 aa, Zea mays
  misc_feature: Ceres CLONE 1404878-F
MPTAHGSGGDLKPAAEGAPPEAAECGVPRLRGAIRVGAGADVLGPPTRRKRGIPERLLGSLVPAWGGPACPALLGGAPPVGSSSKSGLLSGLFTVRDA

SEQ ID NO: 29736 - DNA, 703 bp, Zea mays
  misc_feature: Ceres CLONE 1404881-F
  misc_feature: Encodes the peptide sequence at SEQ ID NO. 29737
cgctcagaactagtggatcccccgggctgcaggaattcgcacgagaccattacctagaacatcctaatcgaaaaccggaatggtatcgtgcgacctgtagtcgtcgccagccacctcgctccctcctagacgacacccagctagtgctcccttccacacccaggaaccagccacctaaccccgcccgccatgccgggcctcgccgcctccgacaactcgcccccggcgccggcgccgccgccgcgccggctctcgtcgccgctaccccgtcgcgcgccgtcgtccccgtcgccgtccgcctcctcgcgcgccaagcctcggaagccctcgccctctcccgcggccttccccaccgacgccgacgactcgctcgacaacccggatctggggcccttcctcctcaagcaggcgcgcgacgccatggtgtcgagcgagggcggtggcgccgcgcgcgcactcgagttcgccgagcgcgccgccatggcgctcgagcgacgcggcgagggcgccgagctcgagctcgccatgagcctccacgtcgccgccgccatccactgcggcctcggccggcacgctgacgccatccccgtcctcgagcgcgccgtcgcagtcgtcacgccgccgccagaggcgcctgccgacggcgagcccaaaccaaggccgtggcaaccgggggggacaaacacaagagctggagcctgcg

SEQ ID NO: 29737 - protein, 171 aa, Zea mays
  misc_feature: Ceres CLONE 1404881-F
MPGLAASDNSPPAPAPPPRRLSSPLPRRAPSSPSPSASSRAKPRKPSPSPAAFPTDADDSLDNPDLGPFLLKQARDAMVSSEGGGAARALEFAERAAMALERRGEGAELELAMSLHVAAAIHCGLGRHADAIPVLERAVAVVTPPPEAPADGEPKPRPWQPGGTNTRAGAC

SEQ ID NO: 29738 - DNA, 695 bp, Zea mays
  misc_feature: Ceres CLONE 1404882-F
  misc_feature: Encodes the peptide sequence at SEQ ID NO. 29739
gctctagaactagtggatcccccgggctgcaggaattcgcacgagaccattacctagaacatcctaatcgaaaagaagccacagcagctgcaagcttttgcttcgtccgtccgtccgcccgcccgtccccgcatcattcccgaagtcccagcatggatttggaggggccgtgggcgcgggtgctgcacctgcacgatgcgtgcgagtggggccgggcggtgcgggcgcgcgcggtggcgccggcgctggaggccgcggcgtgggcgtgcctcgccatgtcggtcatgctcgtgctcgaggtgtgctacatgagcgtctccagcttcgtcgccgtcaacctgctgcgccggaccccacagcggcggtacagctgggagcccatgccctccgggaccgcccggggggacgatgaggaggcagcggcgggcgatgcaggcggcgaggcgtacccgatggtactcgtgcagatccccatgtaccacgagagggacgtctaccaaatctccgttggagcggcatgcgccctcacatgcccggccgaccgtatcataaaccggtattggcgcattcccaccccccacttgtgtagggattgtcgacgcaccacgggcaggccgggtcgcgggggcaagtattgcacaaaatctccgccccgagacgccggcgagcccaccaggtcgcagcttcctccacga

SEQ ID NO: 29739 - protein, 181 aa, Zea mays
  misc_feature: Ceres CLONE 1404882-F
MDLEGPWARVLHLHDACEWGRAVRARAVAPALEAAAWACLAMSVMLVLEVCYMSVSSFVAVNLLRRTPQRRYSWEPMPSGTARGDDEEAAAGDAGGEAYPMVLVQIPMYHERDVYQISVGAACALTCPADRIINRYWRIPTPHLCRDCRRTTGRPGRGGKYCTKSPPRDAGEPTRSQLPPR

SEQ ID NO: 29740 - DNA, 492 bp, Zea mays
  misc_feature: Ceres CLONE 1404884-F
agagctggagctcaccgcggtggcggccgctctagaactagtggatcccccgggctgcaggaattcgcacgagaccattacctagaacatcctaatcgaaaaaaactcacagcacaaacgtgtcctctcctcttccatcgtcgtcctcgctcccggccccgcctgtctagtctagtcccctcttctcgcgtggcaccccctgtactgggtacgtgctaggcacaccagctatagttgggaggttttacagcaaggcaacaaagggttttgggtgggggtcatgggggaaacgggggggggaaaaaaggaaaggccttcaattccggggaacccggggaaaaataaagacccgaggtttggtttggggccccgttttatctctggccaaaaaattttggaaaccggggggggaagggccccccctcaaaagcgcgggggggggaccctccccggggggagggggggccttcttcattaaaaggggggggcggg

SEQ ID NO: 29741 - DNA, 717 bp, Zea mays
  misc_feature: Ceres CLONE 1404885-F
  misc_feature: Encodes the peptide sequence at SEQ ID NO. 29742
  misc_feature (409)..(409): n is a, c, t, g, unknown, or other
  misc_feature (413)..(413): n is a, c, t, g, unknown, or other
  misc_feature (415)..(415): n is a, c, t, g, unknown, or other
  misc_feature (434)..(434): n is a, c, t, g, unknown, or other
  misc_feature (491)..(491): n is a, c, t, g, unknown, or other
tccccgcggtggcggccgctctagaactagtggatcccccgggctgcaggaattcgcacgagaccattacctagaacatcctaatcgaaaaatcgttccccagcagcctcttccccttcccgaccagagcaagcacgccaccgcttccgtcgtcgtcctcccgaccgtctcactcccgcccccacctccgcatccgatctccgaaacctaataatccaacggtcgcgcccgcgtcctctcggatggaggtggcccagccccaggcgagcaacgcccagggagtggcggagccggccatgaagctactgttcgtggagatgggcgtcggctacgatcagcacggccaagatatcaccgccgccgccgtgcgcgcctggcagggacgcatcacctccaactcccatcccgncttncngggcgggtccatcccaggnagtgacacggaccagatgaagctgcagatcaagctcggagtgcctaggtcgacgcancacttgctggatgctgaaagagtcaaggccgtcttcccctatggcaagaatatcagctttgaggtcgttgacggtggcatgatctggtccagggggggggggctgggaaccattgggggataaaacggatggctgctacataacccaccctgcaggggatttccgctaactggttgactggaaaaccctggaatggaccagaaaaaattgtgtagggttcccccga

SEQ ID NO: 29742 - protein, 123 aa, Zea mays
  misc_feature: Ceres CLONE 1404885-F
  misc_feature (56)..(56): Xaa is any aa, unknown, or other
  misc_feature (57)..(57): Xaa is any aa, unknown, or other
  misc_feature (58)..(58): Xaa is any aa, unknown, or other
  misc_feature (83)..(83): Xaa is any aa, unknown, or other
MEVAQPQASNAQGVAEPAMKLLFVEMGVGYDQHGQDITAAAVRAWQGRITSNSHPXXXGGSIPGSDTDQMKLQIKLGVPRSTXHLLDAERVKAVFPYGKNISFEVVDGGMIWSRGGGLGTIGG

SEQ ID NO: 29743 - DNA, 697 bp, Zea mays
  misc_feature: Ceres CLONE 1404888-F
  misc_feature: Encodes the peptide sequence at SEQ ID NO. 29744
  misc_feature (473)..(473): n is a, c, t, g, unknown, or other
  misc_feature (512)..(512): n is a, c, t, g, unknown, or other
aagctggagctccccgcggtggcggccgctctagaactagtggatcccccgggctgcaggaattcgcacgagaccattacctagaacatcctaatcgaaaaaacagcacgctctccctctccccgacggctgctagctagcgacaacagatcgacggcaacaccgatgggcgaggccaacgccacaggcacgccagccaccgcgacggtgcgcgtgctggccgtgtcgcgcgtcgcgccggcgccggcgccggcagcggcggaccccgtcgtcgtcaagctgtccttcttcgacacgccctgggtcgtgctgccgcccatccagcgggtgttcctgtacgagctgcctggtggcgacggtgagttcacggcggcagtgacgcgcctcaagagctccctcgccgccacgctggcggtgtacctgccgctggccgggaagctggcgtacgtcgccggcaccggggacgtggtcgnggactgcgtcgacgaccccggggcggccttcgtcgaggnggaggcgcacgccggcatcgacaccatggaccatcacccggttgcagagcgactaggcggcccaactccccgcgtccctagttgctggttgcggacctccccaccgggtggccccccgcgcggtgaacattcccgtgaatccttggaactgcctatgggtcgaaataccaagccgtaccctctac

SEQ ID NO: 29744 - protein, 177 aa, Zea mays
  misc_feature: Ceres CLONE 1404888-F
  misc_feature: SWISSPROT Homolog: EC 2.3.1.153 Anthocyanin 5-aromatic acyltransferase
  misc_feature (103)..(103): Xaa is any aa, unknown, or other
  misc_feature (116)..(116): Xaa is any aa, unknown, or other
MGEANATGTPATATVRVLAVSRVAPAPAPAAADPVVVKLSFFDTPWVVLPPIQRVFLYELPGGDGEFTAAVTRLKSSLAATLAVYLPLAGKLAYVAGTGDVVXDCVDDPGAAFVEXEAHAGIDTMDHHPVAERLGGPTPRVPSCWLRTSPPGGPPRGEHSRESLELPMGRNTKPYPL

SEQ ID NO: 29745 - DNA, 633 bp, Zea mays
  misc_feature: Ceres CLONE 1404889-F
  misc_feature (277)..(277): n is a, c, t, g, unknown, or other
  misc_feature (278)..(278): n is a, c, t, g, unknown, or other
  misc_feature (316)..(316): n is a, c, t, g, unknown, or other
  misc_feature (331)..(331): n is a, c, t, g, unknown, or other
  misc_feature (332)..(332): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (343)..(343): n is a, c, t, g, unknown, or other
  misc_feature (344)..(344): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (358)..(358): n is a, c, t, g, unknown, or other
  misc_feature (359)..(359): n is a, c, t, g, unknown, or other
  misc_feature (364)..(364): n is a, c, t, g, unknown, or other
  misc_feature (365)..(365): n is a, c, t, g, unknown, or other
  misc_feature (369)..(369): n is a, c, t, g, unknown, or other
  misc_feature (370)..(370): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (398)..(398): n is a, c, t, g, unknown, or other
  misc_feature (399)..(399): n is a, c, t, g, unknown, or other
  misc_feature (402)..(402): n is a, c, t, g, unknown, or other
  misc_feature (404)..(404): n is a, c, t, g, unknown, or other
  misc_feature (405)..(405): n is a, c, t, g, unknown, or other
  misc_feature (407)..(407): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (487)..(487): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (538)..(538): n is a, c, t, g, unknown, or other
  misc_feature (539)..(539): n is a, c, t, g, unknown, or other
  misc_feature (550)..(550): n is a, c, t, g, unknown, or other
  misc_feature (551)..(551): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (596)..(596): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
aaagctggagctccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgnnagcggcggtggcgtgggggaccgggccagccactgggnatggaggaaaagggnnaggcnnncccnncgnnnnnnncatgnnagatnngggnnaaggnnngnnnncannnnnnnnnngggnnggnanngnaaggnnnnngggggggggaaaannnnaggggggaaggggggggagaaaaaaaagannnnngggaaagaaaaaggggaaangggggggnnnnnnaaaaaaaaaaagagggggggggaaaaggggaggggggnnaaaaaggaaanngggggggagaggggggannnngggaaaaaaaaaaaaaaagaaggnggggggagaaggggnnnnnnnnnnnnnnnnnnnngga

SEQ ID NO: 29746 - DNA, 694 bp, Zea mays
  misc_feature: Ceres CLONE 1404890-F
  misc_feature: Translation starting site: 200
  misc_feature: SWISSPROT Homolog: EC 3.1.3.16 Phosphoprotein phosphatase
  misc_feature (444)..(444): n is a, c, t, g, unknown, or other
  misc_feature (445)..(445): n is a, c, t, g, unknown, or other
  misc_feature (462)..(462): n is a, c, t, g, unknown, or other
  misc_feature (580)..(580): n is a, c, t, g, unknown, or other
  misc_feature (583)..(583): n is a, c, t, g, unknown, or other
  misc_feature (584)..(584): n is a, c, t, g, unknown, or other
  misc_feature (672)..(672): n is a, c, t, g, unknown, or other
  misc_feature (680)..(680): n is a, c, t, g, unknown, or other
aaagctggagctccccgcggtggcggccgctctagaactagtggatcccccgggctgcaggaattcgcacgagaccattacctagaacatcctaatcgaaaaaaacccccggacatttctggtcgcaccctcctccggccctcccagccgctaagccctctggaaccttcgagagctcgatcggatcggagcccctgccatggccgacgaggcgaaggcgaagggtaatgcggcgttctcagccggccgcttcgaggaggcggcgcggcacttcacggacgccatcgcgctcgccccgggcaaccacgtcctctactccaaccggtcggcggcgctcgcctcactccaccgctactccgacgctctcgccgacgcgcagaagaccgtcgagctcaagcctgactgggccaagggctactcccgcctcggcgcggcgcactgggnncctcggcgacgccgccngcgccgtcgccgcatacgagaagggccttgcgctcgaccccagcaacgaagggctcaaggcggggctcgaggacgccaagaaggccgccgccgccccgccgcggcgcggggacgcggnccnngagcccgcgcaaaaaaggcccagccgccccaacgccgaagaaaaacagacccgaaccccccccgcgaacaaacccaccgaacccgacnacacgcanagccggccccaccc

SEQ ID NO: 29747 - DNA, 723 bp, Zea mays
  misc_feature: Ceres CLONE 1404892-F
  misc_feature: Encodes the peptide sequence at SEQ ID NO. 29748
aagctggagctccccgcggtggcggccgctctataactagtggatcccccgggctgcaggaattcgcacgagaccattacctagaacatcctaatcaaaaccctccactcgcctccaaatcttctctctcctttcctcctctcgtctcaccgcatcacctctccctccggcgcgcgcgtccgggtacagcgctagagtcactcaccaccatgcaggcggcggcggcggcgaatggcgcgggcgacgtgcagaagcctcagcagcaaccgctggtggcgggggcgccgcccccaccgccgccggcggccgtggtgccgccccattgggtcgccatgccgttcgcaccgcctcccggggccgcggccatggtgatgcagccgcaccatatggcgcctccgccgccgcagttcgcgccgactcacttcgtgccgttccacgccgtcgcgccgccgcgggcacagtcggtgccagcagcggtcgcactgggttccccggcgccgcatcagcccgggcaggaggagaacaagagcgtctgggtcggtgacctccattactggatggacgagaactacctacacagctgcttcggctacaccggcgaggttgtggcgatcaaagcactccgccaaaagcagattgggtagtccgaaggataccgggttcattccagttctacaccctgctttggactgaaaaagtttccctaagacaacccccgccaaa

SEQ ID NO: 29748 - protein, 144 aa, Zea mays
  misc_feature: Ceres CLONE 1404892-F
MQAAAAANGAGDVQKPQQQPLVAGAPPPPPPAAVVPPHWVAMPFAPPPGAAAMVMQPHHMAPPPPQFAPTHFVPFHAVAPPRAQSVPAAVALGSPAPHQPGQEENKSVWVGDLHYWMDENYLHSCFGYTGEVVAIKALRQKQIG

SEQ ID NO: 29749 - DNA, 712 bp, Zea mays
  misc_feature: Ceres CLONE 1404894-F
  misc_feature: Encodes the peptide sequence at SEQ ID NO. 29750
  misc_feature (480)..(480): n is a, c, t, g, unknown, or other
  misc_feature (540)..(540): n is a, c, t, g, unknown, or other
  misc_feature (648)..(648): n is a, c, t, g, unknown, or other
  misc_feature (681)..(681): n is a, c, t, g, unknown, or other
gctctagaactagtggatcccccgggctgcaggaattcgcacgagaccattacctagaacatcctaatcgaaaaagtttcgacagtcgtcgtcccctctactctcccggcttccgcagaatcccagcttctctggccctctcactccaaacatcgggctccaggccgtctcccgccaacccaaattcgcttcccgccgctccccattaaacccgcttgaaaggtcgcgccctcgagcagagcaacccctgaccacaaatccgatccgtagccgccgtgcctcgatttcgtctcttcccctctgctcgagtacgagcggctactcccggcggcggcggcggcggcggcgatgagcgcggtgagctcgaccatatcaaggagctgatcaagtggggaacagactacatcctcaaaaccttcaattcatctgctgacacgatagacaggattgtcgctcaggtgggtgtaggtgacacctctnaaggcagcagtcagcctaatgaccattactgctggatgagaccagaggacatcgactacnaaaggccagtcaccgagtgtcactcttgctcagatctagcgtctgaaatggctgctgccctggctggcagcttcatagtggtcaaggacagcaaaacctactccgacnagctcgtcaaaggcgcaaaagccctgtacaagntcggaaggctgcagcgcgggcgaacagcccc

SEQ ID NO: 29750 - protein, 65 aa, Zea mays
  misc_feature: Ceres CLONE 1404894-F
  misc_feature: SWISSPROT Homolog: EC 3.2.1.4 Cellulase
  misc_feature (9)..(9): Xaa is any aa, unknown, or other
  misc_feature (45)..(45): Xaa is any aa, unknown, or other
  misc_feature (56)..(56): Xaa is any aa, unknown, or other
MRPEDIDYXRPVTECHSCSDLASEMAAALAGSFIVVKDSKTYSDXLVKGAKALYKXGRLQRGRTA

SEQ ID NO: 29751 - DNA, 614 bp, Zea mays
  misc_feature: Ceres CLONE 1404895-F
  misc_feature: Encodes the peptide sequence at SEQ ID NO. 29752
  misc_feature (354)..(354): n is a, c, t, g, unknown, or other
gctctagaactagtggatcccccgggctgcaggaattcgcacgagaccattacctaaaacatcctaatcgaaaaagaggctaaacccccgtctaaccctgctgccgtgccgcttgccactactccgcttcgttctccgccgcctccccggacgtccggaaacttctagattgaagggggatagccattggcgtcaacgtgtgtgatggaggtcaggggactggggcagctcctggcggcgctggccgcggcgttcttcgtccgcgccatcgcgggacccggccccgccctccttccgccggcggaggacacggaggccgacgaggccgacgcggaggctggcgagggaggtggntggtggtgtgccgcccgtgaccatccggtgggctcgcatcacctgcgcactgaagaacaagcgcggggaagtggcaaggtttctgttgtcaaatgcgtcaggggaagccaaaaccggggaggctgcttggactaatggggccatcgggctttgggaaaaacaactttggtcaatggggttaaagggcagcttgccggatcgtcttccttggaccttttccgggtttctgggataccaagggccgggcccattccggaagg

SEQ ID NO: 29752 - protein, 94 aa, Zea mays
  misc_feature: Ceres CLONE 1404895-F
MEVRGLGQLLAALAAAFFVRAIAGPGPALLPPAEDTEADEADAEAGEGGGWWCAARDHPVGSHHLRTEEQARGSGKVSVVKCVRGSQNRGGCLD

SEQ ID NO: 29753 - DNA, 694 bp, Zea mays
  misc_feature: Ceres CLONE 1404899-F
  misc_feature (474)..(474): n is a, c, t, g, unknown, or other
  misc_feature (484)..(484): n is a, c, t, g, unknown, or other
  misc_feature (528)..(528): n is a, c, t, g, unknown, or other
  misc_feature (614)..(614): n is a, c, t, g, unknown, or other
aaagctggagctccccgcggtggcggccgctctagaactagtggatcccccgggctgcaggaattcgcacgagaccattacctagaacatcctaatcaaaacaaattcaaataactcggccgcaggcagcatccgcggagacgcggagcctccattccccgtctggcttcctcctctggatctagccgacgccgccctcaccctgtcacccaccgacgtcgccgtcgccacctatatcacccaccgcctctgaagaagaagacgcggatccgagggtagttaactgctgaagaagaagagccggtacggagaagacgcggagcagtacgtctccgatctggatgttggtaaggttcatcctgatttgaacggcaagctcactgataacgagttcctgggagggggaagctagacgatttctgttagaggaggaagaagaggatgatgaactcttcttagtacttgtccctgctnatctctcggncatgcaagaagagaaaagagccatagtagcatctgctgttgaancggtgcacatgtaccaagagagggcagcgagatcaatggtgctggaccaagtgtggcagcgagactaatggtgatggactaatgtngatccagaggtttgtgaagtcagcacaccctctggtacgtcggaaatagaggaggaaaaggctgagaaaagcaggttgca

SEQ ID NO: 29754 - DNA, 689 bp, Zea mays
  misc_feature: Ceres CLONE 1404900-F
tacccgcggtggcggccgctctagaactagtggatcccccgggctgcaggaattcgcacgagaccattacctagaacatcctaatcgaaaaattttttaactagtctaaatacttgacagaagaaattcccgttttcgcttgactattcttcttcgtccctgatttttatccccaaactcaccgccggggcacaacaatccagttctcctttcgccggaatctgtccctcctccccctcctccccgcctctgcgggtactggaccaccgtggagcgggcattcatccaggctaggtccattccttcctttgctcgttctcttctccatcgcggaagctccacccgagttgacgccagaagagaatcggtgccctagggtgttctcgcagaattattttcccagaggatttgcagatcgagtcgaaccctatgccccacgttaaggcttgccgccgggctgccccctttaccaccaccgggcggctccctggccccgggcaggggcccagttccccccgggaaattgggatggatggacccggaagggcccgggatccatacccgcccccttggggcccaaagaaggcccccaaccccccgctgggggaaaggggcccgcttcccgttcccctaaaaaaatgggggggttccccgttggcccccaccggggaggtcccggggaaaaaaaa

SEQ ID NO: 29755 - DNA, 678 bp, Zea mays
  misc_feature: Ceres CLONE 1404906-F
  misc_feature: Encodes the peptide sequence at SEQ ID NO. 29756
aaagctggagctccccgcggtggcggccgctctagaactagtggatcccccgggctgcaggaattcgcacgagaccattacctagaacatcctaatcgaaaaacaccccggtcggctagtcccaaggctgctgccgccgcctgctgctaggggatcgcttgctttcctcggaccactctgccgaccacatctacaccgcatcaacggtccttccaagtgagctccaatcccctgtctgtagatggagagggtgctcaaggatgacgccgtcgaggagaagggcgagcgcgccaggatggcatcgtttgttggggccatggcaatctcggatttggtgaagaccacattgggcccaaaaggaatggacaagatcctgcaatcaactggcagaggacgtaatgttactgttacaaatgatggggctaccattttgaagtcacttcacattgacaatcctgctgcaaaggtccttgttgacatctcaaaagttcaagatgatgaagttggtgatgggacaactttctgttgttgttctagctggagaacttttgaaggaggctgagaagttaattaacatggaaattcatccaatgactattattgcagggtacagaaagggctctccaggggggccaaagattctttggctaaaaaaagaccatgggcaaaaaaagaaag

SEQ ID NO: 29756 - protein, 106 aa, Zea mays
  misc_feature: Ceres CLONE 1404906-F
MERVLKDDAVEEKGERARMASFVGAMAISDLVKTTLGPKGMDKILQSTGRGRNVTVTNDGATILKSLHIDNPAAKVLVDISKVQDDEVGDGTTFCCCSSWRTFEGG

SEQ ID NO: 29757 - DNA, 705 bp, Zea mays
  misc_feature: Ceres CLONE 1404907-F
  misc_feature: Encodes the peptide sequence at SEQ ID NO. 29758
  misc_feature (473)..(473): n is a, c, t, g, unknown, or other
  misc_feature (521)..(521): n is a, c, t, g, unknown, or other
  misc_feature (565)..(565): n is a, c, t, g, unknown, or other
  misc_feature (634)..(634): n is a, c, t, g, unknown, or other
  misc_feature (658)..(658): n is a, c, t, g, unknown, or other
aaagctggagctccccgcggtggcggccgctctagaactagtggatcccccgggctgcaggaattcgcacgagaccattacctagaacatcctaatcgaaaaagctagccaagctataccactagaaccagagcacaactcaaagcaatgccgccgcctcctcctcctccgccccactcccacgcttcccatcccgcgccgcatggacgcgagcagcactagcgcgggggcacacagcacggcgagcgggcgggggcgcgacgatggacctgggcgggtcggtggtgatggacgcgggcgcctcggagctgggcctgctcggcggcggatctagcaggctgctcaagcacgggcgggggcccaatgcggcggggggagacgacgacgtgtggggcggcggcagggccaagcagcccaggacagggacagcgcccgtcgtcggctcggggacgtggcggctgccaccaaggcgngcggcggcgccgttcctgctgggctcgtgcagtcccggccacggcggngagcagatgctcagcttctcgtccgccgccgccgccgccgcggnctcgtgcgcctcctccaccgctgcggctgatgggcggcgggccatgccgctgtactacgggaccccggnctcttgctcaggattgagctcggngagcttggacaccacatgcagggggaaatgcccagggtgagggccca

SEQ ID NO: 29758 - protein, 144 aa, Zea mays
  misc_feature: Ceres CLONE 1404907-F
  misc_feature (101)..(101): Xaa is any aa, unknown, or other
  misc_feature (124)..(124): Xaa is any aa, unknown, or other
  misc_feature (132)..(132): Xaa is any aa, unknown, or other
MDLGGSVVMDAGASELGLLGGGSSRLLKHGRGPNAAGGDDDVWGGGRAKQPRTGTAPVVGSGTWRLPPRRAAAPFLLGSCSPGHGGEQMLSFSSAAAAAAXSCASSTAAADGRRAMPLYYGTPXSCSGLSSXSLDTTCRGKCPG

SEQ ID NO: 29759 - DNA, 644 bp, Zea mays
  misc_feature: Ceres CLONE 1404908-R
  misc_feature: SWISSPROT Homolog: EC 3.1.1.11 Pectinesterase
tcgaggtcgacggtatcgataagcttttttttttttttttttgttgcacaaactttgtgtccatgctcctttgcagattcaaacataatggaacaacttgaattgcacatccaaggtctcctatgcagagacataacagactcactgctcactgtctagtttacactggtatacatgacaaagttttggaaactactttgtatagacgaaatgaatcttgaatctgacttctgcgccagtggatcactatacacattcagtggcttgtaaatggtgtcttattctgtgtttatgctgtacgaataaattaatgtggtttgctgtaatcgatctgtctcctgactctcgcgcgtgtgtttgtgtgttattcagacatcaggtgtgagccagtggtatccgttgacgaagctcttgccgaggaaagggcgggcggcgaagtagtcgagctctcgcgcccaggagacgccgtgcacggcgtcgacgccggggccccagttcctgtacatcccgaagaacgccgtcatgctcttgttgctggtgtggtcccagtcatcccagccgccgggcgcgatgaccctgtcgaaataggtgtaggcgtagacgatgcgcgagtactgccccatggcccgccccacgtatagccg

SEQ ID NO: 29760 - DNA, 820 bp, Zea mays
  misc_feature: Ceres CLONE 1404908-F
cggcctctctctcccccgagcccaccccccttcactaacacaacaaaaaaagtggggctccccgcggtggcggccgctctacaatagtggatcccccgggctgcaggaattcgcacgagaccattacctagaacatcttaatcaaaaacccccgcctcgccctccgtcgtctcagcgtatgatgagcatgtgaagagagagaggacgagggtgacgagcgacaacaaagctaatagagtgataggttgacaagacgcattgaagctaaggccacgcataccaaagcaacctcaccatcgctcgcaagctactcgatcaaggacattattgtcgcaacgagctagctaggatccgcgcgttactttcgcgaagcggtgttacatatggctcgcatcctcgtgctggctctggacaccatcgcgagcctcctcctgtcgacggtcgtcgcgagccaccacgcgccggctacgtgcgagtacagaaagcactccggtcaccgctacagggacccgctgcgcggtgttcaaaatcgccggcgaacgtcgcgcggcgcccggtaatttcgatctccatccagcgcggccgtctcactcccgagcccgcagtgggaacaccgcgccgccatgcgtcttcgcaccatccaacgcccggctaggtttcccgcgcggcaaggtgattaggggcgcgaacgacgaagcgcggcgccgtgttcggttaaaatgcgacccgcgatggcggccaccgcgcggcgatcataggttccgcgtcggcctagtgtcggcggatcccagatatagtgccacgccggtctcaacaacag

SEQ ID NO: 29761 - DNA, 682 bp, Zea mays
  misc_feature: Ceres CLONE 1404909-F
  misc_feature: Encodes the peptide sequence at SEQ ID NO. 29762
aaagctggagctccccgcggtggcggccgctctagaactagtggatcccccgggctgcaggaattcgcacgagaccattacctagaacatcctaatcgaaaaccagagccggtagaggcacgccactccgcagtgtcactgcccccccatcacgccgcccgccctttctcggccgttgccgcgagctcgcttcgacccaccgccgatggcgacggcgatgggcgcgatggccgccacctgcatggcctcgatcccggccgccgctacgttccccggtgatctcggcgtcggacgacgccgagcggttgtaccagggtggcgcgccggtgggagacggctgcgtgcgacgccgcctgcccggaggccgttcctgttctcgccgaagggcgtttcggactcgcggagctcgcaaacgtgccttgatccggacgccagcacgagtgttcttgggatcatccttggagggggtgctgggacaaggctgtatccactgacgaagaagagggcgaaaccagcagtgccgttgggcgccaactaccggctcatagatatccctgtcagcaactgtctcaacagtaacgtctccaagatatatgtggtaacacagttcaactctggcttcgtcaacggcacctctcgagggcctatggaaacaacattgccggccacaaaatgcggtata

SEQ ID NO: 29762 - protein, 159 aa, Zea mays
  misc_feature: Ceres CLONE 1404909-F
  misc_feature: SWISSPROT Homolog: EC 2.7.7.27 Glucose-1-phosphate adenylyltransferase
MATAMGAMAATCMASIPAAATFPGDLGVGRRRAVVPGWRAGGRRLRATPPARRPFLFSPKGVSDSRSSQTCLDPDASTSVLGIILGGGAGTRLYPLTKKRAKPAVPLGANYRLIDIPVSNCLNSNVSKIYVVTQFNSGFVNGTSRGPMETTLPATKCGI

SEQ ID NO: 29763 - DNA, 714 bp, Zea mays
  misc_feature: Ceres CLONE 1404911-F
  misc_feature: Encodes the peptide sequence at SEQ ID NO. 29764
  misc_feature (556)..(556): n is a, c, t, g, unknown, or other
aaagctggagctccccgcggtggcggccgctctagaactagtggatcccccgggctgcaggaattcgcacgagaccattacctagaacatcctaatcgaaaaagatttggatgtggactagatgcttaaggtgtgaacgtgaaagtggggtccccagatcatcacgaagggtgataatgtcagctgaagcacactacctttcatttgggaagttccttgaacttagtttttcaagccactcaaccgctagaaggctgccaatatgcgggcattcactcaatacggattgtctgcgctttttttgggttgggctccaaagttgcaatgttccagtattcctcagtcgaaatttacaatgcctgcaaaccacagcctactcttgagattcacaaccccgatatgcacaaagatgccccaaggttgctgccctcgtgtttcgtgctctgattgttgagtcttcaatgagagctgattccagttatatagaggtgaacaagcttttgattatttcttttgttaatttggtgcaacatatagaggtgaacaagcttattanaggaagatccttgtacaatcaagagttcatacaatagatgaaacgatattgtgattctctcaatggtggcttcatgagcaagcaatcattcaccttgttcactaaaatttcagactgtagctcagataaggctttgagcattccttgggagtattatg

SEQ ID NO: 29764 - protein, 90 aa, Zea mays; identical to SEQ ID NO: 11994
  misc_feature: Ceres CLONE 1404911-F

SEQ ID NO: 29765 - DNA, 710 bp, Zea mays
  misc_feature: Ceres CLONE 1404913-F
  misc_feature: Encodes the peptide sequence at SEQ ID NO. 29766
  misc_feature (375)..(375): n is a, c, t, g, unknown, or other
  misc_feature (536)..(536): n is a, c, t, g, unknown, or other
aaagctggagctccccgcggtggcggccgctctagaactagtggatcccccgggctgcaggaattcgcacgagaccattacctagaacatcctaatcgaaaagtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggngcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcggggggtccccggagacgatccgcgacccgcgcgggnttcggccgggaaggtctacacccgcgagggcaactgggacctgctgggcaaacaactcccccgtctttctcatccggcgacgggattaagtttccccgaagggggaccacgcggttcaaagcccaaaccggcggtcgccacggggcaggagaaactgggcggggggtccacttt

SEQ ID NO: 29766 - protein, 179 aa, Zea mays
  misc_feature: Ceres CLONE 1404913-F
  misc_feature (18)..(179): Pfam Name: Catalase Pfam Description: Catalase
  misc_feature: SWISSPROT Homolog: EC 1.11.1.6 Catalase
  misc_feature (122)..(122): Xaa is any aa, unknown, or other
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGVPGDDPRPARXSAGKVYTREGNWDLLGKQLPRLSHPATGLSFPEGGPRGSKPKPAVATGQEKLGGGST

SEQ ID NO: 29767 - DNA, 829 bp, Zea mays
  misc_feature: Ceres CLONE 1404915-R
gggttgtttcgattgggtaccgggccccccctcgaggtcgacggtatcgatattttttttttttttttttggagagaacaatagccaagtctcttgatacatcagattaaagcatgtttagatttccttctctaaacttgagaggtaaagctcagttagatctaagctttggtcaaccttagcattagagctttatagttcgaaagtgagctggagggctctgaaagttttgaagctctaaagtttggaggggatccgaacagcccttggcgaggaaactttcacgtgagcttcctggtagcaaattgtcaagaagccagctggttttggttcctaaaggtgaacatccccttgtaccttgcgggggaaaactggagcgacagcaagggaaatggcttctctttgccacggccggcagtacatttgattggatcccgtgtcttgctgtactcgaaccatctcttggggcgtgacattttcagctaccaccaagggaaatatcttggcagattcaggaacgagtctactgttgatgccaccaacgctgctatgcggcaccaggtggaggaccactggtaatagctctgctgctgctggcactactgccgcaagaatgcctcttgtgtcattctgagcgacctgccttgctactactgtggcgagaatgactctcggaccctttccgtgtgctggcactgctgctgcttggaggtcttgtttctaggacttgcccttactgtcaactgccattggttgacactttcaccgggctgtcgagtatccaagtggataaggatgggttcaggccacattccgggggccccaagaa

SEQ ID NO: 29768 - DNA, 783 bp, Zea mays
  misc_feature: Ceres CLONE 1404915-R2
  misc_feature (1)..(1): n is a, c, t, g, unknown, or other
nccgattgggtacgggcccccctcgagtcgacggtatcgatattttttttttttttttttgaagagaacaatagcccaatctttgatactatcgattaaagcatgtttagatttccttctctaaacttgagtaggtaaagctcagttagatctaagctttggtcaaccttagattagagctttatagttcgaaagtgagctaaaatgctctgaaattttcgaagctccaaagtttggaggggatccgaacagcccttgtgcaaggaaactttcacgtgagcttccggatagcaaattgtcaagaagccagttggctctggttcctaaacgtgaacatccccttgtaccttgcgtgggaaaactggcgcgacaccgatgccaatggcttctctttgccacagctggtagtacatttgattggtatcagcgtctggagtcctggcaccatctcttgcggtgtgacatttgcagctaccacctatggagatatcttgccagactcaggaaacagtactgctgatgatgcaccaacgctgcttggggcgcctgatgggaggacactgataaatcctctggccccgatggaactacagaccgcagaaagcctcttgggccattttgcgggcacctccctggataaccccggggcgaaaaaggccattttggaccctatcccttgtagttggcccggccaccccttgaaggccttgttttttggaatttcccctaagtgaaaaccccctggggggccatttccccggggggggacccccccatgttaaa

SEQ ID NO: 29769 - DNA, 585 bp, Zea mays
  misc_feature: Ceres CLONE 1404918-F
  misc_feature (305)..(305): n is a, c, t, g, unknown, or other
aaagctggagctccccgcggtggcggccgctctagaactagtggatcccccgggctgcaggaattcgcacgagaccattacctagaacatcctaatcgaaaaacacacggaagaagccactagctctccgctctcgcctctcggccttctccttgtgccgccgaacaccctcacaagagtcggcctctcgatttctcagtccagccgcagcagcccccttccctccctcctccatcaggtgttgcctccccgcagatcccaagtcgggaatttcggtccttcgtccccaaacccacaatcccggntggcaattcttttggggttttgttccaggggacccaaagcctttacgggtggaaggggggtgggcctaacggttccgtcttggggggttccaagccttggagtccacgaaataaattttgggaatgcaaacccaaaaaaacacgggtttggaagatttttccaaaccctgtccctttttcccacggccgttaagggggttccccccccccgggggggagaaaccggggggggggggggggcggcccccctttggggggggaaaaaacctaccgggggggg

SEQ ID NO: 29770 - DNA, 678 bp, Zea mays
  misc_feature: Ceres CLONE 1404919-F
  misc_feature: Translation starting site: 500
  misc_feature (440)..(440): n is a, c, t, g, unknown, or other
aagctggagctccccgcggtggcggccgctctagaactagtggatcccccgggctgcaggaattcgcacgagaccattacctaaacatcctaatcgaaaaaccaacccttgtagtctcagtcaatctgtagattgagactacgatgagcctgtcaccgctcgactcctcctccccgccggccgcggctgcggctgcatgctacggaggtgcccctcgccccgggcttccgcttccaccccaccgacgaggagctcgtctcctactacctccgccgccgcgtcctcggccgccgcctccgcgtcgacgccatcgccgagatcgacctctaccgcctcgagccctgggacctcccctccctctcccgcatccgcagccgcgacgccgagtggtacttcttcgcccgtctcgaccgcaagaacgccggcgctgacgccgtganccgagacgtacccgtgaacaggaccactcgcgctacgccgagggtgcactgggatgaccatggacgaggaccgcgatgcgttccagcgcgacgagcccgtcgcaaagaagaagatcctagtattccaggccgtccaggcggctaaaggggaaaggggcccagtgggggacgcgtggaggtgccgcctcctagatggctgaggagcctcagggtttgccgggggtattggggaaaccac

SEQ ID NO: 29771 - DNA, 719 bp, Zea mays
  misc_feature: Ceres CLONE 1404921-F
  misc_feature: Translation starting site: 296
  misc_feature (706)..(706): n is a, c, t, g, unknown, or other
  misc_feature (719)..(719): n is a, c, t, g, unknown, or other
aaagctggagctccccgcggtggcggccgctctagaactagtggatcccccgggctgcaggaattcgcacgagaccattacctagaacatcctaatcgaaaaaaaaccgaaaaggaggacaaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgatctccggcgaggtgccggacgagccggtcgtgtcgaagaagtcggggctactcttcgagcggcggctcatcgagcgctacattgaggaccatggcaagtgtcccgccaccaaggaggacctcaccatggatgatatcgtgccggtcaagaccaacacgatcgtgaagcccaggcctttgcaggctgcaagcattcccaggactccttgggatttttcagaacgagtgggatgctctcatgctttctaattttgctttggagcagcagcttcacacagcaagacaagaacttagtcatgcactctaccagcatggacgctgcctgccgtgttatagcccagattaaagaaaggaaagagatgacgctaagagcacttttggctcaagctgagagacaantctcctgcgtcan

SEQ ID NO: 29772 - DNA, 731 bp, Zea mays
  misc_feature: Ceres CLONE 1404922-F
  misc_feature: Encodes the peptide sequence at SEQ ID NO. 29773
  misc_feature (416)..(416): n is a, c, t, g, unknown, or other
  misc_feature (455)..(455): n is a, c, t, g, unknown, or other
  misc_feature (462)..(462): n is a, c, t, g, unknown, or other
  misc_feature (511)..(511): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (537)..(537): n is a, c, t, g, unknown, or other
  misc_feature (538)..(538): n is a, c, t, g, unknown, or other
  misc_feature (550)..(550): n is a, c, t, g, unknown, or other
  misc_feature (563)..(563): n is a, c, t, g, unknown, or other
  misc_feature (618)..(618): n is a, c, t, g, unknown, or other
  misc_feature (646)..(646): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccattacctagaacatcctaatcgaaaactcttgatccgagccgccaccaaaccctaactatctaaaacccccgtctcgctgtccgatggccgccgcctcgccgccgccctccccaccccacgcaaagcgccccaagatgtcctcctcctccgacccggaagccgatgctgagcccacctcggcctccgccgccgttgagggcgccgatcctgcgcagcgtcgtcccaggtacaagcgccgcaaggtcgccatccttctcgggtactgcggcgcggggtatcagggcatgcagaagaatccgggcgcgcgcaccatcgagggggacctcgaggaggcgctcntactcaggcgggcgccgtgcccgaaggccgaccggtcgncgccgcncccgttacgaattgggcacgtgctgcgcgcaccgacaagggcgtcaggncgcggnnnnccaggtgggtgtccggnncgcttctacgtncgacccgccgggnctccatcgaatcgcttgaacgcgcagcttcgcgccgcagatccgcgccctacggnttacgtgcgcgttaaccactcatcaaancgcgaaaaaagtctgggnacccggcgggaaggaaccctgtatctggcttcccggaatttgttcttgaccccagcgcacacccgaa

SEQ ID NO: 29773 - protein, 173 aa, Zea mays
  misc_feature: Ceres CLONE 1404922-F
  misc_feature: SWISSPROT Homolog: EC 5.4.99.12 tRNA-pseudouridine synthase I
  misc_feature (69)..(69): Xaa is any aa, unknown, or other
  misc_feature (82)..(82): Xaa is any aa, unknown, or other
  misc_feature (84)..(84): Xaa is any aa, unknown, or other
  misc_feature (103)..(103): Xaa is any aa, unknown, or other
  misc_feature (109)..(109): Xaa is any aa, unknown, or other
  misc_feature (118)..(118): Xaa is any aa, unknown, or other
  misc_feature (136)..(136): Xaa is any aa, unknown, or other
  misc_feature (145)..(145): Xaa is any aa, unknown, or other
MSSSSDPEADAEPTSASAAVEGADPAQRRPRYKRRKVAILLGYCGAGYQGMQKNPGARTIEGDLEEALXLRRAPCPKADRSXPXPLRIGHVLRAPTRASGRGXPGGCPXRFYVRPAGXPSNRLNAQLRAADPRPTXYVRVNHSSXREKSLGTRREGTLYLASRNLFLTPAHTR

SEQ ID NO: 29774 - DNA, 730 bp, Zea mays
  misc_feature: Ceres CLONE 1404928-F
  misc_feature: Encodes the peptide sequence at SEQ ID NO. 29775
  misc_feature (430)..(430): n is a, c, t, g, unknown, or other
  misc_feature (467)..(467): n is a, c, t, g, unknown, or other
  misc_feature (508)..(508): n is a, c, t, g, unknown, or other
  misc_feature (622)..(622): n is a, c, t, g, unknown, or other
  misc_feature (675)..(675): n is a, c, t, g, unknown, or other
  misc_feature (712)..(712): n is a, c, t, g, unknown, or other
aaagctggagctccccgcggtggcggccgctctagaactagtggatcccccgggctgcaggaattcgcacgagaccattacctagaacatcctaatcgaaaaactctccaatcacgccgcctagtctcaccgcaacatggcgaccttcaccggggcctcctccctctccctccacttctaccacccgaactcccactcccgccaaacatccgcccaggggtccaccggcagctcgcacctccacctgcatccgcgcgccagtcgcgcgagctgcgcctcttccgacacgacggccacgaagcaacgccgcccagtgcaggagaacatccgcgaggaggtggcgcgactcccaggcccggtccagggttactctgcgtggtacgagaccttcccgccggagaccgacggtgacccgaacgagcgctactcnctggacgaggtcgtctaccgctgcagtgtcggggggnctgcctcgacgagcgccacgacatgggaggctgtgccccgncctacccgggagtcctactggcgatgagctcttcgagctcccgcgatcggccgcaccgcctaggcctagcggtgtcggcgagctggaccaaaaaaaaaggagtttgtggctcgnccgaagatcgacgtccgaccacatcgtgtccgcctcttcgagggccaactcgnacgtcctttctgggcagaagcgctctcggacgcgagncaacttcgagcgggaata

SEQ ID NO: 29775 - protein, 132 aa, Zea mays
  misc_feature: Ceres CLONE 1404928-F
  misc_feature: SWISSPROT Homolog: EC 4.2.3.1 Threonine synthase
  misc_feature (111)..(111): Xaa is any aa, unknown, or other
MATFTGASSLSLHFYHPNSHSRQTSAQGSTGSSHLHLHPRASRASCASSDTTATKQRRPVQENIREEVARLPGPVQGYSAWYETFPPETDGDPNERYSLDEVVYRCSVGGXASTSATTWEAVPRPTRESYWR

SEQ ID NO: 29776 - DNA, 721 bp, Zea mays
  misc_feature: Ceres CLONE 1404929-F
  misc_feature: Encodes the peptide sequence at SEQ ID NO. 29777
  misc_feature (381)..(381): n is a, c, t, g, unknown, or other
  misc_feature (440)..(440): n is a, c, t, g, unknown, or other
  misc_feature (445)..(445): n is a, c, t, g, unknown, or other
  misc_feature (446)..(446): n is a, c, t, g, unknown, or other
  misc_feature (481)..(481): n is a, c, t, g, unknown, or other
  misc_feature (516)..(516): n is a, c, t, g, unknown, or other
  misc_feature (564)..(564): n is a, c, t, g, unknown, or other
  misc_feature (565)..(565): n is a, c, t, g, unknown, or other
  misc_feature (569)..(569): n is a, c, t, g, unknown, or other
  misc_feature (581)..(581): n is a, c, t, g, unknown, or other
  misc_feature (582)..(582): n is a, c, t, g, unknown, or other
aaagctggagctccccgcggtggcggccgctctagaactagtggatcccccgggctgcaggaattcgcacgagaccattacctagaacatcctaatcgaaaaaaccaagaacaaaccattgttggacgcgttcccctcctgcacgcaacctcatctcgtcctccagatcctggatggccgtcctccttgataccttgcctcgcgagtgctctcggtgagctactttgttttgatttatcaggaaatccgtttgcttcatgttatgcaggctcagatctgattgctggattcggcatcttacgggcttgaatagagctaggactgggagaaaacaacaaacccgcgttggatcctgtatcgatctggagaaatttctaagtncgtcgtcgtcgtcgtcgttcgggttcggagcggatctgaggcgacgatggctggagggncgcgnnaatctctttgggtctgcagtcctgctttcactcgnaatggatgatgtctctgcgctgataaataattggnatcatttcgatatttattagtagatctatgagaatgcccgcctggaannagcngagtaagctgcnncatgtaaaaggcctgcttgggtcgacagcaaaaagaaaaaaaagatggcctttcccaaaggaggctttggcaatgagggtgccctcgcagggcggcccgtatttaaaaaaaatttataatgtgtgcggcggaagaaaat

SEQ ID NO: 29777 - protein, 92 aa, Zea mays
  misc_feature: Ceres CLONE 1404929-F
  misc_feature (42)..(42): Xaa is any aa, unknown, or other
  misc_feature (63)..(63): Xaa is any aa, unknown, or other
  misc_feature (75)..(75): Xaa is any aa, unknown, or other
  misc_feature (87)..(87): Xaa is any aa, unknown, or other
MLCRLRSDCWIRHLTGLNRARTGRKQQTRVGSCIDLEKFLSXSSSSSFGFGADLRRRWLEGRXNLFGSAVLLSLXMDDVSALINNWXHFDIY

SEQ ID NO: 29778 - DNA, 709 bp, Zea mays
  misc_feature: Ceres CLONE 1404932-F
  misc_feature (472)..(472): n is a, c, t, g, unknown, or other
aaagctggagctccccgcggtggcggccgctctagaactagtggatcccccgggctgcaggaattcgcacgtgaccattacctagaacatcctaatcgaaaagccacaacatcacgaaaggaccggatcttggtgagctcgagggtacttgacgcggttcttcctatcgcggcaggtgaccaggacctctatcccctccttgatggaggtcggggactgggatggaggccagggactcgacggcggtgggcctggaggtggcggcaaaggcctcggcgtcgacggccgcggcggtgcgcatttctcggctcgttcattcttgtgccctccttcgattacttcatttcgtcgcgtcccaaatcggtcgatggaaaatggaatctcgatggcttttgttaaatctggattgctatgcatgtctagcgagcacttgggatttttggtacagtgagattggtagccgcacatgggnaatctcgatggcttttgtaaaatctggattgctatgcatgtctagcgatacactttggatttctggtaccgtgagattggtagttgcagatggatacagggggccttagtggagtggcagcagaagactgaaatatgggggtggacacatcttttcatctggacgttgaagcaatgtcttcgttcccttgggggtggggcggttaatgcttttttgggaacaggtggtctggcattt

SEQ ID NO: 29779 - DNA, 837 bp, Zea mays
  misc_feature: Ceres CLONE 1404933-F
  misc_feature (39)..(39): n is a, c, t, g, unknown, or other
cacattccaccgcttatccgtccccgaaccccccccgtngtcgtcccacagctggggctccccgcggtgggggccgctctcccaatagtggatcccccgggctggcggtttccccacgagaccattacctagaacatcctaatcgaaaaaggttcctctcccccgttgcgcaacgcgctttcccccacttcatccgcctcggcgccgtggcttagatcgcgctggcgctcctcctcctgctggccgtggcgaggtccgcgccggccagcggtgcggagtcacctggatctcgacctgggctgcctctcctctgcagaacgccggagggagtgccgtgccacgtagcccgagtgcctcgtccaggagtcggatgaggaggcccccgacttggccggatcccaccgccgcgcgctctacgaaggcgggtagttcacctacggcgcgctgaggagtgacaacccccccctgctcccgccgctggagcccgctactaccattgcctgccgggtagcgcaaggaccatcccctatcaaacggcgcccggctaacgaatccacccgcctgccctccccctcgaagtggtctcccgccccccgtccctcctgactttggttaccggtttgggtctgccaaaagggatgccggtatcttttccccccgcccatgcctttccccccacccatgtccgccatcaagccgcccccccgcccaccgtcaattgggtgttacccacagatagtggctccaccccccaggcgtttccgcgctttctatcgaaatcaaccccctgtttctgctccccgcaatttctggttttctcgcccaccctacagcccg

SEQ ID NO: 29780 - DNA, 717 bp, Zea mays
  misc_feature: Ceres CLONE 1404938-F
  misc_feature: Encodes the peptide sequence at SEQ ID NO. 29781
  misc_feature (273)..(273): n is a, c, t, g, unknown, or other
  misc_feature (417)..(417): n is a, c, t, g, unknown, or other
  misc_feature (472)..(472): n is a, c, t, g, unknown, or other
  misc_feature (669)..(669): n is a, c, t, g, unknown, or other
aaagctggagctccccgcggtggcggccgctctagaactagtggatcccccgggctgcaggaattcgcacgagaccattacctagaacatcctaatcaaaaactcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcnggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtncatcgtgctggtgtgcgggcgccgagctgggcagcctcagccgcgacgagctggncgcaaggtgttgggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgcccaaggcggagttcatcgacctggcgcgcaagtccggncaggtcgacgaggacagcctgggcgttccagtcgcgcctgctggacaa

SEQ ID NO: 29781 - protein, 169 aa, Zea mays
  misc_feature: Ceres CLONE 1404938-F
  misc_feature: SWISSPROT Homolog: EC 2.3.1.119 Icosanoyl-CoA synthase
  misc_feature (88)..(88): Xaa is any aa, unknown, or other
MAREEQALLSTEIVNRGVEPSGPDAGSPAFSVRVRRRLPDFLQSVNLKYVRLGYHYLISHGVYLATIPVHRAGVRAPSWAASAATSWXQGVGGEATYDLATVLAFLAVLAFTISVYIMSRPRPVYLIDFACYKPADELKVPKAEFIDLARKSGQVDEDSLGVPVAPAGQ

SEQ ID NO: 29782 - DNA, 714 bp, Zea mays
  misc_feature: Ceres CLONE 1404941-F
  misc_feature (349)..(349): n is a, c, t, g, unknown, or other
  misc_feature (359)..(359): n is a, c, t, g, unknown, or other
  misc_feature (360)..(360): n is a, c, t, g, unknown, or other
  misc_feature (368)..(368): n is a, c, t, g, unknown, or other
  misc_feature (371)..(371): n is a, c, t, g, unknown, or other
  misc_feature (392)..(392): n is a, c, t, g, unknown, or other
  misc_feature (397)..(397): n is a, c, t, g, unknown, or other
  misc_feature (401)..(401): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (425)..(425): n is a, c, t, g, unknown, or other
tggagctccccgcggtggcggccgctctagaactagtggatcccccgggctgcaggaattcgcacgagaccattacctagaacatcctaatcgaaaactacatgccaaatctggaggcaagagaaccgggagagggcgtgttgggttgctcgtcgtgatcccggacggcaatacctgcccttgcctacttgccactgcttgcgtacactgatgtccttgttcaatcccctctagaaagtagaaacattgcttaattggcttggctattgctgttagctccacacaaaagagagaaccggcggcgagctaggagctagccatggacggacacggcgcggtctcaccgtgnagcgtgctanngcgggcgncgnctgtgctgctccctgtgtggncgtcncagntgctggaggnnnccctgggtggcngcccccgcgcgtgacccgtgcgctgaggccgaaggccctgaggggcaccccggtacggctcctctggggggacctcatcgaggagaagggtttcgcgggggggccttggaaagcccggtcccgggggaatggcaaaagaattcgtcccttggggggggcttttctttcccggggcctcaaaagaaggggaaggtttcgttaattggtgtggggccccccccaggggttttaatcccgtccccattttttcccgaaaaaggttggaaaaaaaaggggggcaaccttggag

SEQ ID NO: 29783 - DNA, 738 bp, Zea mays
  misc_feature: Ceres CLONE 1404942-F
  misc_feature: Encodes the peptide sequence at SEQ ID NO. 29784
  misc_feature (523)..(523): n is a, c, t, g, unknown, or other
  misc_feature (657)..(657): n is a, c, t, g, unknown, or other
  misc_feature (664)..(664): n is a, c, t, g, unknown, or other
  misc_feature (683)..(683): n is a, c, t, g, unknown, or other
  misc_feature (684)..(684): n is a, c, t, g, unknown, or other
  misc_feature (703)..(703): n is a, c, t, g, unknown, or other
  misc_feature (721)..(721): n is a, c, t, g, unknown, or other
  misc_feature (723)..(723): n is a, c, t, g, unknown, or other
aaagctggagctccccgcggtggcggccgctctagaactagtggatcccccgggctgcaggaattcgcacgagaccattacctagaacatcctaatcgaaaaccatccatccatccagttagttagttagtaagttagttgagggagaagaagcaggggaggggaagcgatgagcaacatgctgcgggctcgccgccgcctggacctcctgcaggtggtgctcttcgccgctgtgctcctcgtcgtcgtcgccgacgccggcgtgacgagccagtaccggcggaagctggaggcgacggtggagatgccacgggacgccgacgtcttccgcgtcccgccggggtacaatgccccgcagcaggtgcacatcacgctgggtgaccaggagggcacggcgatgatcgtgtcgtgggtgacggccaatgagctgggcagcagcaccgtcatgtacagcgaggcgtcgccggacccggagaagatggagctccgggcggagggcacccacacgcgctacgactacttncactacacctccggcttcatccaccactgcaccctcacaaacctcaagcatagcaccaagtatacaccgccccatgggggttcgggcacacgggtgaggagcttctgcttcaccacgcaacccatgcggggggncctgagntggccctttcaagttcggnnctcattggcgaccttgggnccagaacgtttgactccnancacgacgctgtcgca

SEQ ID NO: 29784 - protein, 189 aa, Zea mays
  misc_feature: Ceres CLONE 1404942-F
  misc_feature: SWISSPROT Homolog: EC 3.1.3.2 Acid phosphatase
  misc_feature (118)..(118): Xaa is any aa, unknown, or other
  misc_feature (163)..(163): Xaa is any aa, unknown, or other
  misc_feature (165)..(165): Xaa is any aa, unknown, or other
  misc_feature (172)..(172): Xaa is any aa, unknown, or other
  misc_feature (185)..(185): Xaa is any aa, unknown, or other
MSNMLRARRRLDLLQVVLFAAVLLVVVADAGVTSQYRRKLEATVEMPRDADVFRVPPGYNAPQQVHITLGDQEGTAMIVSWVTANELGSSTVMYSEASPDPEKMELRAEGTHTRYDYXHYTSGFIHHCTLTNLKHSTKYTPPHGGSGTRVRSFCFTTQPMRGXLXWPFQVRXSLATLGPERLTPXTTLS

SEQ ID NO: 29785 - DNA, 677 bp, Zea mays
  misc_feature: Ceres CLONE 1404943-F
  misc_feature: Encodes the peptide sequence at SEQ ID NO. 29786
  misc_feature (580)..(580): n is a, c, t, g, unknown, or other
  misc_feature (581)..(581): n is a, c, t, g, unknown, or other
aaagctggagctccccgcggtggcggccgctctagaactagtggatcccccgggctgcaggaattcgcacgagaccattacctagaacatcctaatcgaaaaacagaaccctgcaactgcaagctaaggagagtgtgatcaccaacagctagtgctagtcccccttccttccatccatccatggcatgcgtcagcaccttccagagctgccccattgccagaagagcaaagatcaacacgaggtccaggggctgcagcagtagcgtggcgaaggggtcatcaccaccagccttccagttccagtgcagggcgtcgactttcgcggcggacaccagcctccggctcgagctggacgagaaccccgaggcgatcatctcgggggcgtggcccgggaactgctccctcctcagctacgacgacctccgcgcctacctcgagtcgcaggagacggcggcccaggcagacggtcagcagcgcggcgtggcgctcctgagcgagaccatgtccacaccccgtgctggtggccacagcagaccagaccctggagggacgtcgagtgcactttcgagggccgtgtcgnnggctttccggtcgtcgacagcggctcagaatggggtcgggggtgatcgtcaagaaacgaccgggcaagagccctctcatgggtccaagacgaaaaa

SEQ ID NO: 29786 - protein, 165 aa, Zea mays
  misc_feature: Ceres CLONE 1404943-F
  misc_feature (134)..(134): Xaa is any aa, unknown, or other
MACVSTFQSCPIARRAKINTRSRGCSSSVAKGSSPPAFQFQCRASTFAADTSLRLELDENPEAIISGAWPGNCSLLSYDDLRAYLESQETAAQADGQQRGVALLSETMSTPRAGGHSRPDPGGTSSALSRAVSXAFRSSTAAQNGVGGDRQETTGQEPSHGSKTK

SEQ ID NO: 29787 - DNA, 720 bp, Zea mays
  misc_feature: Ceres CLONE 1404945-F
  misc_feature: Encodes the peptide sequence at SEQ ID NO. 29788
  misc_feature (622)..(622): n is a, c, t, g, unknown, or other
  misc_feature (720)..(720): n is a, c, t, g, unknown, or other
aagctggagctccccgcggtggcggccgctctagaactagtggatcccccgggctgcaggaattcgcacgagaccattacctagaacatcctaatcgaaaaagaaaatacgcacctgctcctcactcttctttatatttttttctccatttggcaacttttgcttgtcgttcatgtatatgcatgaccctttcacacatatgatcagaagataagcacatgcaagacgatctcgcgtggatatgatgcatggatcagacctaacctctatatcatcaccaaacgctcgtagatgatgctatacaattccatgattaaattatatataagtaaaaaaaaaagaaccgtacgtgcatacataaaattaagaattaatggctgccaatggacgacatatgcatggacaggtaagctggtgatcccactgaaccgggaggcgcccaacttccggtccatgatcgggatgatcgacgggaggacggagctgaagccgctgccagccagcggcggcccagaggaccggcggctgcaggtgtggggccgtctccgccgccgccggatcccgcggcgatgactactacttggacgtggagagcgccagcgcggcggtgccgctggtgcancagcagtaacgtgaacgggcggttcgtccgcctccgcacctctccggtggtcgagttgagcatgatggccgccaagatcgcctacgagaaacgcgctn

SEQ ID NO: 29788 - protein, 93 aa, Zea mays
  misc_feature: Ceres CLONE 1404945-F
MMLYNSMIKLYISKKKRTVRAYIKLRINGCQWTTYAWTGKLVIPLNREAPNFRSMIGMIDGRTELKPLPASGGPEDRRLQVWGRLRRRRIPRR

SEQ ID NO: 29789 - DNA, 668 bp, Zea mays
  misc_feature: Ceres CLONE 1404948-F
  misc_feature: Encodes the peptide sequence at SEQ ID NO. 29790
  misc_feature (439)..(439): n is a, c, t, g, unknown, or other
  misc_feature (440)..(440): n is a, c, t, g, unknown, or other
tggagctccccgcggtggcggccgctctagaactagtggatcccccgggctgcaggaattcgcacgagaccattacctagaacatcctaatcgaaaaagggccggacgacggggacagacagcggtgtcgcgggggcacctgcttcccaacgccgtccgcacctgctgccctgtcgtccgccctccttcccttctcctcccctccaactgtttcctcaacctcccgacccaaccacggccgtgcccgccaaggcgccaaccgcacagtatcgctgtctcttggacattgcagcagcagctggggtgctgacgtgctgtgggtggttctgttgtccatggcgcggaagcatcagcatgttgccatatttaccacagcgtgcttgccgtggatgactgggactgcggtaaaccactgtttcgggctgcataccttgccagnngctgagatgggagtcacgctggtgttgccttggctgtccagggggatcaggagctcgtttatcccaacagatgaggttcagttttgcgccagagcaggaaactatgtgcggcggtggcttgaggaacggactgggcttgttgccgaagtttgacataaagtctaaccctggaaagtttcaactggaaaaagagtattctaactggtggagaaatcaagcaaacaaaag

SEQ ID NO: 29790 - protein, 85 aa, Zea mays
  misc_feature: Ceres CLONE 1404948-F
  misc_feature: SWISSPROT Homolog: EC 2.4.1.241 Digalactosyldiacylglycerol synthase
  misc_feature (35)..(35): Xaa is any aa, unknown, or other
MARKHQHVAIFTTACLPWMTGTAVNHCFGLHTLPXAEMGVTLVLPWLSRGIRSSFIPTDEVQFCARAGNYVRRWLEERTGLVAEV

SEQ ID NO: 29791 - DNA, 711 bp, Zea mays
  misc_feature: Ceres CLONE 1404950-F
  misc_feature: Encodes the peptide sequence at SEQ ID NO. 29792
aaagctggagctccccgcggtggcggccgctctataactagtggatcccccgggctgcaggaattcgcacgagaccattacctagaacatcctaatcgaaaaccgcacacctctgacctccctccgtccatctcatcatcatctttgtccctctcgcgcaattcgccgaacacaccgcgcgcgcctcgcctcccagcgacggccgcctcgacggccaatgctggcggcgggatgagcgtggaggaggaggtggagcgcggggaggaggacctgttctacgagtcgctcgaccgcatcctctcctcgtcgggctcctccacctctgcctcggacgacgatggcgccgaccgcccgcgccaccgccgcagctgcgatgcgccagccgcagcggccctcgacctgtgaccctcccagccggcgcccgtccatgagcggcggagccggctgctccatctcatggggctcaccggcgatccttccctcgccggatttgagattgcccggtccgcctccggagaagccgagggaccgcccccggcctctctcgtctcgtggtcgaggtcaggcgttgctgccctgctctccgccgtgaagacgtgctcgggggctggcgactgtcctctgcttgtccgacgggcccaagttggacacgcacgacgccttttccctgataggccacaacggaaaggtgtaacttgccctggagtcgca

SEQ ID NO: 29792 - protein, 57 aa, Zea mays
  misc_feature: Ceres CLONE 1404950-F
MSVEEEVERGEEDLFYESLDRILSSSGSSTSASDDDGADRPRHRRSCDAPAAAALDL

SEQ ID NO: 29793 - DNA, 768 bp, Zea mays
  misc_feature: Ceres CLONE 1404951-F
  misc_feature: Encodes the peptide sequence at SEQ ID NO. 29794
  misc_feature (31)..(31): n is a, c, t, g, unknown, or other
  misc_feature (768)..(768): n is a, c, t, g, unknown, or other
cgggctggagctcatcgcggtggcggccgcnctacactagtggatcccccgggctgcaggtttcgcacgagaccattacctagaacatcctatcgaaaaacacggatgcccctagatctgcttagcatatgatgctagggtttcgtggtccctcactcaacgaatccgagccgtatcggggggtgcggggagtcaccggcgtcccggcgttgcctgggctgggatacagttgcaatggccgctgtaactgatgagacaggtaagattgaggctttgacatctgctggagcctttgtggagcgtggcattcaggacgcatgtgatgatgcctgcagcatttgccttgagcgtttctgggagagtgacccttctgcattaactggttgcaacatgacttccgtctccaaggcattcctgaatgggccccatagaagttccacaggccccacgggggtggcagccctattactatgaagggatccccaccagcccaggagcttggtttggggtaccaggagcgggtgggggcaacatttggaagtagttgaagatgccgaacgaggattaattggtgagtgtcccggggtctggggggagtgttacctttccgcccctttgccttgtttgggaaaggggttctttacattgtgtggaggcccgtaaatggccccacatctagctcgggtacgccctttgtaagagagcggggcgccctctgccttttttaataaaaatggcgggctccggggcgccggttactaaggctan

SEQ ID NO: 29794 - protein, 79 aa, Zea mays
  misc_feature: Ceres CLONE 1404951-F
MAAVTDETGKIEALTSAGAFVERGIQDACDDACSICLERFWESDPSALTGCNMTSVSKAFLNGPHRSSTGPTGVAALLL

SEQ ID NO: 29795 - DNA, 643 bp, Zea mays
  misc_feature: Ceres CLONE 1404953-F
  misc_feature: Encodes the peptide sequence at SEQ ID NO. 29796
  misc_feature (342)..(342): n is a, c, t, g, unknown, or other
  misc_feature (343)..(343): n is a, c, t, g, unknown, or other
aaagctggagctccccgcggtggcggccgctctagaactagtggatcccccgggctgcaggaattcgcacgagaccattacctagaacatccgaatcgaaaaatcgcagaaattctccgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaaggccaaggcggagaagcggctacctgcgggcaagtccgccggcaaggaggcgnncgacaagaaggggaggaagaaggcgaagaagagcgtggagacctacaagatctacatcttcaaggtctccgttctcccccaattcgccttcacctcgccgcttcctccttgaccgccaccgttgacgtcgtcttccggcgaggtagctcgccggaagacctcacctggacttttccgacgcaccctccacacactctttaaccctccggaatggccgcctgcttctagctcgtcgacgccccaatctccgcttgcttcctcgacagccccatccgcctcttctcgctctcgctacggctc

SEQ ID NO: 29796 - protein, 88 aa, Zea mays; identical to SEQ ID NO: 26553
  misc_feature: Ceres CLONE 1404953-F
  misc_feature (52)..(52): Xaa is any aa, unknown, or other

SEQ ID NO: 29797 - DNA, 599 bp, Zea mays
  misc_feature: Ceres CLONE 1404954-F
  misc_feature: Encodes the peptide sequence at SEQ ID NO. 29798
  misc_feature (384)..(384): n is a, c, t, g, unknown, or other
  misc_feature (499)..(499): n is a, c, t, g, unknown, or other
cataactggagctccccgcggtggcggccgctctagaactagtggatcccccgggctgcaggaattcgcacgagaccattacctagaacatcctaatcaaaagtcgcatcgcacgccatcagcagctagcgcgctcctcgagcccagcagagaaaggccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgcagaaggaggccggcggcggcaaggcggcgctggcgcccgaggaggtggtggcgcggatgcccgcggngcccagcgaccccgccgccgccgcggccatggtggaccgcatgctccgcctgctcgcctcctacgacgtcgtccggtgccagatgggagaccgggacgggcggtacgaggggcgntactcggccggggccggctggaaggggctcacccccaacaaggacgggggggccatggcccgacctcccgcctcatgaacccagaaacaggccccccatg

SEQ ID NO: 29798 - protein, 131 aa, Zea mays
  misc_feature: Ceres CLONE 1404954-F
  misc_feature (31)..(87): Pfam Name: Dimerisation Pfam Description: Dimerisation domain
  misc_feature: SWISSPROT Homolog: EC 2.1.1.68 Caffeate O-methyltransferase
  misc_feature (68)..(68): Xaa is any aa, unknown, or other
MGSTAGDVAAVVDEEACMYAMQLASSSILPMTLKNAIELGLLEVLQKEAGGGKAALAPEEVVARMPAXPSDPAAAAAMVDRMLRLLASYDVVRCQMGDRDGRYEGRYSAGAGWKGLTPNKDGGAMARPPAS

SEQ ID NO: 29799 - DNA, 638 bp, Zea mays
  misc_feature: Ceres CLONE 1404958-F
  misc_feature: Encodes the peptide sequence at SEQ ID NO. 29800
aaagctggagctccccgcggtggcggccgctctagaactagtggatcccccgggctgcaggaattcgcacgagaccattacctagaacatcctaatcgaaaaatcagacgaccaccttcctgcccccattcgtttccgcatcggcgtatctcccggcggcaaaggcgctctcctcccgacctccctgcggtgccggtacgacagtcgacaggatggcaatggccacatcagcatcgtaccctccacctcctccattttaccgattgtacaaaaaatttgagcaagatccctcatctgcaccagaacctccaccaccaattgatgaaccattcaaagccttgggtgttgatgctgccgagggcgagcctgagtctggcagtgaaggagagtattcaggttcggatgatgatgagcaggagccggaggatgactcgaaagaggcagataaggcaacaggtaagattgcgattgcgcttcagaaggctgtgccggggcccaaggttaatccttttgacgataagccgaagatgaaatttggttttgatgaggaggatggctcaggcacccgagaccaggagaagaatgagttgaccaagaagatgggaaaggatgtgaaggcagcagaggcaaagaggtca

SEQ ID NO: 29800 - protein, 142 aa, Zea mays
  misc_feature: Ceres CLONE 1404958-F
MAMATSASYPPPPPFYRLYKKFEQDPSSAPEPPPPIDEPFKALGVDAAEGEPESGSEGEYSGSDDDEQEPEDDSKEADKATGKIAIALQKAVPGPKVNPFDDKPKMKFGFDEEDGSGTRDQEKNELTKKMGKDVKAAEAKRS

SEQ ID NO: 29801 - DNA, 626 bp, Zea mays
  misc_feature: Ceres CLONE 1404963-F
  misc_feature: Encodes the peptide sequence at SEQ ID NO. 29802
aaagctggagctccccgcggtggcggccgctctagaactagtggatcccccgggctgcaggaattcgcacgagaccattacctagaacatcctaatcgaaaaaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcacccggccggacaccttcttcaccgccgccgactccgtgaggtctgtctgcacggaggtggccacggacctgcagatcctcgtggataactgcctctaccatctccacaaggtaattagctcaaggatcgtcagagatcgtgcccaccctttggcctttattcaggaatttgaatctttagttaggatcgttccatacagtgggatcccgtctaggctttgttcggttttcacggattggagacccagaataattcctagccggattacttctctaatttatataaattttgatgagttggaacgaaaccgggtttattccaatagaaacgaacggccccctaggaaatggagaagtccc

SEQ ID NO: 29802 - protein, 127 aa, Zea mays
  misc_feature: Ceres CLONE 1404963-F
MKFMRLGTRPDTFFTAADSVRSVCTEVATDLQILVDNCLYHLHKVISSRIVRDRAHPLAFIQEFESLVRIVPYSGIPSRLCSVFTDWRPRIIPSRITSLIYINFDELERNRVYSNRNERPPRKWRSP

SEQ ID NO: 29803 - DNA, 640 bp, Zea mays
  misc_feature: Ceres CLONE 1404965-F
  misc_feature: Encodes the peptide sequence at SEQ ID NO. 29804
aaagctggagctccccgcggtggcggccgctctagaactagtggatcccccgggctgcaggaattcgcacgagaccattacctagaacatcctaatcaaaaaatctcacggctagctagcacaagcatagtgcaggggcttgccacctaagtaaggcccgcctgagagccatggcatccaaggccgtcctcttcttggctctcaacctcctgttcttcacggtggccaacgcctgcggcaactgcccgaccccaacgcccccggtcgagccaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggcggtggaggatcccatgttgatccatttgacatcttctcatcattttttggaccctcttttggaggaggtggtggaagcagcaggggaagaaggcaaagg

SEQ ID NO: 29804 - protein, 116 aa, Zea mays
  misc_feature: Ceres CLONE 1404965-F
  misc_feature (13)..(71): Pfam Name: DnaJ Pfam Description: DnaJ domain
MFGRAPKKSDNTKYYEILGVPKSASQDDLKKAYRKAAIKNHPDKGGDPEKFKELAQAYEVLSDPEKREIYDQYGEDALKEGMGGGGSHVDPFDIFSSFFGPSFGGGGGSSRGRRQR

SEQ ID NO: 29805 - DNA, 663 bp, Zea mays
  misc_feature: Ceres CLONE 1404972-F
  misc_feature: Encodes the peptide sequence at SEQ ID NO. 29806
  misc_feature (435)..(435): n is a, c, t, g, unknown, or other
  misc_feature (440)..(440): n is a, c, t, g, unknown, or other
  misc_feature (518)..(518): n is a, c, t, g, unknown, or other
aaagctggagctccccgcggtggcggccgctctagaactagtggatcccccgggctgcaggaattcgcacgagaccattacctagaacatcctaatcgaaaaacgggatagaatcccattccccccgaaccctgcgccggggacccagccagctagctacatccactgatctacgcgcattccccgtaccaccgccaccgcgccgcgtcacggaaggaggaggatgtcgtcgtctccctcgccggcggccacccgcctggatctggatggcaaccccatcgcgcccctcaccatctgcatgatcggcgccggcggcttcatcggctcccacctctgcgagaagctaatggccgagacgcaccacaccgtcctcgctgttgacgtctactgcgacaagatccgccacctcgtcgaccccgcgccgccgcacctcgncgggngcatctcattccacgccttaacatcaaaaacgactccaggctagaggggctcatcaagatgggcgatctgaccataancctggccgggatctgcacgccgggcgactaacaaactcgcccactcggaaccatctaaggaaattcatcgacgcattccccagggggcaggaactggtccgaaaaacagaaaagggttcatccaattccccccctggggagggta

SEQ ID NO: 29806 - protein, 86 aa, Zea mays
  misc_feature: Ceres CLONE 1404972-F
  misc_feature: SWISSPROT Homolog: EC 5.1.3.18 GDP-mannose 3,5-epimerase
  misc_feature (71)..(71): Xaa is any aa, unknown, or other
  misc_feature (73)..(73): Xaa is any aa, unknown, or other
MSSSPSPAATRLDLDGNPIAPLTICMIGAGGFIGSHLCEKLMAETHHTVLAVDVYCDKIRHLVDPAPPHLXGXISFHALTSKTTPG

SEQ ID NO: 29807 - DNA, 627 bp, Zea mays
  misc_feature: Ceres CLONE 1405006-F
  misc_feature: Encodes the peptide sequence at SEQ ID NO. 29808
  misc_feature (491)..(491): n is a, c, t, g, unknown, or other
  misc_feature (492)..(492): n is a, c, t, g, unknown, or other
  misc_feature (547)..(547): n is a, c, t, g, unknown, or other
  misc_feature (597)..(597): n is a, c, t, g, unknown, or other
aaagctggagctccccgcggtggcggccgctctagaactagtggatcccccgggctgcaggaattcgcacgagaccattacctagaacatcctaatcgaaaaaagcaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgagggcggcagcgtcctccgcggcgcgctgctgctcctgtgcgtggcggtcgtctacgtcaactacaccttcttctctcgagtcggtgggcatcagcacgctggtggacatcttccgtggcggggctcaaggtgcgcagcatccagattgtgggcgcggctcgtgctccccagnntctacacgcggcgacgtgccccggagagattgtagagggggtcaggttcttcggnaggggcttacgttgtcacgccagccccaggggcatgggtcgagcccttcncagggcttcctcgggcccacaaaaggcccc

SEQ ID NO: 29808 - protein, 115 aa, Zea mays
  misc_feature: Ceres CLONE 1405006-F
  misc_feature: SWISSPROT Homolog: EC 2.3.1.15 Glycerol-3-phosphate O-acyltransferase
  misc_feature (104)..(104): Xaa is any aa, unknown, or other
  misc_feature (105)..(105): Xaa is any aa, unknown, or other
MVASPRFKPIEECCSEGRSEQTVAADLDGTLLISRSAFPYYLLVALEGGSVLRGALLLLCVAVVYVNYTFFSRVGGHQHAGGHLPWRGSRCAASRLWARLVLPXXYTRRRAPERL

SEQ ID NO: 29809 - DNA, 862 bp, Zea mays
  misc_feature: Ceres CLONE 1405009-F
  misc_feature: Encodes the peptide sequence at SEQ ID NO. 29810
  misc_feature (27)..(27): n is a, c, t, g, unknown, or other
  misc_feature (862)..(862): n is a, c, t, g, unknown, or other
ccccttaaatggccgggaaaaagccgnctctggccgcgcccctgcgggtgcgggaggtggagccccccccgcccccccaaactggagctccccgcggtggcggccgctctagaatagtggatcccccgggctgcaggaattcgcacgagaccattacctagaacatcctaatcgaaaaaatttcgactctcaactcccaaggtccctttttttttctcgatctggaagcgccgcactagcacccatggacgtgagcggagcaggcgagaaggcgaagaagggcgcggcggggcgcaaggccggcgggccgacgaagaactcggtgtcgcggtcctccagggccgtactgcagctccccgtcagacgagtcggggggtacctcaaaaaggcccgggacgctgcagcgtgtacgccaccgggaggcccccggcctaacctccgccggccggtcctggagtaccctcggcgggccgaaggcggccccgaagctctgcccgggccaaagtttgcaagggggaccaaccaggaaataacggggccacccattcccgggagcgccacgggggcgttccttcggccccttccgggcaaaccgcacccgagggaaatttttcgccaaaagccttggctttgggcccgaggaggaccatccccaatcgtccccaacagcggggtgggtccgttcccccaaaacaattcaacaacatggggggtccccccccccggagaaagaggtgggcgcccggaaaaagggccggaaaaatggggaggcccgaaaggaagggcgcggcccaagatcccccctgaaaagaaggagggccacaggggggtatcccccctcctctagaaggtgggccggggn

SEQ ID NO: 29810 - protein, 200 aa, Zea mays
  misc_feature: Ceres CLONE 1405009-F
MDVSGAGEKAKKGAAGRKAGGPTKNSVSRSSRAVLQLPVRRVGGYLKKARDAAACTPPGGPRPNLRRPVLEYPRRAEGGPEALPGPKFARGTNQEITGPPIPGSATGAFLRPLPGKPHPREIFRQKPWLWARGGPSPIVPNSGVGPFPQNNSTTWGVPPPGERGGRPEKGPEKWGGPKGRARPKIPPEKKEGHRGVSPLL

SEQ ID NO: 29811 - DNA, 745 bp, Zea mays
  misc_feature: Ceres CLONE 1405010-F
  misc_feature: Encodes the peptide sequence at SEQ ID NO. 29812
cgtcgggagggggggcgggggcgccaggaggggggggcgggggggggggggcggggggggggggggggaggcgaccaggggataaaagctggagctccccgcggtggcggccgctctagaactagtggatcccccgggctgcaggaattcgcacgagaccattacctagaacatcctaatcaaaaaaaccccgtgtcggttctcagacaccgccgtcggcgttctcccgacatctccccgtccagctcgttgggtgagcccctatccttcaccttcacgacttcacctgcttctccactgcgagccccgcccccggccccgtcgagcgccctgctcagatccatcggaaggggcttgccgcaccactgcccctagcaaaaggtgggcagccagcggtgcaggcgaagatcatgcaccggtgtcttatgaacattggtaaggggagaaagaagatgaggaatagacggggggggtgatctgcccctctgttctgatggaggacccccaccttctttatcttgtaatgcatggagctgggcgagcttggggcttgtctgcttccttttcctgaaacatcaaggccgacaggggtcgagacccaggtttaatttcaggacttctttcatgggggcccgaaaagtaggaagacctcggagggaggatcatttccggcttggcgcccccgctcacaagggtgaaatccccgggggaagtgaaaaaggggggccgaacccgtggaaaaaca

SEQ ID NO: 29812 - protein, 40 aa, Zea mays
  misc_feature: Ceres CLONE 1405010-F
MGARKVGRPRREDHFRLGAPAHKGEIPGGSEKGGPNPWKN

SEQ ID NO: 29813 - DNA, 681 bp, Zea mays
  misc_feature: Ceres CLONE 1405011-F
tggagctcaccgcggtggcggccgctctagaactagtggatcccccgggctgcaggaattcgcacgagaccattacctagaacatcctaatcaaaaaaatccaattttctactcacggacgccgcccctgtgcctcgccatcgcctcaggtacgcaaggcggtcgaacacgagcgcccgccttcgttcttgcctgcgctgcccctctcctcgccgtttattcgggctcctacctcttgatacaacttgcgcggtgggggcagtgaggcagcaagacgtgaggtccaggatgatgaacaacaacagtggcggcggtgcccggaggccctggaggggggcatgggtacggtagtgggtgtaggaagcctaaaaatttaatctatgagaagggcgggcgcagcgggatcatccgaatcccaccccggagtgctccccccggagggggcctacaagcgttcgggagctatcatcaacaaggctctgagcggaaattgttgcccacatactacgtccaaccgacacgggaaaggccctaccccccccaatcaggggggaatcccaaaaaaggccgtgcaaggcttcctccaggggtaaatccttgcggcgtcccacgaacctcttcccgggacatttttccggcaagggccaaaaaggatcggaaccccccaggatttcccaaagg

SEQ ID NO: 29814 - DNA, 644 bp, Zea mays
  misc_feature: Ceres CLONE 1405017-F
  misc_feature (242)..(242): n is a, c, t, g, unknown, or other
  misc_feature (243)..(243): n is a, c, t, g, unknown, or other
  misc_feature (245)..(245): n is a, c, t, g, unknown, or other
  misc_feature (254)..(254): n is a, c, t, g, unknown, or other
  misc_feature (258)..(258): n is a, c, t, g, unknown, or other
  misc_feature (264)..(264): n is a, c, t, g, unknown, or other
  misc_feature (265)..(265): n is a, c, t, g, unknown, or other
  misc_feature (279)..(279): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
aaagctggagctcaccgcggtggcggccgctctagaatagtggatcccccgggctgcaggaattcgcacgagaccattacctagaacatcctaatcgaaaaagcaggagaagagagacgacacagcagctttttgggtttccccttccctttccccgcgcggtgatcgcagggttctccgcgagcgagcagagcactgcgcgtcctccgtgacttctggtgatcctgggggtctggacgtgnngntcatttggntggntggggnngggacaacccggcnaaaatgaactaaaatcccgggacgtaaagagagggcccccccaaaaaaaaaannnnnnnnttttttcccccccccccctttccggggggggggggggttaaaaagggggccccccccgcttttaaaaaaaaatttatgggggggcccccccccccaaggagtttttttgggggggccgcaaaaaatttggggggggacacacccaggggggcggggggcccccctttttttataaaaaaaatccttttttggggggggggccgctttcttttgggggggggggggggggggttttttcctctccaaaaaaaaaaggggggttttgtgaaaaaaaaaaaaacaactttcctcccaccccacccaaa

SEQ ID NO: 29815 - DNA, 657 bp, Zea mays
  misc_feature: Ceres CLONE 1405030-F
  misc_feature: Encodes the peptide sequence at SEQ ID NO. 29816
  misc_feature (161)..(161): n is a, c, t, g, unknown, or other
  misc_feature (540)..(540): n is a, c, t, g, unknown, or other
  misc_feature (649)..(649): n is a, c, t, g, unknown, or other
aaagctggagctccccgcggtggcggccgctctagaactagtggatcccccgggctgcaggaattcgcacgagaccatttacctagaacattcctaatcaaaaaacccaggacgaggcccagggaggatcctcccgacttccgacgcttgcgtaggacccnccgacttccgacggcgtccgcccgcgtcgcgtgccacgcccacgccacgccggccgccgcgaggaaagaacaccgggtacttcccctttcccttacgctccagtttcacaagtcgcgagccgtgcgtcgcgtcgacgcgagttccgcgtgagggagcaggcagttgcagttggaggcggtgacgaaaccctaggacttgagctccagcgcacggctcgggtcctcctcaccgttcccggcgatggaccggcggcaggagctctgcaggaacttccagcgcggcagctgcaagtacggatcgcacttgcaggtttgtgcacgcctcctctcagcagcagcagcaggcgaagcccaaccccgttttgggttcgggcttaanggagtaggcagcagcaacagcagcagtctttcgttttcgtgcgcagttccagcagcagcagcagcagaagcccaaccccgtttgtggattttgggagtgcaaggcagtngcggctgc

SEQ ID NO: 29816 - protein, 85 aa, Zea mays
  misc_feature: Ceres CLONE 1405030-F
  misc_feature (46)..(46): Xaa is any aa, unknown, or other
  misc_feature (83)..(83): Xaa is any aa, unknown, or other
MDRRQELCRNFQRGSCKYGSHLQVCARLLSAAAAGEAQPRFGFGLXGVGSSNSSSLSFSCAVPAAAAAEAQPRLWILGVQGSXGC

SEQ ID NO: 29817 - DNA, 735 bp, Zea mays
  misc_feature: Ceres CLONE 1405042-F
  misc_feature: Encodes the peptide sequence at SEQ ID NO. 29818
  misc_feature (615)..(615): n is a, c, t, g, unknown, or other
  misc_feature (643)..(643): n is a, c, t, g, unknown, or other
aagctggagctccccgcggtggcggccgctctagaactagtggatcccccgggctgcaggaattcgcacgagaccattacctagaacatcctaatcgaaaaagagcttgcaaacaccaccagcgaaaacgtcgtggccagccatcccggtgtcgtcccgcgttctacagccaccgctgtcgtcgccgtcctagactcctagatccgtcagcttaacgagctccattccttcgaggccagccatcccggtgtctcagcagcggcggcggcggcgtcgagctcttgctttctgtgggaggacgcatggcgatgtctgcggggcgtgggctcttggtcctcttcttctctgccgccgtagtggctgagctcgcctctgccgcgaacggtcctttcctgtccgatagcgtcttccagtcgagcgccggatctacagggaggagcttgctgcaggccaagaatagttgccctgtgaactttgagttccaaaactacacaatcatcacaagcaagtgcaaaggaccgaagtttccagccagccaatgctgtgccgcactcaaggaattcgcgtgcccttttacaattacctcaatgacgagagcaatgaatgtgcatcgancatgttcagctacatcaacctctatggncagtatcccaccaggtctgttttccagcgagtgcaaagaaaggaagatgggggcttccttgcgcagatgtccccccggaaggacggtccact

SEQ ID NO: 29818 - protein, 144 aa, Zea mays
  misc_feature: Ceres CLONE 1405042-F
  misc_feature (105)..(105): Xaa is any aa, unknown, or other
  misc_feature (114)..(114): Xaa is any aa, unknown, or other
MAMSAGRGLLVLFFSAAVVAELASAANGPFLSDSVFQSSAGSTGRSLLQAKNSCPVNFEFQNYTIITSKCKGPKFPASQCCAALKEFACPFTITSMTRAMNVHRXCSATSTSMXSIPPGLFSSECKERKMGASLRRCPPGRTVH

SEQ ID NO: 29819 - DNA, 704 bp, Zea mays
  misc_feature: Ceres CLONE 1405046-F
  misc_feature: Encodes the peptide sequence at SEQ ID NO. 29820
gctctagaactagtggatcccccgggctgcaggaattcgcacgagaccattacctagaacatcctaatcgaaaactcacactctgcccagctaagctccctccgtccatcggcatggcgactaccactactaccatcctcctcctcctcctcgtcgcagccactgccgtctcggcggccgacctctccgtgtaccacaacgtgcacccgccgtccccgtccccgctcgagtccatcatcgcgctcgcccgcgccgacgacgcgcggctcctcttcctctcatccaaggcggcctcgtccggcggcgtcacctccgctcccgtcgcctccggccagactccgccctcgtacgtcgtccgcgcggggctcggcaccccggtccagcagctgctcctcgcgctcgacaccagcgccgacgccacctggtcgcactgcgcgccgtgcgacacgtgccccgccggcagccgcttcatcccggccagctcctcctcgtacgcctccctcccggcgcctccgactggtgcccgctcttcgagggccagcgtgcccggcgaacccagacgctcggcgccgctgccggcgtgcgcttctccaagccgtcgcggacacctcgtcaggcgtcgctggcagcgacacgctgcgcttgggcaggacgcatcgccgctaccgttcggtgcgggggcgcgtggccggccgacaccaccg

SEQ ID NO: 29820 - protein, 197 aa, Zea mays
  misc_feature: Ceres CLONE 1405046-F
MATTTTTILLLLLVAATAVSAADLSVYHNVHPPSPSPLESIIALARADDARLLFLSSKAASSGGVTSAPVASGQTPPSYVVRAGLGTPVQQLLLALDTSADATWSHCAPCDTCPAGSRFIPASSSSYASLPAPPTGARSSRASVPGEPRRSAPLPACASPSRRGHLVRRRWQRHAALGQDASPLPFGAGARGRPTPP

SEQ ID NO: 29821 - DNA, 714 bp, Zea mays
  misc_feature: Ceres CLONE 1405047-F
  misc_feature: Encodes the peptide sequence at SEQ ID NO. 29822
  misc_feature (493)..(493): n is a, c, t, g, unknown, or other
  misc_feature (578)..(578): n is a, c, t, g, unknown, or other
  misc_feature (690)..(690): n is a, c, t, g, unknown, or other
  misc_feature (691)..(691): n is a, c, t, g, unknown, or other
gctctagaactagtggatcccccgggctgcaggaattcgcacgagaccattacctagaacatcctaatcgaaaaaacagcacgctctccctctccccgacggctgctagctagcgacaacagatcgacggcaacaccgatgggcgaggccaacgccacaggcacgccagccaccgcgacggtgcgcgtgctggccgtgtcgcgcgtcgcgccggcgccggcgccggcagcggcggaccccgtcgtcgtcaagctgtccttcttcgacacgccctgggtcgtgctgccgcccatccagcgggtgttcctgtacgagctgcctggtggcgacggtgagttcacggcggcagtgacgcgcctcaagagctccctcgccgccacgctggcggtgtacctgccgctggccgggaagctggcgtacgtcgccggcacccgggacgtggtcgtggactgcgtcgacgaccccggggtggccttcgtcgaggcggaggcgnacgccggtatcgacaccatggacgtcccgccggctggcgagcgacgaggcgcacgacatccccggcgtcctagcgctgttaccgnagctccccaacaaagtgctcccgggcgcgggttctgtccgtgcaagccacgcggatccccggggggggcctcgcgctcgggctctccgtgcacacggcgtcgcgacggcagnnccgggggggaggttcatgggccc

SEQ ID NO: 29822 - protein, 192 aa, Zea mays
  misc_feature: Ceres CLONE 1405047-F
  misc_feature: SWISSPROT Homolog: EC 2.3.1.153 Anthocyanin 5-aromatic acyltransferase
  misc_feature (119)..(119): Xaa is any aa, unknown, or other
  misc_feature (147)..(147): Xaa is any aa, unknown, or other
  misc_feature (184)..(184): Xaa is any aa, unknown, or other
  misc_feature (185)..(185): Xaa is any aa, unknown, or other
MGEANATGTPATATVRVLAVSRVAPAPAPAAADPVVVKLSFFDTPWVVLPPIQRVFLYELPGGDGEFTAAVTRLKSSLAATLAVYLPLAGKLAYVAGTRDVVVDCVDDPGVAFVEAEAXAGIDTMDVPPAGERRGARHPRRPSAVTXAPQQSAPGRGFCPCKPRGSPGGASRSGSPCTRRRDGXXGGEVHGP

SEQ ID NO: 29823 - DNA, 733 bp, Zea mays
  misc_feature: Ceres CLONE 1405048-F
  misc_feature: Encodes the peptide sequence at SEQ ID NO. 29824
  misc_feature (604)..(604): n is a, c, t, g, unknown, or other
  misc_feature (605)..(605): n is a, c, t, g, unknown, or other
  misc_feature (640)..(640): n is a, c, t, g, unknown, or other
  misc_feature (641)..(641): n is a, c, t, g, unknown, or other
aaactggagctccccgcggtggcggccgctctagaactagtggatcccccgggctgcaggaattcgcacgagaccattacctagaacatcctaatcgaaaaatctcaccacacaccgcagccccagcaagatcgcgcggaggccatggcgaagcccaagccttcctccgccggcgccaagccgaccgcgcctgcgccgccggttacagtgcactcggcgctggtcacctacacctccatgctcgcgctcctgtccctctgcccgcccttcgtcatcctcctgtggtacacgatggtgcacgcggacggatcggtggtgcggacttacgagcacctcagggatcacggcgtgctcgaggggctaaaggccatctggcccatgcccaccctcgtcgcgtggaagatcatcttcggcttcggcctcttcgaggccgtcctacagctgctgctccctgggaagcgcttcgaagggcccatctcgcctgccgggaacgtgccggtctacaaggcaaatggcttacaagcatatgcagtgaccttgataacttaccttggtttgtggtggttcggtatatttaacccctgcatagtgtatgatcacttgnnggaatatactctgctctttgttttggaagctttgnnatctggattttctctacataagggccatgtatttcatcttcatctgactctggatcctctgggaatgtgataatgacttctactggggtatg

SEQ ID NO: 29824 - protein, 188 aa, Zea mays
  misc_feature: Ceres CLONE 1405048-F
  misc_feature: SWISSPROT Homolog: EC 1.3.1.21 7-dehydrocholesterol reductase
  misc_feature (154)..(154): Xaa is any aa, unknown, or other
  misc_feature (166)..(166): Xaa is any aa, unknown, or other
MAKPKPSSAGAKPTAPAPPVTVHSALVTYTSMLALLSLCPPFVILLWYTMVHADGSVVRTYEHLRDHGVLEGLKAIWPMPTLVAWKIIFGFGLFEAVLQLLLPGKRFEGPISPAGNVPVYKANGLQAYAVTLITYLGLWWFGIFNPCIVYDHLXEYTLLFVLEALXSGFSLHKGHVFHLHLTLDPLGM

SEQ ID NO: 29825 - DNA, 489 bp, Zea mays
  misc_feature: Ceres CLONE 1405050-F
  misc_feature (169)..(169): n is a, c, t, g, unknown, or other
  misc_feature (181)..(181): n is a, c, t, g, unknown, or other
  misc_feature (222)..(222): n is a, c, t, g, unknown, or other
aagctggagctccccgcggtggcggccgctctagaactagtggatcccccgggctgcaggaattcgcacgagaccattacctagaacatcctaatcgaaaaagctatttcctgtattctcttcctgccggccgctagagagattggcatcgcactgctctctgtgtttnggccgctctatngttggcggagtccctttcgtttctgtcggcttcgtctgttnctgtacgccgcttccgtacaggacacagcttccctgtttaatcgaatttggcccccctggccatggaaaaaccgggcccccccgaaaacccctccccccccccaaaaaaaaaacaaaaccctcccttttttggggggggaaaaaattttttttttttcttttgtggaaaaatataaacagggggccccccccaaaaaacacaaccggcgcgggggggggggaaaaaaaaaaaaaaagggggtttttttttggaggccccgttttatt

SEQ ID NO: 29826 - DNA, 743 bp, Zea mays
  misc_feature: Ceres CLONE 1405052-F
  misc_feature: Encodes the peptide sequence at SEQ ID NO. 29827
  misc_feature (448)..(448): n is a, c, t, g, unknown, or other
  misc_feature (541)..(541): n is a, c, t, g, unknown, or other
  misc_feature (599)..(599): n is a, c, t, g, unknown, or other
  misc_feature (602)..(602): n is a, c, t, g, unknown, or other
  misc_feature (609)..(609): n is a, c, t, g, unknown, or other
aaagctggagctccccgcggtggcggccgctctagaactagtggatcccccgggctgcaggaattcgcacgagaccattacctagaacatcctaatcaaaaaaaactttagtctactcgtcctcggtcctcctcttctcgcagcagccagcagaccaatcgggacaagcaaactcccccgattagtttaagcagcccgggcccggcgacgaccagctccgttccgcgcggggatttaaacgcgcgaagcgagaaggcacgcagcaggcggcagcggcaagcaacgaacgcgatcgcgcgccgacgacgacgcgcggtgccggcgcctggtggtgccgtgttgcggactccgctgcatcgtctcggtcggtcgtcgtcgttatcatgggtgtccggctgccggtggcgtggtccgccgtcctcgtcctcctcgtgcgggcggccgtggncgcggagtacgcgggcatcttcaacttcggggactccctggtggacgccggcaacctggtggtgggacgcatcccgggactactggccacggngcgcctggccctacggatgacccacttcggctaccccaccgggcgctgctccgacggncgnctcgtcngtgacttcatcgcgcaggagctgggcgtgccgctgctgccgccgtcaaagggaagacgcgacgttccaccgcggcgccaacttcgcgatcacgggcgcacgtcgctggaacgccctttctcgtgagcgcggcgg

SEQ ID NO: 29827 - protein, 116 aa, Zea mays
  misc_feature: Ceres CLONE 1405052-F
  misc_feature: SWISSPROT Homolog: EC 3.2.1.51 Alpha-L-fucosidase
  misc_feature (22)..(22): Xaa is any aa, unknown, or other
  misc_feature (53)..(53): Xaa is any aa, unknown, or other
  misc_feature (76)..(76): Xaa is any aa, unknown, or other
MGVRLPVAWSAVLVLLVRAAVXAEYAGIFNFGDSLVDAGNLVVGRIPGLLATXRLALRMTHFGYPTGRCSDGRLVXDFIAQELGVPLLPPSKGRRDVPPRRQLRDHGRTSLERPFS

SEQ ID NO: 29828 - DNA, 797 bp, Zea mays
  misc_feature: Ceres CLONE 1405055-F
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (27)..(27): n is a, c, t, g, unknown, or other
  misc_feature (38)..(38): n is a, c, t, g, unknown, or other
  misc_feature (39)..(39): n is a, c, t, g, unknown, or other
  misc_feature (46)..(46): n is a, c, t, g, unknown, or other
  misc_feature (52)..(52): n is a, c, t, g, unknown, or other
  misc_feature (797)..(797): n is a, c, t, g, unknown, or other
gggatgcccaccaaggnnnnnnccccncccccacaatnnaaagtgngggacnaccaagacggcgctccccgcggtggcggccgctctagactagtggatcccccgggctgcaggaattcgcacgagaacattacctagaacatcctaatcggaaaatatctttttctccccaagaaaaaaaaggcggcgagagcataagaagaaaaacacacacacacacacacacaaagcgcacttttcaaatcgacaaaggggaaaggttcgcttcttgtggcatctagctttccttcgagtgccatggccgatccggcggaggagaacgttgtctcgccgccaccgacccctgcggccccagccgtgggggcctcagacccgcccccttgcagctgctgttgacaagcgcctcaacggaaaaaggggtctggcttccggggccggtagggaaagggccccgggggaattccggctttccttggagagggaaccctttccggggcacaaaatccccctggggggagggggacaaaacttggctggccggttcgggttatgggaaaaaaaaaaaaaacccttcctgggcgggcgcgaaaaaaggggggggggaaaaggggcaactgggggtccctgttcccgaaagggttttgaaataccccccccccctggatccggaatataccccgggcccgacaatgggggggacctccccccccttttttcctcggggggccaaaagaaaccaccccttattaaaaaaaaaaagccccccccggaattcccccacacagggagcgtactgn

SEQ ID NO: 29829 - DNA, 713 bp, Zea mays
  misc_feature: Ceres CLONE 1405058-F
  misc_feature: Encodes the peptide sequence at SEQ ID NO. 29830
  misc_feature (347)..(347): n is a, c, t, g, unknown, or other
  misc_feature (550)..(550): n is a, c, t, g, unknown, or other
  misc_feature (653)..(653): n is a, c, t, g, unknown, or other
aaagctggagctccccgcggtggcggccgctctagaactagtggatcccccgggctgcaggaattcgcacgagaccattacctagaacatcctaatcgaaaaattcaatcaagttgagtaaagcccccccaccccaaaccaaatctcggaaggcgatcgacgactcgacgtgtgttctacgagtaggagctgttaatcaacagctagtgaatcggagggcgacggtaccaaccttgatgcggcgatagagtcgctcctgaatgtcgagaagcagatgaggctggccggagatgtcgccggcactcggaaggccgtcatcgacatcgtcgagctctgctacaaggccnggcgcgtggaagacgctaaacgaccagatcgttctcctatctaagaggagaggccagcttaagcaggctattactgctatggttcagaaagcaatggagtacattaatttgacaccaggcattgacacaagcatcgagctaaaaaaacactgagcagtgtctctgctggcaaaatctatgttgagatagagagagcaagattngatcaaaggcttgcaaaaattaaagaggagcagggacagatttacgaggctgctgattgatgcaagaaaagttgctggttgaaacattttgctctattgcaangaacgaagaaaattgctttcattctgtgagcaggtccggcttaatgcttgaaatcgggca

SEQ ID NO: 29830 - protein, 38 aa, Zea mays
  misc_feature: Ceres CLONE 1405058-F
  misc_feature (25)..(25): Xaa is any aa, unknown, or other
MRLAGDVAGTRKAVIDIVELCYKAXRVEDAKRPDRSPI

SEQ ID NO: 29831 - DNA, 705 bp, Zea mays
  misc_feature: Ceres CLONE 1405059-F
  misc_feature: Encodes the peptide sequence at SEQ ID NO. 29832
gctctataactagtggatcccccgggctgcaggaattcgcacgagaccattacctagaacatcctaatcgaaaaattcaacggtcatctccgctccgctcctccgctccacgccgccaccgctcctccgctcctcgcggctcaaacggtcaaatcgcagatccacaggaaaccccaagcggcggccgtccctgctgcggctctgcctccctctgctctccgattcgagcggattccatggccagagacgacgacggcgcgcccgcgcccggcgttccgggccaggtgtacctgcccgcgtggcgccgcgcgtacgaccgactcgtgaagatgctgcgccaggcgtacgcgcaggccgaggagctctccgtcgaccgcgagcatctcatctccgagctccagttcctgcagagcgccagccgcgagcgccaggagatctccccagtccgcctccagcagatctgcaaggacgaggagctcagcaagagagtccttgaggctgagacggcggcgcgtcttggcggcaaggagcttcagattcactgccatcagaaactcgcaaaacttgccgagagggatttggagaacttcaaaagttggatttcgaatttggctgctgaaaatactgacctaaaagaaaaactggaaaaaggttgaaagccaggtgcagattaaccaccaaaatttaaatccccgagaaaagggg

SEQ ID NO: 29832 - protein, 139 aa, Zea mays
  misc_feature: Ceres CLONE 1405059-F
MARDDDGAPAPGVPGQVYLPAWRRAYDRLVKMLRQAYAQAEELSVDREHLISELQFLQSASRERQEISPVRLQQICKDEELSKRVLEAETAARLGGKELQIHCHQKLAKLAERDLENFKSWISNLAAENTDLKEKLEKG

SEQ ID NO: 29833 - DNA, 678 bp, Zea mays
  misc_feature: Ceres CLONE 1405061-F
  misc_feature (678)..(678): n is a, c, t, g, unknown, or other
aaagctggagctccccgcggtggcggccgctctagaactagtggatcccccgggctgcaggaattcgcacgagaccattacctagaacatcctaatcgaagtatctgaccacgtcacacgacaccaccaccagccctccccttcatcaattggagcacggagcccgttcattcccctcttctccgctggttgcctccggatccccaattccacgagatctccaattccaccgcgtcgtctctgcatccggaccccataccccgatcgatccctaaggcccatggttttctccgacgccgcgtctcctctagtagccaccgctgctgactctgcttcctcctgcgtcgcccacctccgctgctgctgtcgcgttagatgctgacggtgacgaacacgcgcaactctttatgcgccgcgatttctcgctgatcagctccagaattgataagctatggatctatcgcggcccacatcgtcggacctctcgctcgggtctcactctcacggtcacgcccaagcccacgctcgtaggcacgcggtagccgcgccgctgcgactgttccacgacccggaggaacccaaaccggatcccgtcctgggccgtacaggccgaacctgcagagtgatgacgaggacgggggccgaccagaacttctccctccttcgggcactccctcn

SEQ ID NO: 29834 - DNA, 680 bp, Zea mays
  misc_feature: Ceres CLONE 1405062-F
  misc_feature: Encodes the peptide sequence at SEQ ID NO. 29835
  misc_feature (358)..(358): n is a, c, t, g, unknown, or other
  misc_feature (397)..(397): n is a, c, t, g, unknown, or other
  misc_feature (421)..(421): n is a, c, t, g, unknown, or other
  misc_feature (436)..(436): n is a, c, t, g, unknown, or other
  misc_feature (480)..(480): n is a, c, t, g, unknown, or other
  misc_feature (513)..(513): n is a, c, t, g, unknown, or other
  misc_feature (517)..(517): n is a, c, t, g, unknown, or other
  misc_feature (568)..(568): n is a, c, t, g, unknown, or other
ggagctccccgcggtggcggccgctctagaactagtggatcccccgggctgcaggaattcgcacgagaccattacctagaacatcctaatcgaaaaccctttccttccgccgcccaaatgccagtggccaccttcctcctcgtcgcgcttctctcgtgcggcgcacgagccatccggacgcacggcggctatgtctccgcggtcggggaccccggcatgcggcgcgacggcctccgcgtggcatgggaggcgtggaacttctgcaacgaggtcggccaggaggcccccggcatgggcagcccccgcggtgccgattgcttcgatcttctcgagacgagctccgacgaggaggggcggncggtgtactcggtggcgcacctggtgagcgacgccgacnaccgcctgggcgcgggcgacctgntcccggggtccccgncggggcgcgccccgcgtcacggacgccgacctctacgcgccggncaagggagctgtacctaggcgaccgctggcagntggncgacaccccgccggccgtggcagttcttggatggccatgctcaagaagggnaacttcgacaccacggccgccgctggcccggaaaagggcggcccggggggccgttttccggaaaagtcccgttcccgggcccccccggggccgggtggatgagacagccgtg

SEQ ID NO: 29835 - protein, 126 aa, Zea mays
  misc_feature: Ceres CLONE 1405062-F
  misc_feature (81)..(81): Xaa is any aa, unknown, or other
  misc_feature (94)..(94): Xaa is any aa, unknown, or other
  misc_feature (102)..(102): Xaa is any aa, unknown, or other
  misc_feature (107)..(107): Xaa is any aa, unknown, or other
MPVATFLLVALLSCGARAIRTHGGYVSAVGDPGMRRDGLRVAWEAWNFCNEVGQEAPGMGSPRGADCFDLLETSSDEEGRXVYSVAHLVSDADXRLGAGDLXPGSPXGRAPRHGRRPLRAGQGSCT

SEQ ID NO: 29836 - DNA, 756 bp, Zea mays
  misc_feature: Ceres CLONE 1405067-F
  misc_feature: Encodes the peptide sequence at SEQ ID NO. 29837
  misc_feature (546)..(546): n is a, c, t, g, unknown, or other
  misc_feature (716)..(716): n is a, c, t, g, unknown, or other
aagctggagctccccgcggtggcggccgctctataactagtggatcccccgggctgcaggaattcgcacgagaccattacctagaacatcctaatcgaaaaacggtccaccgacgactcttcttcctcacctcctcccgctccagctccagctcgtctctctcctcgcctcgcgtagggtttcgcttcccgtctcgccgccgtcagcatgggggacaactacgatgacgaaggcgagccgatcgtgaacctcgacgaacgggaaccctcccctgagcatcagccgtacgaagacctcgatgacgacctcgacggcggcggcgattggacccgcgaccgctctccgacccccgtccacggcgacgacggcggggcagggtcctcctccaagccccgaaagcgccttctcaagaagggcggcggtggaggcatgcccggcgatgacgggctggatgactttgggttggaggacgaggacgcggacccttcggctgaggcgaggaagaggaagggctcgtcgtcgctgagggacctcgcgaggggcggngcggccagggagaataagctaagaaatgcgatggaaggacgacgggagggggaggaacactgcgatggtgagggataggcagagatcaggagcaaggtactcaggcgtgagggatgaccaggatgatggggagaggtagatccaggagctctgtgactacatttgctgantgcggagtcagaggatgaccatgaaagtgttagaaccgtt

SEQ ID NO: 29837 - protein, 138 aa, Zea mays
  misc_feature: Ceres CLONE 1405067-F
MGDNYDDEGEPIVNLDEREPSPEHQPYEDLDDDLDGGGDWTRDRSPTPVHGDDGGAGSSSKPRKRLLKKGGGGGMPGDDGLDDFGLEDEDADPSAEARKRKGSSSLRDLARGGAARENKLRNAMEGRREGEEHCDGEG

SEQ ID NO: 29838 - DNA, 691 bp, Zea mays
  misc_feature: Ceres CLONE 1405068-F
  misc_feature: Encodes the peptide sequence at SEQ ID NO. 29839
  misc_feature (541)..(541): n is a, c, t, g, unknown, or other
cgctcttaactagtggatcccccgggctgcaggaattcgcacgagaccattacctagaacatcctaatcgaaaaaggcctcgccactcttccgaacctgtagtcgcttacccactgccaactcagcgccaaactgtggagaattttttttttacctatttctatttatggtggtggtggtgtgcaatcgcaggaacaatcaccaccgttattaagaagatgatgcgctgcgctgcaacgggcggcgggtgcgtcgcttcgtggagcggcgattggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagttaaatcctcaggacatgttctgccatatgttggcgttgcttgtttggnggctattctgtttggttaccatcttggtgtggtcaatggcgcacttgaatatctcgcgaaggatcttgggattgctgaaatgctgtcttgcaggggggtgggtggttagcacatccttggctgggtgcacactaggtcttttttactggg

SEQ ID NO: 29839 - protein, 143 aa, Zea mays
  misc_feature: Ceres CLONE 1405068-F
  misc_feature (108)..(108): Xaa is any aa, unknown, or other
MMRCAATGGGCVASWSGDWRLPAVNPCSVRMPTGNDGWCAGLRSRAADLAGLEMANLRGGVGGLFRASPRYGRLQATAAVDPEDIPLEKVQVKSSGHVLPYVGVACLXAILFGYHLGVVNGALEYLAKDLGIAEMLSCRGVGG

SEQ ID NO: 29840 - DNA, 748 bp, Zea mays
  misc_feature: Ceres CLONE 1405069-F
  misc_feature: Encodes the peptide sequence at SEQ ID NO. 29841
  misc_feature (659)..(659): n is a, c, t, g, unknown, or other
  misc_feature (722)..(722): n is a, c, t, g, unknown, or other
aagctggagctccccgcggtggcggccgctctataactagtggatcccccgggctgcaggaattcgcacgagaccattacctagaacatcctaatcaaagagtacttgtgcggaccgtggctcccggtgttccccatgacaccaactcatgtaacaggtgaggcgtcctccagtccctagatctgtgtagtgcgcctctgcgatactgcgactgcgtccggtcggtgcgcgtatcatcggccgccaaactgtgagccccgattggccactaggccactactgcagaactgcaatcgtgcgataacacagaggaaggcggacggcgatgggcgccgtggtgaggcccgctctcctgcttcgcctgagaggcgcctctacgttgtcgagctcgtcctccggccctcgtcgctgtcgcttcccctccttctctcactcctgtttccagtttgggaggcaatttccggctcagagagccaatggaagcccgatgcagcatttcggtactctgaaagcttaaggtttttacctgcgctgtggacccatgagggacgactttctacgtaggaggactacctgcgtttgctccctacccgccaattatgaagccgcgccccttcctatactgaccccccccctcgcgtgatcttctcaattgttgntcgaacccctgttcttactactcacccattgccccgctctcatttaactctacaggtgccggngagacttgttgtggtagtgtacgtca

SEQ ID NO: 29841 - protein, 63 aa, Zea mays
  misc_feature: Ceres CLONE 1405069-F
MGAVVRPALLLRLRGASTLSSSSSGPRRCRFPSFSHSCFQFGRQFPAQRANGSPMQHFGTLKA

SEQ ID NO: 29842 - DNA, 779 bp, Zea mays
  misc_feature: Ceres CLONE 1405070-F
  misc_feature (221)..(221): n is a, c, t, g, unknown, or other
  misc_feature (372)..(372): n is a, c, t, g, unknown, or other
  misc_feature (443)..(443): n is a, c, t, g, unknown, or other
ggagctccccgcggtggcggccgctctagaatagtggatcccccgggctgcaggaattcgcacgagaccattacctagaacatcctaatcaaaaaagaatatcgcatcgccgtcgcgtcgtcgtcgatctccccgccccgccccgcccgcgccgcggaatctgacacatctccctaatctctcctaggaccgggtgcccttacatccacgccgcaacgcanatcgccgtccgagccctcgcggtctctcgtctccccgtgcgagaggacgccggcagcagcggcgtgccagtgcggtggcttggtgggggaagaccggagggcgcggcagagctcgcgcccagaggtgcacggcagggctggtctcggcgtncgctgggggaaggcgagtacccccgggaaggacgaggtgataatcatgagctcgatctgcccttccggggnagccaccactggggggggggtatgccctgtggaattctgataaaacaaccctgggggggccttggcaaatcttgacaagacatcagggggggtatgccttgcccctggaaagggtcctgggaacaaagctcagggaaaagggggtatttgtgggaaaaaaggggccccatcctcccggggtgaccaaaaaaaagcgccctgggtttaacccccccctttttcaggggggcccctatagtgttttttggggggggccctcccccttgagaaaaaaagggggggcgggggcgccccaatattttggggggggtgtttccctctttaaaaggcgcgcct

SEQ ID NO: 29843 - DNA, 694 bp, Zea mays
  misc_feature: Ceres CLONE 1405071-F
  misc_feature: Encodes the peptide sequence at SEQ ID NO. 29844
  misc_feature (477)..(477): n is a, c, t, g, unknown, or other
  misc_feature (513)..(513): n is a, c, t, g, unknown, or other
  misc_feature (521)..(521): n is a, c, t, g, unknown, or other
  misc_feature (525)..(525): n is a, c, t, g, unknown, or other
  misc_feature (526)..(526): n is a, c, t, g, unknown, or other
  misc_feature (604)..(604): n is a, c, t, g, unknown, or other
aaagctggagctccccgcggtggcggccgctctagaactagtggatcccccgggctgcaggaattcgcacgagaccattacctagaacatcctaatcgaaaaagctagccaagctataccactagaaccagagcacaactcaaagcaatgccgccgcctcctcctcctccgccccactcccacgcttcccatcccgcgccgcatggacgcgagcagcactagcgcgggggcacacagcacggcgagcgggcggtggcgcgacgatggacctgggcggctcggtggtgatggacgcgggcgcctcggagctgggcctgctcggcggcggatctagcaggctgctcaagcacgggcgggggcccaatgcgtcggtgggagacgaccacgtgtggagcggcggcagggccaagcagcccaggacagggacagctgccgtcgtcgcacggaggacgtggcggctgtcactcaaggcgaatnacggcgccgtatcctgcatgaggtcgtgcagtcccnacccacgncganngagcagatgctcaacttctcgtccgccgccgccgacgtcgacggactcgatggactactccaccgctgcggatgatgntcggcgaggccatggcgctgtactacgagaccgcggcctcttgcatcagattgagctaggtgagcttgagcaccagcatgcaaggggcaa

SEQ ID NO: 29844 - protein, 143 aa, Zea mays
  misc_feature: Ceres CLONE 1405071-F
  misc_feature (72)..(72): Xaa is any aa, unknown, or other
  misc_feature (84)..(84): Xaa is any aa, unknown, or other
  misc_feature (88)..(88): Xaa is any aa, unknown, or other
  misc_feature (114)..(114): Xaa is any aa, unknown, or other
MDLGGSVVMDAGASELGLLGGGSSRLLKHGRGPNASVGDDHVWSGGRAKQPRTGTAAVVARRTWRLSLKANXGAVSCMRSCSPXPRRXSRCSTSRPPPPTSTDSMDYSTAADDXRRGHGAVLRDRGLLHQIELGELEHQHARG

SEQ ID NO: 29845 - DNA, 733 bp, Zea mays
  misc_feature: Ceres CLONE 1405073-F
  misc_feature: Translation starting site: 193
  misc_feature: SWISSPROT Homolog: EC 2.3.3.1 Citrate (Si)-synthase
  misc_feature (629)..(629): n is a, c, t, g, unknown, or other
  misc_feature (641)..(641): n is a, c, t, g, unknown, or other
  misc_feature (682)..(682): n is a, c, t, g, unknown, or other
aagctggagctccccgcggtggcggccgctctagaactagtggatcccccgggctgcaggaattcgcacgagaccattacctagaacatccctaatcaaaaaagcaaccacttctgctctgcatcccgtctgggcctctgcatttgcttggctgctgctcccttctcccaccgaccaactcgatcccgcgccatggatcgcgccgaccccgcgcggggccgccttgccgtgctctcctcccacctccgtggtgcaggggccgaggaggcggcggggctggagaggtcgccggtatccgcgccggcgcccgggccccgcgccggcgcgcttgccgtggtggacgggaggaccgggaagcggcacgaggtcaaggtctccgaagacggcaccgtgcgcgccaccgacttcaagaagattacccactggaaaggacgacaagggtcttaagatttatgatcctggttaccttaacactgcccctgttcgctcgtccatctgctacatcgatggagatgagggaatccttcgctataggggttatccaatcgaagaattggctgaaagcagctcgttttgtgaggtggcctacctttttatgtatgggaacttgcctactcagagtcattggncaggctgggaantttgctattctcagcattctgctggtcccaaagactgttgnatatcatacatcaatgcccatgatgctcaccccatggggtgtcttgccagg

SEQ ID NO: 29846 - DNA, 607 bp, Zea mays
  misc_feature: Ceres CLONE 1405077-F
  misc_feature: Encodes the peptide sequence at SEQ ID NO. 29847
  misc_feature (329)..(329): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (348)..(348): n is a, c, t, g, unknown, or other
  misc_feature (351)..(351): n is a, c, t, g, unknown, or other
  misc_feature (352)..(352): n is a, c, t, g, unknown, or other
aagctggagctccccgcggtggcggccgctctagaactagtggatcccccgggctgcaggaattcgcacgagaccattacctagaacatcctaatcaaaaagagggcgcgcattactctgcagcgcggacacgcccggcacggcaagccagccactcttctcgcgtgaagctgccaggacgagagagagagaggaggaggattagcttagccattcttgcggctgggcaaggaaactgctgaagccactagccggctgcctgctctacttcctccgaaccgaacgaggtgcatcgtgaggaagcagcagcagggggggcagtggccggncggggatgacggnnnaggnagnncgtggccgcggcggaggcggacctggatcaggactcggcggcggcggcggcgcccgtgctgctgagcccgctcaacgagacgctgtggcgcgacagggcggccgccgccgccggtcggggtctccgtcggggaagtgttcgggcgcccggggggggccggacctcccggggaccggcggggttcgctccggaaaaaacaaggccgggttgcagggccccccggggaccccccaagccgggacacttaccggggtt

SEQ ID NO: 29847 - protein, 91 aa, Zea mays
  misc_feature: Ceres CLONE 1405077-F
  misc_feature (3)..(3): Xaa is any aa, unknown, or other
  misc_feature (4)..(4): Xaa is any aa, unknown, or other
  misc_feature (5)..(5): Xaa is any aa, unknown, or other
  misc_feature (6)..(6): Xaa is any aa, unknown, or other
MTXXXXRGRGGGGPGSGLGGGGGARAAEPAQRDAVARQGGRRRRSGSPSGKCSGARGGPDLPGTGGVRSGKNKAGLQGPPGTPQAGTLTGV

SEQ ID NO: 29848 - DNA, 704 bp, Zea mays
  misc_feature: Ceres CLONE 1405078-F
  misc_feature (639)..(639): n is a, c, t, g, unknown, or other
cgctctagaactagtggatcccccgggctgcaggaattcgcacgagaccattacctagaacatcctaatcgaaaaagtgtttcgcactttgctattcagcttcgttcttcaccggttcaccctagccgccaccccaacccccagcgacagggaccttcgccgccaggccgcccccaatccctagcgactgcgagcaccgtcgccaggcgccgtgcagcgagcgtcgccgcctggcgaagtcgcgcgactcgtgccctgcagcgagcgccgctgtcccgcacccaccgtcgaacggctgccgatgcccaacgccctgcagcgagttgcgccgtcgtccgcttcctctcgctggtaacctcgtgtttcgatttggacagattgctcgtgacttggtgttgcgccgccgaccgagcctccttcccctaagtccctaaccgtaagtcctaaatcttggtgagttctgttcatgtgcatttgagcttacgcatctatgatacgcgccttagggattgtgatctgtgattaggggttgtgaaattgagatgccattttagggattgtggaagtgtgaactgtgccttactgaaatcgagatgccatttgagcaagttttcaactattttgttggattggcgaggntatgagacctttccagatactttatatccgaatggttggaaaaatatattatgctggtgtattac

SEQ ID NO: 29849 - DNA, 722 bp, Zea mays
  misc_feature: Ceres CLONE 1405079-F
  misc_feature: Encodes the peptide sequence at SEQ ID NO. 29850
  misc_feature (639)..(639): n is a, c, t, g, unknown, or other
  misc_feature (722)..(722): n is a, c, t, g, unknown, or other
aagctggagctccccgcggtggcggccgctctagaactagtggatcccccgggctgcaggaattcgcacgagaccattacctagaacatcctaatcgaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatccttcagcgacggcccttcatgtacgtggtgcgcgacctccgggagaagtacgggcccatcttcaccatgcggatggggcagcgcaccctcatcgtggtcacctcggcggagctcatccacgaggcgctggtgaagcagggccccatgttcgcgagccggcccgaggacagccccacccgcctcctcttcagcgtcggcaagtgcaccgtcaactcggcgccctacggccccccctgtggcgtgctctgcgccgcaacttcgtcngccgagatcgtgtccccgcaccgcgtcaggtctttctctgggaaatcggggaagtggggccgtggacgcgcacttgcgccgcn

SEQ ID NO: 29850 - protein, 164 aa, Zea mays
  misc_feature: Ceres CLONE 1405079-F
  misc_feature: SWISSPROT Homolog: EC 1.14.13.89 Isoflavone 2'-hydroxylase
MDVNDVLLVVLAAALAAMWWRRCSKTGGVDGLPPGPPGWPVVGNLFQVILQRRPFMYVVRDLREKYGPIFTMRMGQRTLIVVTSAELIHEALVKQGPMFASRPEDSPTRLLFSVGKCTVNSAPYGPPCGVLCAATSSAEIVSPHRVRSFSGKSGKWGRGRALAP

SEQ ID NO: 29851 - DNA, 674 bp, Zea mays
  misc_feature: Ceres CLONE 1405089-F
  misc_feature: Encodes the peptide sequence at SEQ ID NO. 29852
  misc_feature (328)..(328): n is a, c, t, g, unknown, or other
  misc_feature (349)..(349): n is a, c, t, g, unknown, or other
  misc_feature (523)..(523): n is a, c, t, g, unknown, or other
aagctggagctccccgcggtggcggccgctctagaactagtggatcccccgggctgcaggaattcgcacgagaccattacctagaacatcctaatcgaaaagcatcttcgcctccgctcaacgctcgcccagcccgccgcccccccaccgatccacgagaaaccttctcgcctccgcgggacgattcgccagggagagcaaaggtagcagaggcgccatggacgctgccaagtcggtgacgccgggcgccgtgtcctacatcctggcgcacccgtctacgggctccgatggcgccgtgtcggatctcgtcgttcaggtcctcgatctncagtccatcggcatgggcagncggttcagtttcacgggcaccgatgggaaacgacaaaatcaggcgatgctccccacttactttgcgtcggaggtccactccggcatctgaaagatttcggtctcatccgcatcctcgactaccctgggcactcgtcaaaggcacgctgacaaagtctgattgtcgtcaaatgcnaaactgtgtgcgaaacgctcgaacgcccaaatcacgggggagggccaaaaagaaggatcctccatttggggtggaacccaaagacgaaggctcaagccggggtttgaggaaaaaatcctccccccctcggggtgaagccataggcaaaggg

SEQ ID NO: 29852 - protein, 73 aa, Zea mays
  misc_feature: Ceres CLONE 1405089-F
  misc_feature (6)..(74): Pfam Name: Rep-A_N Pfam Description: Replication factor-A protein 1, N-terminal domain
  misc_feature (44)..(44): Xaa is any aa, unknown, or other
MDAAKSVTPGAVSYILAHPSTGSDGAVSDLVVQVLDLQSIGMGXRFSFTGTDGKRQNQAMLPTYFASEVHSGI

SEQ ID NO: 29853 - DNA, 733 bp, Zea mays
  misc_feature: Ceres CLONE 1405090-F
  misc_feature (1)..(1): n is a, c, t, g, unknown, or other
  misc_feature (534)..(534): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (588)..(588): n is a, c, t, g, unknown, or other
  misc_feature (614)..(614): n is a, c, t, g, unknown, or other
  misc_feature (644)..(644): n is a, c, t, g, unknown, or other
  misc_feature (686)..(686): n is a, c, t, g, unknown, or other
  misc_feature (687)..(687): n is a, c, t, g, unknown, or other
naaagctggagctccccgcggtggcggccgctctagaactagtggatcccccgggctgcaggaattcgcacgagaccattacctagaacatcctaatcgaaaaagaaaatacgcacctgctcctcactcttctttatatttttttctccatttgccaacttttgcttgtcggtcatgtatatgcatgaccctttcacacatatgatcagaagataagcacatgcaagacgatctcgcgtggatatgatgcatggatcagacctaacctctatatcatcaccaaacgctcgtagatgatgctatacaattccgtgattaaattatatatcagtaaaaaaaaaagaaccgtacgtgcatacataaaattaagaattaatggctgccaatggacgacatatgcatggacaggtaagctggtgatcccactgaaccgggaggcgcccaacttccggtccatgatcgggatgatcgacgggaggacggagctgaagccgctgccagccagcggcgtcccagaggaccgcggctgcaggntgtggnnntttctccgcccgccgcgggatccgggcggcgatgacactaacttgnaacgtgtagagcggcaccccgcgccnggtgaccgttggtgcagccagcagttacgntgaaacggggtggattcgtccgcctccgcacccttctcccgnnggttcgaaggcggagccatgaatgggccccccaaagatcggcctaa

SEQ ID NO: 29854 - DNA, 709 bp, Zea mays
  misc_feature: Ceres CLONE 1405091-F
  misc_feature: Encodes the peptide sequence at SEQ ID NO. 29855
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
gctcttgaactagtggatcccccgggctgcaggaattcgcacgagaccattacctagaacatcctaatcgaaaaatctagggctattagaaaacgtgcaaggcttctttcctcccaaatcccctgagcaaggcccccgtcggctagcgccgcagccgtcgccgtcgacgccgactctcaccggcagccgcttgcagcgcgtcccttccccgctcccggcgccatggactgcgcaaagggaaggtcggtggcggacctctacgacgagctgatggtggagatcttctcgcgcatgcccgtcaaagacctccgccgttccacttacgtgtgcaaatcttggcgcaacctcatcaccgaccccctcaaccgcaagaagctgccccagaccctgggaggcttcttccacgggggcgtcggagggcctcgcagctacggccatttcaccagcctgccgggggagcggagtggcctccggtcgaccctttccttctcttttatcaaggcaatggtgcctgggggtcgagcgcatgggcctccttggattcttgcaacggggctcctgcttcttggggtgcacgcgggaagggcaaggtcgggtacatcgtggtcaaaccctgcgacccagaaattggtggactgtggccggcaggttcgcggtcttggcccgcatttgtgagacagtatgaatgccctaggtcgcnnnnnnnnnn

SEQ ID NO: 29855 - protein, 150 aa, Zea mays
  misc_feature: Ceres CLONE 1405091-F
  misc_feature (7)..(54): Pfam Name: F-box Pfam Description: F-box domain
MDCAKGRSVADLYDELMVEIFSRMPVKDLRRSTYVCKSWRNLITDPLNRKKLPQTLGGFFHGGVGGPRSYGHFTSLPGERSGLRSTLSFSFIKAMVPGGRAHGPPWILATGLLLLGVHAGRARSGTSWSNPATQKLVDCGRQVRGLGPHL

SEQ ID NO: 29856 - DNA, 718 bp, Zea mays
  misc_feature: Ceres CLONE 1405097-F
  misc_feature: Encodes the peptide sequence at SEQ ID NO. 29857
aaagctggagctccccgcggtggcggccgctctagaactagtggatcccccgggctgcaggaattcgcacgagaccattacctagaacatcctaatcaaaaacttcccgttccccaattcgaaatcgagtcgggtactcgggtcggtcttgccgtgcgtgggtggctgtccgaaacagcccgcgctcctactcctccgcccgccagcgccgtgtccctctagggctttgtcgggatgccgctccctctgagggagcgcgagcacatgcccaatgtcccctacaagcagacggcggacgccgaggagagccgccgccgccgcgagggccagatggccgacatccgcaaggccacgcgagaggaaaggctccagaatacgtgccgcgatgtattccctgccgacgcctccgtgccggccatggccattcctctggcctccagcaaatattcgatggtttgcgcgaccagtgtaatcctgccaactgcacttgccccactgttgggagggaagcctgcggccaaatccgggattagcccgcccttgctggtagtttcccggttgaacacccgtcctgcaaagtttcttttggcccctgttgccgggcggggttccccggttcaacccccttttgttctgcctaccatgttcgatcagcctttgccgcacgttggtctattgaacctaaacccaccctttaggtttccccctccccatggcg

SEQ ID NO: 29857 - protein, 161 aa, Zea mays
  misc_feature: Ceres CLONE 1405097-F
MPLPLREREHMPNVPYKQTADAEESRRRREGQMADIRKATREERLQNTCRDVFPADASVPAMAIPLASSKYSMVCATSVILPTALAPLLGGKPAAKSGISPPLLVVSRLNTRPAKFLLAPVAGRGSPVQPPFVLPTMFDQPLPHVGLLNLNPPFRFPPPHG

SEQ ID NO: 29858 - DNA, 810 bp, Zea mays
  misc_feature: Ceres CLONE 1405097-R
  misc_feature (548)..(548): n is a, c, t, g, unknown, or other
  misc_feature (627)..(627): n is a, c, t, g, unknown, or other
  misc_feature (657)..(657): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (713)..(713): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (747)..(747): n is a, c, t, g, unknown, or other
  misc_feature (754)..(754): n is a, c, t, g, unknown, or other
  misc_feature (772)..(772): n is a, c, t, g, unknown, or other
  misc_feature (785)..(785): n is a, c, t, g, unknown, or other
  misc_feature (794)..(794): n is a, c, t, g, unknown, or other
  misc_feature (796)..(796): n is a, c, t, g, unknown, or other
attgggtaccgggccccccctcgaggtcgacggtatcgataagcttttttttttttttttttctagataagcttggaacgactttgagacaatggtgccaaaaccacgtttgaggaagcacaagtgactacaacagagaagatgacataacgaaccacaaacctacaatgagccaatgagttaagactcgagactcaagagactcccaaaaacctatttgccattatgtcttataatttgtgtcaatactcatgcaacatgtcatacaggacaggaaccgctttgacaaaaaccaacacattccctatcttccaaggttcttttcttctacctcatcaaataggtaaaacaatataattcattcatgctatattggaggcaaaacccaactcccgacaacacctgcgacttcatgcctaccaccagaggcggtgggagcaagagcccaaatgatccaaccggctgaccttgaagactgaccacttccatgcagcaccactggtgatgcagcacaaggactgaccctgctgactgggactgacatgacnaaacacctgaagaccagaacaattggggacccgaacccaagggtttttttggggggggaaaaaaaaacccctttctttncccccacattttttttttgttttggtttgncccccccccccccaattaaatttgtttttttnnnnnnnnnagaagagagagagatntttttttnnnnnnnnnnncccccccccccccccnctacaanaaaaaaaaaaaaaaaagnggggggggggggntggggtttncnccacacccacaaca

SEQ ID NO: 29859 - DNA, 744 bp, Zea mays
  misc_feature: Ceres CLONE 1405099-F
  misc_feature: Encodes the peptide sequence at SEQ ID NO. 29860
  misc_feature (242)..(242): n is a, c, t, g, unknown, or other
  misc_feature (257)..(257): n is a, c, t, g, unknown, or other
  misc_feature (262)..(262): n is a, c, t, g, unknown, or other
  misc_feature (288)..(288): n is a, c, t, g, unknown, or other
  misc_feature (336)..(336): n is a, c, t, g, unknown, or other
  misc_feature (382)..(382): n is a, c, t, g, unknown, or other
  misc_feature (383)..(383): n is a, c, t, g, unknown, or other
  misc_feature (391)..(391): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
gctcttgaactagtggatcccccgggctgcaggaattcgcacgagaccattacctagaacatcctaatcaaaaaatctctcatttcctcacgcacgtctcgcaactgccgcggcacaccgcgccgcttctcctcctcctcctcctccttccgagccgagagaaaggctgctgccagagggacgagggcgagcgaggatccttccgagcgatggagcagtacgaggtggtggagcagatcggncggggcgcctacggnttcgnctacctcgtcctcccacagggcgagncgcagaggtacgtcatggagaagatcccgctcttccagcagaacgacnagttccagcgggaccgcttacccaggagatggccctgatggcaagnnctcacaancccgtacatcgtcaagtaccagggccgattggtgggaccaggggacctcccgctggattggtacaaggtaatggcaaagagggggcatgggccaagggttcaaaaaggcagggggcattccattctccaaaaaggagggggggtcccggggttcacagaatatggtcctcggccctccaataactgggactgtgaaccggggggtgctcccgcggacttccagaggtttccacacatatgcagaacaacatctgatgtgcacgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29860 - protein, 54 aa, Zea mays
  misc_feature: Ceres CLONE 1405099-F
  misc_feature: SWISSPROT Homolog: EC 2.7.11.1 Non-specific serine/threonine protein kinase
  misc_feature (18)..(18): Xaa is any aa, unknown, or other
  misc_feature (27)..(27): Xaa is any aa, unknown, or other
  misc_feature (43)..(43): Xaa is any aa, unknown, or other
MEQYEVVEQIGRGAYGFXYLVLPQGEXQRYVMEKIPLFQQNDXFQRDRLPRRWP

SEQ ID NO: 29861 - DNA, 769 bp, Zea mays
  misc_feature: Ceres CLONE 1405101-F
  misc_feature: Encodes the peptide sequence at SEQ ID NO. 29862
  misc_feature (335)..(335): n is a, c, t, g, unknown, or other
  misc_feature (341)..(341): n is a, c, t, g, unknown, or other
  misc_feature (470)..(470): n is a, c, t, g, unknown, or other
  misc_feature (548)..(548): n is a, c, t, g, unknown, or other
  misc_feature (549)..(549): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
aaagctggagctccccgcggtggcggccgctctagaactagtggatcccccgggctgcaggaattcgcacgagaccattacctagaacatcctaatcgaaaaaaagcaccacgcacgatcgccttcgccaaccgcgccgctctctctctctttctctctcgcacgagccgcgccggcgccgccaccacgcgcgcgggagacagagaccacagccgcagccaccgacgggcggaataggaattggtgggcgccggggggaggagcaggaggaggtccgttgcggtggccggcggcggaggagcttgacactgtacggaagaaggtggtggagattnagtggnaagggatgaacaaagaggttatgggttgctgcttgcccctacagaatttggccctttggcgggctcatattgatcatcagggggtgggagtagtcacagctatgaccataaaattatggagtactcccnttgggtttcgtttccctctaaatggttctgagccacccttttatttttttcttttcaggttttaacttcatttctggnncaggtttggagggtgctaataggaattcagaggttgatggacttgcaaaaagcctaatggataaacctgagaactannnnnctgggggaagttatgcaaaaagggtggctgttaggtgcacctgcagaattagtggatatgaattctaagggaggggtatcataggaatataattctgggggggggaaggggcctttggtagtttcaggggctcagtcct

SEQ ID NO: 29862 - protein, 62 aa, Zea mays
  misc_feature: Ceres CLONE 1405101-F
  misc_feature (42)..(42): Xaa is any aa, unknown, or other
MNKEVMGCCLPLQNLALWRAHIDHQGVGVVTAMTIKLWSTPXGFRFPLNGSEPPFYFFLFRF

SEQ ID NO: 29863 - DNA, 680 bp, Zea mays
  misc_feature: Ceres CLONE 1405105-F
  misc_feature (478)..(478): n is a, c, t, g, unknown, or other
  misc_feature (680)..(680): n is a, c, t, g, unknown, or other
ggagctccccgcggtggcggccgctctagaactagtggatcccccgggctgcaggaattcgcacgagaccattacctagaacatcctaatcgaaaaaagccgtgccacagcatcggtcgtgcgacgaggcgtacgagccgcagcgtcggtcatgcgacgtgcgcgggcggagcactctctggagagaaccgctcgccgacccacccaccgcactgctctcccacccaaatcgccgaccgataggagagaacccgagctgagaagagagagggcagcaggcggcggcgcggagtaacacgcggaagggaatgcacagcccgtgtgagcctctcgcccccgcgaaaccccaccgattctgattccgccggcgaaatcgggcgcctcgcggctcggccggctaagcggtggacggcggcgccgaggggctcgttcgacacggtggggtgagctcgtgaggagcagcagccacggcgaaggntatgatgaagggaggcggccgggaaggagacgctcctccgcttcctcctcctgcttctccaccccctcaccgccctctacttcttctacacgctggacctcctcttcacctcggggtcgtcggccgcctccaactgcgcggcctggacgccgtttcggtctccccggatgtcttgcccaccctcccggcggggggcgggaan

SEQ ID NO: 29864 - DNA, 672 bp, Zea mays
  misc_feature: Ceres CLONE 1405106-F
  misc_feature: Encodes the peptide sequence at SEQ ID NO. 29865
  misc_feature (672)..(672): n is a, c, t, g, unknown, or other
aaactggagctccccgcggtggcggccgctctagaactagtggatcccccgggctgcaggaattcgcacgagaccattacctagaacatcctaatcgaaaaagctaggttcctatgcccaaagtcacacagcttcttctccttctacttctccttcctcctctcctcaccggcaccttgatctaatctcttccatcctagcttgctcgccgctgccagtctctcctccgcctgcaacgactcccatgtctcagtcttctcctctcttctccgtcgcccgagcgcacgccggagcaggagggcgagccgtggcagccgctctcctgctccgtcgtcgccccattgcacagctgccgcacagcatccatggcctacggtgtctctctccagccagagcgacaccttccaagacgctcctcagcctcccccgcgccacgctgtcctccttcgccgaccccgacggcgacggcggctccagcgcgaaagccagcgacggcggcgccaaggccggcgccggcggggaggagcaggtcggggaatgcgagatgtcggagatggccagggcgttccacatctcgccacgggtggcgacgtccatctccgtggacgatcgcgttcgccgacctcaccgtgccgctggcgatgcgctcgctggtctgccacgggaccttcn

SEQ ID NO: 29865 - protein, 142 aa, Zea mays
  misc_feature: Ceres CLONE 1405106-F
MSQSSPLFSVARAHAGAGGRAVAAALLLRRRPIAQLPHSIHGLRCLSPARATPSKTLLSLPRATLSSFADPDGDGGSSAKASDGGAKAGAGGEEQVGECEMSEMARAFHISPRVATSISVDDRVRRPHRAAGDALAGLPRDL

SEQ ID NO: 29866 - DNA, 543 bp, Zea mays
  misc_feature: Ceres CLONE 1405110-F
  misc_feature (210)..(210): n is a, c, t, g, unknown, or other
  misc_feature (310)..(310): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
tggagctccccgcggtggcggccgctctagaactagtggatcccccgggctgcaggaattcgcacgagaccattacctagaacatcctaacaaaaagcgttctgtggccgccgcccttctgccgtccgaccggaccaggtcgccgacgtcgcccctatcccgcacgcgtcatcgcagcgcctccgagtctccgccaagatctgcctcggncacggcgcggcgccgcttggagctgcagccgtccaagccgactgcccttccggcggaccacccggacccaccggacccattgggccgagcccgccccaantttaatttggctttttttaaaaaaaaggggggctcctttttttaaaaaaaagtttttccccccaagagaggccctcctttaaaaaaaaaannnnaaacaaaaggggggggggggggccccccaaaaaaaaaagggtttttttttaaaaaaccccccgcccggcgcccctttttttttttttttttgaaaaggggggttttttttttttttgtaaaaaaaaaaacctccctttt

SEQ ID NO: 29867 - DNA, 752 bp, Zea mays
  misc_feature: Ceres CLONE 1405111-F
  misc_feature: Translation starting site: 383
  misc_feature: SWISSPROT Homolog: EC 2.3.1.119 Icosanoyl-CoA synthase
aaagctggagctccccgcggtggcggccgctctagaactagtggatcccccgggctgcaggaattcgcacgagaccattacctagaacatcctaatcaaaaaaaaaacacacgaacaccgaaccgcaacgtaaccggataggggaagagctctttccttcagctgtgccgtgcacaacgcacggcacgctaggtttggcttgcatcgcccccgccaagaaagacgctgccgtgagcgggctgagcggtcggcaagcacgcaacaggcggccgacatgccgagcgtgaacgtcgttctccgcgtcggagaacctcaagcacgtacatagctggagtaccagtacctggtgaaccacttcctgacgctgctgctggtgccggtgatgggcgccacggtgctggagctggcgcgcctcgacaccggggagctgctctcgctgtgccactcactggagctggacctggtccacatcctctgctcggtgttcctggacttcttcgtcggtaccgagtacgagatgtcagggcccaggccggcgtatctggtggactacgcctgctacaagtcccccgccagggttgccgcgtagccttcgccaccttaatgaagcacacgcgcctcatcagcgactacgacgagagcgtgcgcctccagaccaggatcatggagcgctcggggctcggcgaggacacgtgccctccgcccgtcaccactaacatccgccaaacccaggatggaggcctcgcgcgcga

SEQ ID NO: 29868 - DNA, 668 bp, Zea mays
  misc_feature: Ceres CLONE 1405113-F
  misc_feature: Encodes the peptide sequence at SEQ ID NO. 29869
aagctggagctccccgcggtggcggccgctctagaactagtggatcccccgggctgcaggaattcgcacgagaccattacctagaacatcctaatcgaaaaattccaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggcgcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtgaaacttcttctcgccgcgcgaccgcaagtacccgaatggctccaggccttaacgggcgggcgaaacagtgcactgcaaaaacacccgcccccacgagcccacaacgaaaaacagacagggggtatatcattaacgccggcggggtaccaccacactacccccctcttagtcgggcggggaaaaaaaaaggggcgggtcgggcaaaaacaaaaaacaaactcgcgccgcgccggactgtcctcg

SEQ ID NO: 29869 - protein, 64 aa, Zea mays
  misc_feature: Ceres CLONE 1405113-F
  misc_feature (9)..(64): Pfam Name: NAM Pfam Description: No apical meristem (NAM) protein
MDCGGALQLPPGFRFHPTDDELVMYYLLRKCGGLPLAAPVIAEVDLYKFDPWQLPEKAFGGEKE

SEQ ID NO: 29870 - DNA, 749 bp, Zea mays
  misc_feature: Ceres CLONE 1405118-F
  misc_feature: Encodes the peptide sequence at SEQ ID NO. 29871
  misc_feature (253)..(253): n is a, c, t, g, unknown, or other
  misc_feature (442)..(442): n is a, c, t, g, unknown, or other
  misc_feature (450)..(450): n is a, c, t, g, unknown, or other
  misc_feature (496)..(496): n is a, c, t, g, unknown, or other
  misc_feature (497)..(497): n is a, c, t, g, unknown, or other
  misc_feature (576)..(576): n is a, c, t, g, unknown, or other
  misc_feature (710)..(710): n is a, c, t, g, unknown, or other
  misc_feature (711)..(711): n is a, c, t, g, unknown, or other
aaagctggagctccccgcggtggcggccgctctagaactagtggatcccccgggctgcaggaattcgcacgagaccattcctagaacatcctaatcgaaaaccacctctcaagtccaaaagcgaagcctacgcccgccccaacggtgaaaacgtcggaaccctagatccctctcacggtcgcgcctgtgctccaaaaccttagatccgacatgcatcagcccagagcccgctacccacccgggtatggctccngcgggggaggcggtggcgggggaggcggtagtggagtaggaagaggaggcagcggcggcggaggaaaccacaactactacggccggaacacacatccacagcatcaacaccactaccagcagcagcagcagcactcgcataggaactcctcgcaccagcagcagtggctgcggcgagaccagggccccngccgttgncggggccagtgtctgggaaacgctgtgcctaagacggcgcctcagnncttgacgctgtttgactcgagttctcaaagattgggaaggctcaactaaatataccagctccagacacacgctacaggnacagaggatgtcactgcaacaaaggcaatggagtttgaggattatttcttgaaacgtgagttgcttatgggagtatatggaagaagggatttgaaatgccatctcctattcaagaagaaagattccctattggnnttgactggaagtgatattcttggcagggcgaaaatggc

SEQ ID NO: 29871 - protein, 111 aa, Zea mays
  misc_feature: Ceres CLONE 1405118-F
  misc_feature (15)..(15): Xaa is any aa, unknown, or other
  misc_feature (78)..(78): Xaa is any aa, unknown, or other
  misc_feature (80)..(80): Xaa is any aa, unknown, or other
  misc_feature (96)..(96): Xaa is any aa, unknown, or other
MHQPRARYPPGYGSXGGGGGGGGGSGVGRGGSGGGGNHNYYGRNTHPQHQHHYQQQQQHSHRNSSHQQQWLRRDQGPXRXRGQCLGNAVPKTAPQXLTLFDSSSQRLGRLN

SEQ ID NO: 29872 - DNA, 723 bp, Zea mays
  misc_feature: Ceres CLONE 1405119-F
  misc_feature: Encodes the peptide sequence at SEQ ID NO. 29873
  misc_feature (288)..(288): n is a, c, t, g, unknown, or other
  misc_feature (321)..(321): n is a, c, t, g, unknown, or other
  misc_feature (461)..(461): n is a, c, t, g, unknown, or other
  misc_feature (474)..(474): n is a, c, t, g, unknown, or other
  misc_feature (505)..(505): n is a, c, t, g, unknown, or other
  misc_feature (581)..(581): n is a, c, t, g, unknown, or other
  misc_feature (624)..(624): n is a, c, t, g, unknown, or other
aaagctggagctccccgcggtggcggccgctctagaactagtggatcccccgggctgcaggaattcgcacgagaccattacctagaacatcctaatcgaaaagttccaaaaagaaaaaagaaaaactcagccgccggccgctgcccctctcggctgcacgacgtccgtgagggcgtgccccctggccccgtcccttgtcgcctgcccgccggtgcccgcacaggctgccagtgccatactgccatccctccgtccggccgtctgcccaggctgcctgcccggcgcccntggcctccccggtcgctggctctctgcccaggncgccaggccgcaggtcccaccgccccagaccacccgcgaaccagtccgctgcaggctgcaggccaccgtcccctcccagttcgccggtcagattattaaccattcagataccccagctccgcctagacgcgaatcctcgncactatggtgggncagcggtgtccctgccgagccaagcacaggncgtgctttcggagccggctctgcgacccggtcttcatccactccgccctcagtagctccctggacactaattacancaagctgaagtacctcgtcgccagctcggtctccgaggctgcnaacaattctgtcctcctctgggtccccccgcgggtgtggaaaaagcagcggtggtcgaacatgggttcttgatgaatctgaggaggagcacccagatgc

SEQ ID NO: 29873 - protein, 76 aa, Zea mays
  misc_feature: Ceres CLONE 1405119-F
  misc_feature (14)..(14): Xaa is any aa, unknown, or other
  misc_feature (39)..(39): Xaa is any aa, unknown, or other
MVGQRCPCRAKHRXCFRSRLCDPVFIHSALSSSLDTNYXKLKYLVASSVSEAANNSVLLWVPPRVWKKQRWSNMGS

SEQ ID NO: 29874 - DNA, 726 bp, Zea mays
  misc_feature: Ceres CLONE 1405120-F
  misc_feature: Encodes the peptide sequence at SEQ ID NO. 29875
  misc_feature (478)..(478): n is a, c, t, g, unknown, or other
  misc_feature (690)..(690): n is a, c, t, g, unknown, or other
cgctctagaactagtggatcccccgggctgcaggaattcgcacgagaccattacctagaacatcctaatcaaaaacatttcctctctctctttctctaactccgggtccctctctcctctctctattctctccatccttgcttctgggaagctcatcagccatggacgatgccactgcagaggaagaagcttccatgttcgagaccagccatgtcctcggcgccctgctggcctcctcgccgttgctggcgcgcgcctgggaccgctgcacagccgcctccgccgcagcgccgtggttcgttcacggcgaagacggcggcaaggtgtacgtggggttctctggggtgcaggctgcgcttacggcggcaggcgcggcggtggccggcggcggcgccgacatcttcgcgccggtgagtctcggcggggacgcggcggggcggatgttcgcgccgctggtcgccgccgagcccgacccggncgctacccgggagccggttgccgtgcaggcgctggcgctgcagtgcttccctgaactctgctgcagtcctgattttcagatgcttctgaatcagatcagggggaagggcagtcgtggtcacggcccactcccttggtggcgcccgtgcggccctcacggggctacactacctctgcatctcatcgtcaagctcggcacctgctcctcctgtnctgtgcgtcacctttggaagcccatactttggcaca

SEQ ID NO: 29875 - protein, 188 aa, Zea mays
  misc_feature: Ceres CLONE 1405120-F
  misc_feature (106)..(106): Xaa is any aa, unknown, or other
  misc_feature (177)..(177): Xaa is any aa, unknown, or other
MDDATAEEEASMFETSHVLGALLASSPLLARAWDRCTAASAAAPWFVHGEDGGKVYVGFSGVQAALTAAGAAVAGGGADIFAPVSLGGDAAGRMFAPLVAAEPDPXATREPVAVQALALQCFPELCCSPDFQMLLNQIRGKGSRGHGPLPWWRPCGPHGATLPLHLIVKLGTCSSCXVRHLWKPILWH

SEQ ID NO: 29876 - DNA, 769 bp, Zea mays
  misc_feature: Ceres CLONE 1405121-F
  misc_feature (443)..(443): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (600)..(600): n is a, c, t, g, unknown, or other
  misc_feature (601)..(601): n is a, c, t, g, unknown, or other
  misc_feature (605)..(605): n is a, c, t, g, unknown, or other
  misc_feature (616)..(616): n is a, c, t, g, unknown, or other
  misc_feature (630)..(630): n is a, c, t, g, unknown, or other
  misc_feature (663)..(663): n is a, c, t, g, unknown, or other
  misc_feature (664)..(664): n is a, c, t, g, unknown, or other
aagctggagctccccgcggtggcggccgctctagaactagtggatcccccgggctgcaggaattcgcacgagaccattacctagaacatcctaatcaaaaattcctcttgctcttcctcttccattcattagctgcactcgcctccctcgcgccaccgccttctcagccaccaccgccgcgggtgcctcagaaagtgcaggtgtggcccaagccggtgtccatctcgtggccgttgccggcatacgcgccgatctccccgtcgttcaacatccgcgcctcgccgtcgcacccgtcgctccgtcacgccatcgcgtactacacccgcctcatccgcaccgagcggtacacgccgattatcccccccgtcaactacaccggtctcgggcgtccccatccgcctgctcgcgctctccgtctcccgatcccgacgtcccgctcgggncccgcggggtcgacgagtcctaaaccgcttctccgtgccaccaatttcccaggtcggctgaattctctgccgccactccctggggaaattcaatcccggggggttcgagaccttctcccagctgcgccgnnnnnnnnnncttgaaaaaaaggggggnncccncacccaggggnaaacgacgtccccnagggagaaataaaatctcgaccacccctgtttnnccccccccccccgggggatccttctccgacccgcacgaaataaaaaaaaccccccggtcggtgaatacttcggaccatccggggcatgggcttcaaaaaaaaggg

SEQ ID NO: 29877 - DNA, 747 bp, Zea mays
  misc_feature: Ceres CLONE 1405122-F
  misc_feature: Encodes the peptide sequence at SEQ ID NO. 29878
  misc_feature (651)..(651): n is a, c, t, g, unknown, or other
  misc_feature (692)..(692): n is a, c, t, g, unknown, or other
  misc_feature (723)..(723): n is a, c, t, g, unknown, or other
tggagctccccgcggtggcggccgctctagaactagtggatcccccgggctgcaggaattcgcacgagaccattacctagaacatcctaatcgaaaagaggcccaaatatatctccccgcgtccgctagccctagccgccgtccgccgacttcatcgtcgccgtcgtctagacctcttcacgcactggaaaggttaaagtccgacatcaatggcgaagcatcatcctgatctcatcatgtgccggaagcagcctggcatcgcgattggccgcctttgcgagaaatgtgatggcaagtgtgttgtcttcgactcgtacgtgcgcccatgtacgcttgtccgggtctgcgacgagtgcaattatggttcgttccagggaaggtgtgtgatctgtggaggagtcggcatctcagacgcttactactgcaaggagtgcacccagcaggagaaggaccgggacggttgccccaagatcgtgaatctcggaagcgccaagacggatctcttctatgagcgcaagaagtatggttttaagaagagatgaccgagaagatggagctgtgtgtggttcactttggctgtgtggtctgttctatggcactgaatactgagagtaggcagctgagacagcagctttgtattcctgttatggnttgataatggaactggcatggaatacagctgtgatatgcgntgtataactaagtccactgtatgatgcaggnactggctatggatctgggctggag

SEQ ID NO: 29878 - protein, 110 aa, Zea mays
  misc_feature: Ceres CLONE 1405122-F
  misc_feature (1)..(106): Pfam Name: PHF5 Pfam Description: PHF5-like protein
MAKHHPDLIMCRKQPGIAIGRLCEKCDGKCVVFDSYVRPCTLVRVCDECNYGSFQGRCVICGGVGISDAYYCKECTQQEKDRDGCPKIVNLGSAKTDLFYERKKYGFKKR

SEQ ID NO: 29879 - DNA, 730 bp, Zea mays
  misc_feature: Ceres CLONE 1405125-F
  misc_feature: Encodes the peptide sequence at SEQ ID NO. 29880
  misc_feature (317)..(317): n is a, c, t, g, unknown, or other
  misc_feature (393)..(393): n is a, c, t, g, unknown, or other
  misc_feature (505)..(505): n is a, c, t, g, unknown, or other
  misc_feature (713)..(713): n is a, c, t, g, unknown, or other
aagctggagctccccgcggtggcggccgctctagaactagtggatcccccgggctgcaggaattcgcacgagaccattacctagaacatcctaatcgaaaaaaaacgcgcgcacacacaccgtacccctcagctcgcgccaccggccaccgcgcgcacacagaacgcgtgctccgtccgtcccccctctgcctcgcgcgcgcagggttagcgtgagctgatcgagcaacgagagctagctagctagctagctagaggacacgacacgatggccttgcaggtcaccggcggcgtgggctgctgctgccctccggcagntgccccggcggttgccgcaaggggcggcgctgtgtcgcccgccccgcgcggtagtgtccggcgcaaccagggtggntgggaggaggacgagggcaaggtgaggctgggcggctcaaggcgtcgcggtcaccaagctcggcattcggcgcgtgggtcctggggcgacaccacctactggaccgactccnagtgggatgataggagactgaggaaagcacaggacgcgttcgatgcgagcatcgataacgggatgaccttcttcgatactgcagaagtttacgtacagcactgaatgggagcagtcaattctgaaactttactaggaggattcatcagggaaggcaacagaagaacagatcgaaggtggcgttgcaacaagttcgccgcctttcctgnaaatttgaaaggggtac

SEQ ID NO: 29880 - protein, 113 aa, Zea mays
  misc_feature: Ceres CLONE 1405125-F
  misc_feature (17)..(17): Xaa is any aa, unknown, or other
  misc_feature (80)..(80): Xaa is any aa, unknown, or other
MALQVTGGVGCCCPPAXAPAVAARGGAVSPAPRGSVRRNQGGWEEDEGKVRLGGSRRRGHQARHSARGSWGDTTYWTDSXWDDRRLRKAQDAFDASIDNGMTFFDTAEVYVQH

SEQ ID NO: 29881 - DNA, 742 bp, Zea mays
  misc_feature: Ceres CLONE 1405126-F
  misc_feature (227)..(227): n is a, c, t, g, unknown, or other
  misc_feature (433)..(433): n is a, c, t, g, unknown, or other
  misc_feature (463)..(463): n is a, c, t, g, unknown, or other
  misc_feature (464)..(464): n is a, c, t, g, unknown, or other
  misc_feature (476)..(476): n is a, c, t, g, unknown, or other
  misc_feature (477)..(477): n is a, c, t, g, unknown, or other
  misc_feature (502)..(502): n is a, c, t, g, unknown, or other
  misc_feature (504)..(504): n is a, c, t, g, unknown, or other
  misc_feature (514)..(514): n is a, c, t, g, unknown, or other
  misc_feature (515)..(515): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (556)..(556): n is a, c, t, g, unknown, or other
  misc_feature (560)..(560): n is a, c, t, g, unknown, or other
  misc_feature (586)..(586): n is a, c, t, g, unknown, or other
  misc_feature (587)..(587): n is a, c, t, g, unknown, or other
  misc_feature (607)..(607): n is a, c, t, g, unknown, or other
  misc_feature (622)..(622): n is a, c, t, g, unknown, or other
  misc_feature (624)..(624): n is a, c, t, g, unknown, or other
  misc_feature (625)..(625): n is a, c, t, g, unknown, or other
  misc_feature (667)..(667): n is a, c, t, g, unknown, or other
  misc_feature (683)..(683): n is a, c, t, g, unknown, or other
  misc_feature (690)..(690): n is a, c, t, g, unknown, or other
  misc_feature (698)..(698): n is a, c, t, g, unknown, or other
  misc_feature (699)..(699): n is a, c, t, g, unknown, or other
  misc_feature (722)..(722): n is a, c, t, g, unknown, or other
  misc_feature (733)..(733): n is a, c, t, g, unknown, or other
  misc_feature (734)..(734): n is a, c, t, g, unknown, or other
tggagctcaccgcggtggcggccgctctagaatagtggatcccccgggctgcaggaattcgcacgagaccattacctagaacatcctaatcgaaaacccctcgtctcgtcgccgcctacgaaaatggctgcggtcgcgacactcctccgccacagccgccgcagccatgcccacgtcctccccatctcccgtggggtgtgcaccaccacccccaacaaccggcgggnacgatcccgttgccatcacgttgttggacgccgagagacaacaacctctccccgagcggggattccggaccgcgtggggtccatcctctacgccactcgacacagagggggatttcattctggtgttgttccaccagaggggattctcttctctcccgcgcggggggggccctttttttgttggttccccgcgcgcggtttttggntttaagagggaggagggggcgcctcccctnncctcttctcttnnccgcgcgcccccacaagcaccagananataatttttnntttttnnnnnnnnnnnnnnnnccccccgtctagctgcctcngagnatcagtcgtttccactgcgggtcctnncacccccactccccgtcccntcacgcctcttcacntnnttcaacgagcgcgcctacggacgcgtcctgtcctctcgtggnttccttccaggatttnccatcanccagatgnncactctattgcatccttgtaggnctactgcatgnnccgcgata

SEQ ID NO: 29882 - DNA, 707 bp, Zea mays
  misc_feature: Ceres CLONE 1405128-F
  misc_feature: Encodes the peptide sequence at SEQ ID NO. 29883
  misc_feature (567)..(567): n is a, c, t, g, unknown, or other
  misc_feature (623)..(623): n is a, c, t, g, unknown, or other
  misc_feature (639)..(639): n is a, c, t, g, unknown, or other
  misc_feature (640)..(640): n is a, c, t, g, unknown, or other
  misc_feature (707)..(707): n is a, c, t, g, unknown, or other
aaagctggagctccccgcggtggcggccgctctagaactagtggatcccccgggctgcaggaattcgcacgagaccattacctagaacatcctaatcgaaaaaactcgaaccgaagggacgaccgagcggagtctagactcgagagcaacctcgacctcccggatctctctcccacccacgcctcgtcggcgccgtcgtctgctgcagcgatggcctcccccgacctgctcttcaatctgcggaacctcttctacctgggcgcctaccaggtaggcatcaacaacagcgacgtcccgggcctcgacggctacgccgccgctgagcgcgacgccctcgtcttccgctcctacatcgccctcggctcctaccagctggtgatcagcgagatcgactcgtcagccgctacctcgctgcaggccgtgaagctgctcgcgctgtacctcactggagacaaggaaggtgctatctccagtctcaaggaatggttgagtgattcagcaattggaagcaatcctgttctgcggttgattgctgaatctctctccccaaactacccctcgccaggncccggcgatgtgcccaacgaagcccgatcgccctggccgggccgcgccggctcccngcgaagaagagctggnncgggaaggagcccgtggccacctgctcgctgcggctgggcgacttggacgtggaaccaacggtggcn

SEQ ID NO: 29883 - protein, 165 aa, Zea mays
  misc_feature: Ceres CLONE 1405128-F
  misc_feature (3)..(147): Pfam Name: Coatomer_E Pfam Description: Coatomer epsilon subunit
  misc_feature (138)..(138): Xaa is any aa, unknown, or other
  misc_feature (144)..(144): Xaa is any aa, unknown, or other
MASPDLLFNLRNLFYLGAYQVGINNSDVPGLDGYAAAERDALVFRSYIALGSYQLVISEIDSSAATSLQAVKLLALYLTGDKEGAISSLKEWLSDSAIGSNPVLRLIAESLSPNYPSPGPGDVPNEARSPWPGRAGSXRRRAGXGRSPWPPARCGWATWTWNQRW

SEQ ID NO: 29884 - DNA, 756 bp, Zea mays
  misc_feature: Ceres CLONE 1405131-F
  misc_feature: Encodes the peptide sequence at SEQ ID NO. 29885
  misc_feature (226)..(226): n is a, c, t, g, unknown, or other
  misc_feature (292)..(292): n is a, c, t, g, unknown, or other
  misc_feature (354)..(354): n is a, c, t, g, unknown, or other
  misc_feature (427)..(427): n is a, c, t, g, unknown, or other
  misc_feature (428)..(428): n is a, c, t, g, unknown, or other
ggagctccccgcggtggcggccgctctagaactagtggatcccccgggctgcaggaattcgcacgagaccattacctagaacatcctaatcgaaaagtaccatcacgcgccgcccgcccgcccttgattgagcagggactgggagagagggtgaaagggggcaagaaaacgcttcttgttgccgctgtgcttctgcggatccgcggtggctgcgcacgccggcggngaagaggagtcgctggcggcgcgcctccagtctttcttcacctccgtgctctccgggctcttcggncaggccgaggccgaggacgaggacgaagagatgcccacgcgcaaccacaacgctgccgcggntgccgctccgcagcatcaccatcacaaccggaggtggtgctccccgctctggaaggagcaaggccgtgcccgnncgagctgatgccatgaaccggcgagcccccctcggggatattgccaacctcggtaggggtcgccaaggccaaggggaacccccaggtggagggggagatcattcggcccatcaccggaaggtttcggggttcacttccggaaaaaaggggggggaaatgccccaataaaaaaggccgaccctccccccagaggttggcccaaggaaaaaaaaggaagttcctcgaaaaaacccccctcgggagggagaaaaaaccccccccccccccccaaaaaaagggggccctttggggagagccttccctcccccggcgggaggaagggaggccc

SEQ ID NO: 29885 - protein, 51 aa, Zea mays
  misc_feature: Ceres CLONE 1405131-F
MNRRAPLGDIANLGRGRQGQGEPPGGGGDHSAHHRKVSGFTSGKKGGEMPQ

SEQ ID NO: 29886 - DNA, 663 bp, Zea mays
  misc_feature: Ceres CLONE 1405133-F
tggagctccccgcggtggcggccgctctagaactagtggatcccccgggctgcaggaattcgcacgagaccattacctagaacatcctaatcgaaaacccctaccccatcgatccccgccgcccgactttccccgtgattcttctagaacctacccagctgtcgggggccttctctcacagaccgagatccctccccaccgagatcccgcgccgtgatggcgtcgagacggaggcggaggagtcgtcatggagcgggagcccaagtccgccgtacgaccgccctgagcccggtgcgggggaggagcaggcgcaagcgctgcagtgacgatatgcgcatgtatgcggagagtgagccgcgcaagaagatgggcaagaagtgggcctaatctctgctctcgatcatgacaaagtctggtaatcatcgtgctactggagatagaggagcacgtgcggttctgttccaggaacggaacttgctgataatggttggcccatagagctggagagtgaagagtatctagtgtctaggcatcctgagttccgctactagaccgaactccacagccatgaacctgagttggactacctacaaagtttggacatagaagagaagatgaacacgatcaagtggtgccaaactaccagcaatgcactctatctct

SEQ ID NO: 29887 - DNA, 718 bp, Zea mays
  misc_feature: Ceres CLONE 1405137-F
  misc_feature: Encodes the peptide sequence at SEQ ID NO. 29888
  misc_feature (356)..(356): n is a, c, t, g, unknown, or other
  misc_feature (393)..(393): n is a, c, t, g, unknown, or other
  misc_feature (477)..(477): n is a, c, t, g, unknown, or other
  misc_feature (478)..(478): n is a, c, t, g, unknown, or other
  misc_feature (534)..(534): n is a, c, t, g, unknown, or other
  misc_feature (539)..(539): n is a, c, t, g, unknown, or other
  misc_feature (549)..(549): n is a, c, t, g, unknown, or other
  misc_feature (557)..(557): n is a, c, t, g, unknown, or other
  misc_feature (628)..(628): n is a, c, t, g, unknown, or other
  misc_feature (669)..(669): n is a, c, t, g, unknown, or other
aagctggagctccccgcggtggcggccgctctagaactagtggatcccccgggctgcaggaattcgcacgagaccattacctagaacatcctaatcgaaaagagttctaggttagctgaaatctcccttattgtaatctgttcatctcctggcgtgagtctgtggcgctagtgtgatgccttctcctagctcatggcttccggttcgcaatccctaatcctgatctcacttaagcgctcgtgagctctctccagtggctaaagattgcagatttgagttatagtccaagaaacgggtggtggtccgccatggaggtgaggtccgagcaagggctgatggcggggagggatctattncgtatgccaaagagcccgccggcgccggtttccgggnccgcggcgtccgccgccatgcagagcgtgcgcatggcgtacacctcggacggcaccgctgtgttcgctccgatgagatcctcgnncgcgacgccgtcttaccagccgcagggtgcagcccacggcgctagcatgtccgcgncgacnatcattggangcaatggncgcggcagctgcgccgagcattgggggaagccgtgcccaaaaaagggcggcggcgaccaaggagtatgggncccgacggtccatggcgctggcattggggccttgtgtcggnggttaacgggtcccgacgaaagggccaggttcctctggggcgttcccac

SEQ ID NO: 29888 - protein, 136 aa, Zea mays
  misc_feature: Ceres CLONE 1405137-F
  misc_feature (16)..(16): Xaa is any aa, unknown, or other
  misc_feature (29)..(29): Xaa is any aa, unknown, or other
  misc_feature (57)..(57): Xaa is any aa, unknown, or other
  misc_feature (76)..(76): Xaa is any aa, unknown, or other
  misc_feature (81)..(81): Xaa is any aa, unknown, or other
  misc_feature (107)..(107): Xaa is any aa, unknown, or other
  misc_feature (121)..(121): Xaa is any aa, unknown, or other
MEVRSEQGLMAGRDLXRMPKSPPAPVSGXAASAAMQSVRMAYTSDGTAVFAPMRSSXATPSYQPQGAAHGASMSAXTIIGXNGRGSCAEHWGKPCPKKGGGDQGVWXPTVHGAGIGALCRXLTGPDERARFLWGVP

SEQ ID NO: 29889 - DNA, 719 bp, Zea mays
  misc_feature: Ceres CLONE 1405140-F
  misc_feature: Translation starting site: 210
  misc_feature: Pfam Name: Uricase Pfam Description: Uricase
  misc_feature: SWISSPROT Homolog: EC 1.7.3.3 Urate oxidase
  misc_feature (360)..(360): n is a, c, t, g, unknown, or other
  misc_feature (367)..(367): n is a, c, t, g, unknown, or other
  misc_feature (402)..(402): n is a, c, t, g, unknown, or other
tggagctccccgcggtggcggccgctctagaactagtggatcccccgggctgcaggaattcgcacgagaccattacctagaacatcctaatcgaaaaagcgcaacgcaaacccagacggcccgccagacccagcggtcgcttactcgcatcgcagcgcactcgcgccacagtcggcatcacagaccagatccctgcgggtgcggcggccatggccgagaacttccaactccagggccggcacggcaagtcccgcgtccgcgtctcccgcgtctggcgccgcccggccgcggcggggggcgacgtcatcgttgagtggaacgtcgccgtcagtatcgtctccgactcctccccctctacancctccgngacaactccgccatcgtcgccacagattccatcangaacaccgtgtatgtcaaggcgaaagagtgcacggaagtgtgtccatgaagaaattcgccgggattctgggagggcattcacctcgctgaaccctcagggtttcaaggccccgtgacaattcgggacggcccttggaacgggggattgtcaccaaaacccccttcccagggggtcaaggggggggtggaaaacccaccaaggggctttggaaaaaaacgggggccggggttaaaatttggaaatagagaatccccgtgtaaaaaaaaacccccttggttaaaagggttcggaaaacacctattattttttccctaaa

SEQ ID NO: 29890 - DNA, 705 bp, Zea mays
  misc_feature: Ceres CLONE 1405144-F
  misc_feature: Encodes the peptide sequence at SEQ ID NO. 29891
  misc_feature (325)..(325): n is a, c, t, g, unknown, or other
  misc_feature (328)..(328): n is a, c, t, g, unknown, or other
  misc_feature (329)..(329): n is a, c, t, g, unknown, or other
  misc_feature (338)..(338): n is a, c, t, g, unknown, or other
  misc_feature (355)..(355): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (525)..(525): n is a, c, t, g, unknown, or other
  misc_feature (526)..(526): n is a, c, t, g, unknown, or other
  misc_feature (532)..(532): n is a, c, t, g, unknown, or other
  misc_feature (534)..(534): n is a, c, t, g, unknown, or other
  misc_feature (552)..(552): n is a, c, t, g, unknown, or other
  misc_feature (553)..(553): n is a, c, t, g, unknown, or other
  misc_feature (555)..(555): n is a, c, t, g, unknown, or other
  misc_feature (558)..(558): n is a, c, t, g, unknown, or other
tggagctccccgcggtggcggccgctctagaactagtggatcccccgggctgcaggaattcgcacgagaccattatctagaacatcctaatcgaaaacttgttcgccagccgtacgtcttcgtcagtgtcgtgtactcgttttcccttccaaggcacccgttgcgagggcggaggcgccgatggccggggcgggggcgggggcgggagcgggggcgctggccgggctcgcagcgtgcgcgacgctggcgtgcaacgtcgcaggcgccgtgctcttcctcctcagccaagacgacgagcggctgcggcgcgggtgtgcggcgaggntgnncgctggcgncgtcgcgtcgcacccgntgcaggagcgcggggagggagaggccctcgcgccggaacgcgtcctcaacccccacttcggcgaaccgacgatgtaccgggccggtctgcccgcaagttagggactgcggcgccaccgcgatcctggggtgtcccggggatgagctccttccccaacggggannnccggnncccccngnttcccccccccggagccnnanccnccggggtttggcctccccctgcttcctcggacccggtgtcccctttggcccgccgccttttgtcccgaactggctctctcccccgctttcccccgcccgccccgtccagtgttacatttctccgtgcctttccgaaaacctctatta

SEQ ID NO: 29891 - protein, 91 aa, Zea mays
  misc_feature: Ceres CLONE 1405144-F
  misc_feature (49)..(49): Xaa is any aa, unknown, or other
  misc_feature (50)..(50): Xaa is any aa, unknown, or other
  misc_feature (53)..(53): Xaa is any aa, unknown, or other
  misc_feature (59)..(59): Xaa is any aa, unknown, or other
MAGAGAGAGAGALAGLAACATLACNVAGAVLFLLSQDDERLRRGCAARXXAGXVASHPXQERGEGEALAPERVLNPHFGEPTMYRAGLPAS

SEQ ID NO: 29892 - DNA, 642 bp, Zea mays
  misc_feature: Ceres CLONE 1405150-F
  misc_feature: Encodes the peptide sequence at SEQ ID NO. 29893
  misc_feature (567)..(567): n is a, c, t, g, unknown, or other
ggagctccccgcggtggcggccgctctagaactagtggatcccccgggctgcaggaattcgcacgagaccattacctagaacatcctaatcgaaaaatctcgtccacgaaacgtacggacttcgggcatcggccccaacgccagcggcaccgcaccaccacgcccgtcggcgacatgaatccgcccgcagcagccgcgtccaccggcgcaggaggccacgccgcggcgcctgcggcagcccgggagtacgtgcactacccgaggctctcgccagaggaggtggccccgcccccgcccccgccttatcacgccgccaccgccgcgccgtccgcctacggaggcaacccctacatctactcccccgccggcggcgccgccacctccccgaagaatacgatggactccgtgaaggacgtgctcggcaagatggggaagaggtttggcgaggcggcccgcaagaccgagaccatcaccggcaatttctggcagcactgtgagcttttcgatttcgttgccgtattttcacgaaatcgggttccgaagttgtttctgtgtgtttttcatcanattgctaatcgtgttgtgcatttttcatgtacattttgttattgtaatatgaaattaggttgtcgttaagctgtt

SEQ ID NO: 29893 - protein, 153 aa, Zea mays
  misc_feature: Ceres CLONE 1405150-F
  misc_feature (131)..(131): Xaa is any aa, unknown, or other
MNPPAAAASTGAGGHAAAPAAAREYVHYPRLSPEEVAPPPPPPYHAATAAPSAYGGNPYIYSPAGGAATSPKNTMDSVKDVLGKMGKRFGEAARKTETITGNFWQHCELFDFVAVFSRNRVPKLFLCVFHXIANRVVHFSCTFCYCNMKLGCR

SEQ ID NO: 29894 - DNA, 679 bp, Zea mays
  misc_feature: Ceres CLONE 1405151-F
  misc_feature (613)..(613): n is a, c, t, g, unknown, or other
aaagctggagctccccgcggtggcggccgctctagaactagtggatcccccgggctgcaggaattcgcacgagaccattacctagaacatcctaatcgaaaagacgacacacctgacacgtgggtctatcagtcatcctggtccttttattttctttcttctctcacccggttcttcctcctcccgagtcccgaactctcgatccactcatccgctgagggcgtcggccttctggcccttctccccccggccgacctcgcccctccggcgctccgtccgcttcctgaactcgtctccctcacggacgttctcctccctccgctcgccgcgccgcaacccggagaggagaccgccgctcggtcgagcaccacctggggcccagcgtcctcgcgaccagctctagcgcggcgtccgccctctgcagccctggtgtccccgcgactggcttcggccggcacacaactccacagttaggtctccgtctgcacagcgcggcgatcttctctctccttcccgccctctgcagtccctctcagtccctctccgtctgcttgattctgctccaacctcagactaccctcgctctgaaaatgtcattacgcacccaatgcgncttgtagctgtatgctgcaaccctactctgcctcgtcttcttccatcaccctaagcatgcgcgcaa

SEQ ID NO: 29895 - DNA, 662 bp, Zea mays
  misc_feature: Ceres CLONE 1405152-F
  misc_feature: Translation starting site: 156
  misc_feature (83)..(83): n is a, c, t, g, unknown, or other
  misc_feature (363)..(363): n is a, c, t, g, unknown, or other
  misc_feature (393)..(393): n is a, c, t, g, unknown, or other
  misc_feature (394)..(394): n is a, c, t, g, unknown, or other
  misc_feature (401)..(401): n is a, c, t, g, unknown, or other
  misc_feature (402)..(402): n is a, c, t, g, unknown, or other
  misc_feature (410)..(410): n is a, c, t, g, unknown, or other
  misc_feature (458)..(458): n is a, c, t, g, unknown, or other
  misc_feature (477)..(477): n is a, c, t, g, unknown, or other
aaagctggagctccccgcggtggcggccgctctagaactagtggatcccccgggctgcaggaattcgcacgagaccattaccntagaacatcctaatcgaaaaagacttgttcggcctcttcgacggcgtgcccgtctcgtcgagctcattcgccatgccttcctcagcctccgcgagaggaggacgagggctcctcttgccggcggctgctgcggcggttgtggtgctaatattgggtgcagtggcgccagcggcgggttgttatccgcgcgtgttcagcttcggggactcgctggccgacacggggaactacccgttcgtctacggcaacgactctgggtctggcggggccgcgctccggncacccctacgggagaccttcttccacgcgnncacgggnngcgctccnatggggcgctcgtggtcgacttcatcgcggacacgctggggctcccgntcgtgcgaccgtatctgancggacggagcggcgagggacttcccgggggggggcaaacttcgccggtcgggggggccccggggctaagcccggactttttccggggcagggggtttcgacacctgggggaaaacaagggggaccccccactgggaaaattaaagggggtccccggggtctggttttaaccaaaattgtggcccc

SEQ ID NO: 29896 - DNA, 712 bp, Zea mays
  misc_feature: Ceres CLONE 1405158-F
  misc_feature: Translation starting site: 429
  misc_feature (476)..(476): n is a, c, t, g, unknown, or other
  misc_feature (480)..(480): n is a, c, t, g, unknown, or other
  misc_feature (482)..(482): n is a, c, t, g, unknown, or other
  misc_feature (485)..(485): n is a, c, t, g, unknown, or other
  misc_feature (486)..(486): n is a, c, t, g, unknown, or other
  misc_feature (490)..(490): n is a, c, t, g, unknown, or other
  misc_feature (614)..(614): n is a, c, t, g, unknown, or other
caaagctggagctccccgcggtggcggccgctctagaactagtggatcccccgggctgcaggaattcgcacgagaccattacctagaacatcctaatcgaaaaaaaaaaaaagtggacccctccgccctccgacgtaccaccgcgcctccgcatttcgcatcatgaccagagcggcggcagaggtgcctctccggccggagatccgagtgagaaccgccgcttccccctccgtctcctcattttgaaatcgcgttttgtggggtctatctccgccgcaccgggcaccatctctcctccgctggaacgctacttaaccggctcgatttgctccccatttccccgtgcagcctaaatacctgagccgaaaccctaggaccccgcgcctccgcttccgcttccccctctcccgcagctgacgaggccgacgatgggggacaaggagaacgcactccttggggcccgggggggggcgggncggncnatnnatcntgtgttccgcgtcctgactagctggagaagggatctgcatattgctaaacaaacacaagacattggattttatggctggttttgttggcgcttcatatatgtgtggggagggcagtctcctcancagtatggggaatcgggactgataaggatggaaggaaaccagttatcgtactgaaccttattggaatagttatcttcaatactatgtttggactaagt

SEQ ID NO: 29897 - DNA, 672 bp, Zea mays
  misc_feature: Ceres CLONE 1405171-R
  misc_feature (26)..(26): n is a, c, t, g, unknown, or other
  misc_feature (71)..(71): n is a, c, t, g, unknown, or other
  misc_feature (86)..(86): n is a, c, t, g, unknown, or other
  misc_feature (188)..(188): n is a, c, t, g, unknown, or other
  misc_feature (211)..(211): n is a, c, t, g, unknown, or other
  misc_feature (218)..(218): n is a, c, t, g, unknown, or other
  misc_feature (327)..(327): n is a, c, t, g, unknown, or other
  misc_feature (335)..(335): n is a, c, t, g, unknown, or other
  misc_feature (386)..(386): n is a, c, t, g, unknown, or other
  misc_feature (427)..(427): n is a, c, t, g, unknown, or other
  misc_feature (467)..(467): n is a, c, t, g, unknown, or other
  misc_feature (470)..(470): n is a, c, t, g, unknown, or other
  misc_feature (473)..(473): n is a, c, t, g, unknown, or other
  misc_feature (476)..(476): n is a, c, t, g, unknown, or other
  misc_feature (478)..(478): n is a, c, t, g, unknown, or other
  misc_feature (502)..(502): n is a, c, t, g, unknown, or other
  misc_feature (511)..(511): n is a, c, t, g, unknown, or other
  misc_feature (523)..(523): n is a, c, t, g, unknown, or other
  misc_feature (559)..(559): n is a, c, t, g, unknown, or other
  misc_feature (606)..(606): n is a, c, t, g, unknown, or other
  misc_feature (646)..(646): n is a, c, t, g, unknown, or other
ccaattgggtaccgggccccccctcnaggtcgacggtatcgatattttttttttttttttttggttaatanataatattaatatanaaaaaaaggaaataaactactgcaaaattgcaaaaaatccaaagcatctgaaattctagatcttctacgctctaaacataaatcctcacttcttctaccaancgtgcaacacaaactgaaagcanccagccntccacctccatcgccaaactgtccgcccctcgtctcacacccaccatttattcctctgaatccatgcctgctactgaagagctgcccggcgtcttctcctctgctgccntgccttcnccggcggctgtccagtaccgcttgacagcgaaaagcaccttctcaggcacnttggggccgtcctcatggtttgccagcagcgtcttccaacncatccccttcaccgtcctctgcaccttgagcaggacctcnacntcntcncnaaggatcacggttccctctgggcncaggatccnatccatctccancaggatgtcctccattctgcacctgtccttgtaaanagtgaagatgccattggcatgtatgaagtcctatgttcttggataanttgagaatgcctcacaccaggcgtggtggatggcaagtanccccctctcgtacacacggcgacgtg

SEQ ID NO: 29898 - DNA, 669 bp, Zea mays
  misc_feature: Ceres CLONE 1405178-F
  misc_feature: Translation starting site: 178
  misc_feature: SWISSPROT Homolog: EC 1.11.1.11 L-ascorbate peroxidase
aaagctggagctccccgcggtggcggccgctctagaactagtggatcccccgggctgcaggaattcgcacgagaccattacctagaacatcctaatcgaaaagaccctcgcttcacttggcacggactcgcgtccacaaaccacaaccagctcactcaagaacaaagaacccaacccatggcttctcccaagccgctcctcctgctcgccacctcgttcctgagctgcggcctcctggaggccgccgactacgccccaatgaccctgaccgtggtgaacaactgcccctacccggtgtggccgggcatccaggccaactcgcgggcacgaggactctggagggcggtggattcttcctcccgccgctctcccacaagtccttcccggcgccgggccacccctgggccggtcgcatctgggcgcgcacgggctgcgcgggcgccagcgcgtagctcgactgcgccacggacgactgcggcggtcggcccatttgaggcaggcgtcgggaacctgaaattcctttcaccctgggatgagaggacaagccccaggcacactcagagactcctcactctgatgacgcagagggctgtgaccacttgaggcaggtcttcataaagcagaagggtctaactgaacgtcacattgtcgcttgccgagataaccaca

SEQ ID NO: 29899 - DNA, 710 bp, Zea mays
  misc_feature: Ceres CLONE 1405179-F
  misc_feature: Translation starting site: 221
  misc_feature (274)..(274): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (298)..(298): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (307)..(307): n is a, c, t, g, unknown, or other
  misc_feature (309)..(309): n is a, c, t, g, unknown, or other
  misc_feature (310)..(310): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (317)..(317): n is a, c, t, g, unknown, or other
  misc_feature (319)..(319): n is a, c, t, g, unknown, or other
  misc_feature (320)..(320): n is a, c, t, g, unknown, or other
  misc_feature (323)..(323): n is a, c, t, g, unknown, or other
  misc_feature (325)..(325): n is a, c, t, g, unknown, or other
  misc_feature (326)..(326): n is a, c, t, g, unknown, or other
  misc_feature (329)..(329): n is a, c, t, g, unknown, or other
  misc_feature (374)..(374): n is a, c, t, g, unknown, or other
  misc_feature (377)..(377): n is a, c, t, g, unknown, or other
  misc_feature (400)..(400): n is a, c, t, g, unknown, or other
  misc_feature (407)..(407): n is a, c, t, g, unknown, or other
  misc_feature (450)..(450): n is a, c, t, g, unknown, or other
  misc_feature (451)..(451): n is a, c, t, g, unknown, or other
  misc_feature (591)..(591): n is a, c, t, g, unknown, or other
  misc_feature (692)..(692): n is a, c, t, g, unknown, or other
  misc_feature (693)..(693): n is a, c, t, g, unknown, or other
  misc_feature (708)..(708): n is a, c, t, g, unknown, or other
aaagctggagctccccgcggtggcggccgctctagaactagtggatcccccgggctgcaggaattcgcacgagaccattacctagaacatcctaatcgaaaaaaacaaatcgacctagctaggcacaagagcgctagacgccgcagcgcagcacgcaccacccaccgagcggcggcggaggcagggcaatccgcagggagcagaggccgcgcgcgcaggcatgggcgcgccggtgcacggcgccctcgccttgttcctcctgctcctggggggngccagggggcgnnnnccnnnnnanannnnnncncnngnnnncncnntgncnnccnccgccccccgcgctcccggcccgccggggggcgggggccaccccngcncccggctggcggcgcggccgcgnccgcgcngcgccgcgcgggcggagggggcggagaaggcgccgctccggcnnacacaggaggacgccgacggcacgcacaacggcaccagcaccgcgccgcgaagcgaggcgcgggagcgggagccggacccggcagccaagcgcaaccggcaggggccacgcagaggcgggccgcggcaggcaccgccgcncaacaccgcccccgcacggcgccggcccccccagaccgggcccgcgacggcccacccgaggcgggccggagaggacgccaagcccgggccccaccggaacnncaaccacgccagagnct

SEQ ID NO: 29900 - DNA, 737 bp, Zea mays
  misc_feature: Ceres CLONE 1405184-F
  misc_feature (571)..(571): n is a, c, t, g, unknown, or other
  misc_feature (641)..(641): n is a, c, t, g, unknown, or other
  misc_feature (652)..(652): n is a, c, t, g, unknown, or other
  misc_feature (713)..(713): n is a, c, t, g, unknown, or other
aagctggagctccccgcggtggcggccgctctagaactagtggatcccccgggctgcaggaattcgcacgagaccattacctagaacattctaatcgaaaactcccagctcctcctccctgtctgctcccctccactgctgtggcgctctccctctcccgtctcccctcaccttctccacctcccccattccgccaccgcacaagccgacctccctcaccaagaggagaaaagaaagggagagcgaaggaggcaaaccaggtgggacagcaacgcgacgtgcttgctattctctcgagagagatgtcaattttataataaaaccccagcatgcgtcagctggcgaattatgacttgagctcatgcaaggtgtaagtcttactgcaagaagggcagctgtgcatgttaagacccatacatagcctctcttgattacacagcacggggggtgaaaacttgagatacagttgatctcctggttcagagtatgggttcaaggtttgcatcgcatcagctgagcaatgggctgtatgtttctggtcgacctgagcaaccctaagagaaagccccanccattttttccactgcgatgccatatactgggggtgacatcaagaatcaggagagctggggaagatgttngatctccatgntgagaaagcaagaaaatctggtcctctaagaaatgctccttcaagaatactttcatttggnagtgctgcttccaactctggaccc

SEQ ID NO: 29901 - DNA, 650 bp, Zea mays
  misc_feature: Ceres CLONE 1405189-F
  misc_feature: Encodes the peptide sequence at SEQ ID NO. 29902
tggagctccccgcggtggcggccgctctagaactagtggatcccccgggctgcaggaattcgcacgagaccattacctagaacatcctaatcgaaaaatcgattcattcaactgaacagcaagcgcacctaccctacccgccgccgccgaaggcgaaggcctagctcccggtccggcgcgatggctgccgcggcccgccgcggcccgccgcggccccggggcgctcctcctcgtggcgctcctcctgctggcgctggtcgtctccgggcactgcctggacgcgcaccaccgcgggctgaagcgccgccggcggaagcacgagattcactctccgatcaagacggtggtggtcgtggtgatggagaaccgcagcttcgaccacatcctcggctggctccgccgcacccgccccgacatcgacggcctcacgggccgcgagtccaaccgcctcaacgcctccgacccctcctccccggatatcttcgtcacggacgaggccggctacgtcgactccgaccccggccacggtttcgaggacatccgggagcagatcttcggctccgccgacacctccgcggtgccgccgcccatgtccggcttcgcccagaacgcgcgcggcatgagcctcggcatgccgcagaacgtcatga

SEQ ID NO: 29902 - protein, 97 aa, Zea mays
  misc_feature: Ceres CLONE 1405189-F
MENRSFDHILGWLRRTRPDIDGLTGRESNRLNASDPSSPDIFVTDEAGYVDSDPGHGFEDIREQIFGSADTSAVPPPMSGFAQNARGMSLGMPQNVM

SEQ ID NO: 29903 - DNA, 686 bp, Zea mays
  misc_feature: Ceres CLONE 1405194-F
  misc_feature: Encodes the peptide sequence at SEQ ID NO. 29904
  misc_feature (613)..(613): n is a, c, t, g, unknown, or other
tggagctccccgcggtggcggccgctctataactagtggatcccccgggctgcaggaattcgcacgagaccattacctagaacatcctaatcgaaaactctccccaccggctaaccctagcagcggcacgcgggcgacggcgaccagtagagggctagtcgcgccaccggcgaagggattcagcggtctacccgtcctccgacacaggcgcggcggcgtcctgcagattattattggtttgttgcaaaatgtctacggaagtgactttgaacaattctggtggttctgaatctgcattgctgttactggaacagcttgctgaagtttttggaaagttgaaaactcacaccgaaacatttctgcaattgcaaaatggcataaaatgggaagatattgaagggcatttcctcagccttgatgagtcgtacagaagcaagtttgatgaactggtagagaaggagaaggcattagaagaaaagaaagctgaagcttgtagattgattgcagagaaaagagctaaagtttctacaaaagagcatgcctcactgaatcagcttcaggagctaagggatgctgctgtctcttctctaagagaggttcgacaaaaatatangtgggagtttgctgagatacttggagcaaggggaagcaaagacaaaaagttaagaagctctatcatgggcacc

SEQ ID NO: 29904 - protein, 146 aa, Zea mays
  misc_feature: Ceres CLONE 1405194-F
  misc_feature (122)..(122): Xaa is any aa, unknown, or other
MSTEVTLNNSGGSESALLLLEQLAEVFGKLKTHTETFLQLQNGIKWEDIEGHFLSLDESYRSKFDELVEKEKALEEKKAEACRLIAEKRAKVSTKEHASLNQLQELRDAAVSSLREVRQKYXWEFAEILGARGSKDKKLRSSIMGT

SEQ ID NO: 29905 - DNA, 647 bp, Zea mays
  misc_feature: Ceres CLONE 1405197-F
  misc_feature (52)..(52): n is a, c, t, g, unknown, or other
  misc_feature (604)..(604): n is a, c, t, g, unknown, or other
aaagctggagctccccgcggtggcggccgctctagaactagtggatcccccngggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggatacgacgatatgagggagtgcatctccgtcacatcgggcaggccgggattccaggcgggaaggcgggttggaactttactgcctcgaaaaggcatccaacctgatggccaaggccccggaaaaaaaacccggggaatacaaaaaaaggccttaaaaacctttttataacaaaatgggggtgggaaaaacagttcccccgggaaaatttttgggatttaaaaaccccctgggtacaaaaagggggcccctggggaaaaacccccctttttttccccctggggagatttttctcaggggggggggggggggggggggaaaaaatttctccccggggggccccaaaaacaattttgnaaaaaaaaattttttgtgggggggcctcaaaaagaaaaccaag

SEQ ID NO: 29906 - DNA, 745 bp, Zea mays
  misc_feature: Ceres CLONE 1405204-F
  misc_feature (566)..(566): n is a, c, t, g, unknown, or other
  misc_feature (570)..(570): n is a, c, t, g, unknown, or other
caaagctggagctccccgcggtggcggccgctctagaactaagtggatcccccgggcttgcaggaattcgcacgagaaccattaacctaagaaacattcctaatcgaaaaaccctcccccactgccatttgctcatcaagacgactagaggcatccctgagagacagctggttcatttctggatgctgccttgctggcgccaaccctcggcgcaggcagccaaacaacagacagagctagatgtatgagaacgaccggatgctagtggcgatggcgagggcgctcggctgcacatgtggtggctgcgctgctccaagagcggtggagtcgatggcctcacgccggggtctctcgggttgcccagatggtgtggagactgatcaagttgatcctgcggtgacttgcccttcatgtacgtgttgcgcgacctccagtgataactacgggctcatcttcaccgagctccgtgtgcaagagctcactctatcgagagcatcattggtagagctcatccacaaggagcttgcgtgaattatctccccatgtctcgagagacggctcagagnacangcgaaggccgacctctttttcaaagtctaccagtgcaccgacaactcgtggtgctacgaacccctctgtaaaagagctctgctacggactgtcataaccgagatcgagagcaagccgcgcgtcaaagatatctctaggaaaacaccaccgggctcggtgaaggaacactattgaa

SEQ ID NO: 29907 - DNA, 666 bp, Zea mays
  misc_feature: Ceres CLONE 1405206-F
  misc_feature: Encodes the peptide sequence at SEQ ID NO. 29908
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
aagctggagctcaccgcggtggcggccgctctagaactagtggatcccccgggctgcaggaattcgcacgagaccattacctagaacatcctaatcgaaaaacccgacccgcctccaactccaagccaagccgccatggcggctccgcccgcgaccaccgccacgactcaccaccgcgcgctcctcccgcccacgcgcacccacgccgccgctacgcactccgcgctccgcctcccgctccgcgcgcatccccacgcccacgcccagcgcgcgcgcctcaccgccgccgctgccccggcccccgcggcgtcgacggcctccctcgagtcctccgccgcggggaagcctacggtgctcgtggccgagaagctcggcgccgcggggcttgcgctgctgcgggaattcgccaacgtcgactgctcctacggcctctcccccgaggacctccgtgccaagatctcgctctgcgacgcgctcatcgtcaggtccgggaccaaggtcggccgcgacgtcttcgaggcgtccgggggcagctccgcgcgcgnnnggggggccgcggggtcggaatcggacaacgtcgaactttgccgccgccaccgaagcacggatgtgcctcgtcgtcaacgcgcccactgccaacaccggtcgccggccgccgagcatggc

SEQ ID NO: 29908 - protein, 177 aa, Zea mays
  misc_feature: Ceres CLONE 1405206-F
  misc_feature: SWISSPROT Homolog: EC 1.1.1.95 Phosphoglycerate dehydrogenase
  misc_feature (137)..(137): Xaa is any aa, unknown, or other
  misc_feature (138)..(138): Xaa is any aa, unknown, or other
MAAPPATTATTHHRALLPPTRTHAAATHSALRLPLRAHPHAHAQRARLTAAAAPAPAASTASLESSAAGKPTVLVAEKLGAAGLALLREFANVDCSYGLSPEDLRAKISLCDALIVRSGTKVGRDVFEASGGSSARXXGAAGSESDNVELCRRHRSTDVPRRQRAHCQHRSPAAEHG

SEQ ID NO: 29909 - DNA, 620 bp, Zea mays
  misc_feature: Ceres CLONE 1405208-F
  misc_feature: Encodes the peptide sequence at SEQ ID NO. 29910
gctctagaactagtggatcccccgggctgcaggaattcgcacgagaccattacctagaacatcctaatcgaaaatggagaaatctggacagaatgctcatatattgttgtctatgttagtcaagcatcttgaacacaagaatgtattgaaacaaccagatatgaatctagatatcattgaagttacttcacgccttgctgaacactccaaagctcagtcttctatagcactaatgtcttcaataagtgatatggtcaggcatatgggtaaaagcatgcaatccttggccagtgatgcaggtcctggagacaacatggtcaaatggaatagcagatatgggaaagctgtagatgaatgtcttgttcagttgtctagaaaggtcggtgatgctggacctatccttgatacgttagctgtagtactggaaaatatttcgagttctatgattgttgcacggtctactatctctgcagcatatcgcactgctcaaatagttgcatcattgccaaacttgtcacatcagagcaaagcatttcctgaggcgttgtttcatcaacttcttttagcaatgctctatccagattgtgagacacatttaggagcacatcggattttctctg

SEQ ID NO: 29910 - protein, 182 aa, Zea mays
  misc_feature: Ceres CLONE 1405208-F
MEKSGQNAHILLSMLVKHLEHKNVLKQPDMNLDIIEVTSRLAEHSKAQSSIALMSSISDMVRHMGKSMQSLASDAGPGDNMVKWNSRYGKAVDECLVQLSRKVGDAGPILDTLAVVLENISSSMIVARSTISAAYRTAQIVASLPNLSHQSKAFPEALFHQLLLAMLYPDCETHLGAHRIFS

SEQ ID NO: 29911 - DNA, 777 bp, Zea mays
  misc_feature: Ceres CLONE 1405211-F
  misc_feature (219)..(219): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (242)..(242): n is a, c, t, g, unknown, or other
  misc_feature (243)..(243): n is a, c, t, g, unknown, or other
  misc_feature (248)..(248): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
aagctggagctccccgcggtggcggccgctctagaactagtggatcccccgggctgcaggaattcgcacgagaccattacctagaacatcctaatcgaaaagaggtggagagatcgcacgcgccctctgccgcttgttcgttcctcgcgcttgccaccaggcaccaccacacacatcccaatctcgcgaggcggcgagggcaagcagcaggggtctgcnggcggnnnatnnntnnnnnntcnnccttncgttttcaaggaggnnncgcgcgtcttcctcggacgctatcgcgtttctgcccgggcccaccacctccctcctactccaacccgggcagtcggccgcctcacctccactcacaccggaaacctccgaacgcctctcgtcgaaccccccacgaaaaaccgctcctagccccaagcccctgacttggggccaaagcacctacctaccctccctcgggaaccggcagacaaccctacgacctccagcaaacccccgcccaagacacacgcatcctcgccataaccgagaacggggccctttctacccccctcacccccaatcaataagaaaggcctctccaaggggaaggttctcgggagtaagaccaaaataaagggccggagcaccgcccctgccacggcggcacgggggcccacacctggcgcccacagcgccctgacgggtccgggtggtcccacgggcgcctcccaaaccggcgcacgcggaagacaatagttccgaagccgccaccacacaccggccctcaccatg

SEQ ID NO: 29912 - DNA, 704 bp, Zea mays
  misc_feature: Ceres CLONE 1405213-F
  misc_feature: Encodes the peptide sequence at SEQ ID NO. 29913
gctggagctcaccgcggtggcggccgctctagaactagtggatcccccgggctgcaggaattcgcacgagaccattacctagaacatcctaatcaaaaaaaacaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgcgttctccgggtcggcgaacctcaagcacgtcgagctggggtaccagtacctggtgaaccacttcctgacgctgctgctgccgccggtgacggccgccccgtccctggagtcggcgcgccccgcgcccggcgatctgttctccctgtggcgctcgctggacctgtgagcgggccactccgtccgccccgggatccgggctgcgtcttcggcacggtgaaccggatctcggcgctcaaacccccgaaaatggcgccctggccggctgcgggcgcgcccgccggtgcgccgggcctatcgtcccggtcctggtggggcgcgcttactatcccacgtcgcccagggccgcgtccttccaaagaggatcgttgtccgcccccgcccccgaccgggcacgtctattctgcacgccttccatcc

SEQ ID NO: 29913 - protein, 60 aa, Zea mays
  misc_feature: Ceres CLONE 1405213-F
MPSGSAFSGSANLKHVELGYQYLVNHFLTLLLPPVTAAPSLESARPAPGDLFSLWRSLDL

SEQ ID NO: 29914 - DNA, 728 bp, Zea mays
  misc_feature: Ceres CLONE 1405214-F
  misc_feature: Encodes the peptide sequence at SEQ ID NO. 29915
aaagctggagctccccgcggtggcggccgctctagaactagtggatcccccgggctgcaggaattcgcacgagaccattacctagaacatcctaatcgaaaaaacctcctctgcctgccgcttctcctgctgcgggcggtcacggctgcaagtactagaggaggacatccgcttccattactgcgcctgcggaggatcggaggaatcagcagcggaggcttcgattttcggcgggcgcaataaatttcccgcatggatcggaggatcgcgtcctcgttcgactcgcgctgcctcctggcgagggcccctgacggcgcgccgcccgctgccccctctgcgctgcgcaggacagtgcctgaagatgggatgcacagggtgatgccaggagtccttcaaaggttcagcactgcagcagcagtagaggagcccatcacgccgtcagttcatgtgaactacacaaagctcctcattaatgggaactttgatgattccgcatccggcgagaccttcccagctctagaccctcgtacaggggaggtgattggtcatgtggctgcagtgcgcgcacagcacattatccgtgcagaatctgcggatcgcagggtttttgatgaaggggccttgaccgaagtccgactgcccattggcacgcccggggtgaaattggggttttaggcaaccgacccgcaagagcccccgacctactttccacgtcggcccacccgggc

SEQ ID NO: 29915 - protein, 140 aa, Zea mays
  misc_feature: Ceres CLONE 1405214-F
  misc_feature: SWISSPROT Homolog: EC 1.2.1.3 Aldehyde dehydrogenase (NAD(+))
MDRRIASSFDSRCLLARAPDGAPPAAPSALRRTVPEDGMHRVMPGVLQRFSTAAAVEEPITPSVHVNYTKLLINGNFDDSASGETFPALDPRTGEVIGHVAAVRAQHIIRAESADRRVFDEGALTEVRLPIGTPGVKLGF

SEQ ID NO: 29916 - DNA, 679 bp, Zea mays
  misc_feature: Ceres CLONE 1405220-F
  misc_feature: Encodes the peptide sequence at SEQ ID NO. 29917
  misc_feature (679)..(679): n is a, c, t, g, unknown, or other
aaagctggagctccccgcggtggcggccgctctagaactagtggatcccccgggctgcaggaattcgcacgagaccattacctagaacatcctaatcgaaaaaaatctagcaaacggaaatcccatctcgccgccgccgcgatgtctcgccgctatgacagtcgcacgacgatcttctcgccggaggggcgtctctaccaggtggagtacgcgatggaggcgatcgttaacgccgggtcagccctcgagatcctggcggccgacggcgtagtcctgggcggcgagaagaaggtgacctccaagctcctccagacctcccgctccgccgagaagatgtacaagatcgactcccacctgccgtgcgctgtgtcaaggatcatgtccgacgccaacatcctcatcaaaaccgcccgcctccacgaccagcgctacgcgctctcctaccaggagcccatccccgtcgagcatctcgtccagtccctctgcgacacaaagtagggctacacccagtttggtggcctccgcccctttggggactccttcctattcgccggttgggacaagaaccacggtttccagctctacatgaacgacccatctggcaactacggcgggtaggaagggcgccgtatgttggggccaaaccccaggccgcgcagtccatggctcaagcagaatn

SEQ ID NO: 29917 - protein, 118 aa, Zea mays
  misc_feature: Ceres CLONE 1405220-F
  misc_feature: SWISSPROT Homolog: EC 3.4.25.1 Proteasome endopeptidase complex
MSRRYDSRTTIFSPEGRLYQVEYAMEAIVNAGSALEILAADGVVLGGEKKVTSKLLQTSRSAEKMYKIDSHLPCAVSRIMSDANILIKTARLHDQRYALSYQEPIPVEHLVQSLCDTK

SEQ ID NO: 29918 - DNA, 667 bp, Zea mays
  misc_feature: Ceres CLONE 1405221-F
  misc_feature: Encodes the peptide sequence at SEQ ID NO. 29919
  misc_feature (528)..(528): n is a, c, t, g, unknown, or other
  misc_feature (593)..(593): n is a, c, t, g, unknown, or other
aagctggagctccccgcggtggcggccgctctagaactagtggatcccccgggctgcaggaattcgcacgagaccattacctagaacatcctaatcgaaaagaccctcgcttcacttggcacggactcacggccacaaaccacaaccggctcactcaagaacaaagaagccaacccatggatatctcccaagacgctcctcctggtcgccactctcgctcctgagctgcccgctccagatagccgccaactacgccccaatgaccctgaccgtagggaacaactgcccctacccagagtggacagccatcccgtccaactacctctacatcgacgtgctgtaggatcgcctccttcttcctaccgcagatgtcccaagaactcttcctctgatgccggcgcacccctggaccggacgcatctgggagcctacgggcagctcggacgacggcctacagctcgaatgcgactcgttcgactgctgcatacggaccaaatgtgtgggctcctgggactgggtgcccagacncttgatgacgtgtacctaccacagacaaggatcatgacctcgacaatggtgagcgatctgagcgntatcatgcccgtgccgactaggaatctgatggagttcacaggcttagcaccaccctgagcagatcagaatatgt

SEQ ID NO: 29919 - protein, 57 aa, Zea mays
  misc_feature: Ceres CLONE 1405221-F
  misc_feature (46)..(46): Xaa is any aa, unknown, or other
MPAHPWTGRIWEPTGSSDDGLQLECDSFDCCIRTKCVGSWDWVPRXLMTCTYHRQGS

SEQ ID NO: 29920 - DNA, 752 bp, Zea mays
  misc_feature: Ceres CLONE 1405226-F
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (681)..(681): n is a, c, t, g, unknown, or other
  misc_feature (682)..(682): n is a, c, t, g, unknown, or other
  misc_feature (693)..(693): n is a, c, t, g, unknown, or other
  misc_feature (703)..(703): n is a, c, t, g, unknown, or other
  misc_feature (715)..(715): n is a, c, t, g, unknown, or other
  misc_feature (717)..(717): n is a, c, t, g, unknown, or other
aaagctggagctccccgcggtggcggccgctctagaactagtggatcccccgggctgcaggaattcgcacgagaccattacctagaacatcctaatcgaaaaactgcgatgaggccctctcctcctatcacctgacgtccactcacatgcacagacagacaggcacgcgcaaggaaaaattcatttatatatgcacgctcgttcgttgtctatctccccgcatcactgcacaggacgccgcaacaagagcgagggattggagctcatctagtcggctaatcagctagtacgtacgtgtaactaggttgcgatgaaccagctgccgtgcatgcagcgcatggcgatgtagggctctgagggcttcgtggccaggtcccgccgccccaaccgccgccgtgggcctcctcctggtgggaagacatgcagcacccggttgcctagggggggaggcctccggcccccgcggcgaagggggcccccccgatatcgaagggcccgggagcgaagaatcagcatcaagaaacggtaggccgggccaagacccgttcagacgtattgcccgggatcgcacctcgcctggaggcggtcttacgcacccactcccgggctcaggtaacgaacggaggctcccgcacgccggtaacgcacctcgcggcgtgaggnnnnccggcnnnccccgcnncgagccgaagnccgcaccgancccgcgccggcnanggccgcgagtccaggaaaaacgccgcaagccccgc

SEQ ID NO: 29921 - DNA, 815 bp, Zea mays
  misc_feature: Ceres CLONE 1405227-F
  misc_feature (774)..(774): n is a, c, t, g, unknown, or other
aaagctggagctccccgcggtggcggccgctctagaactagtggatcccccgggctgcaggaattcgcacgagaccattacctagaacatcctaatcgaaaagttcttagacgtttctccagagcctgaagccaaatctagggggcttgcttcatctgctgtccgagcgtggtttggtttctcggggctggcgcggtcaagagctcacctgagttccaccgaaatctgccacggtagttcttgcctaggtgtgtcgttgcgttgtgacccttgcggattttcttgttccttttgagctgcgatctttgcaggatagtctcccccccaatccgtaatcatccggcgtctaggaaaatggcagtcccaatttggttaatttggtacggctacctgccctccccccccatcccgcgtaacaaccgaatatccccctctgcccccgtttacttcctcccctccccctcctccttctctctagcgtcgcattcctcacgatctctctcataccatcttgcccccccctctccccgcctgcctggcgcccttcccacgaccctctgtcccactcctgttccgcccccactctccgctcacctagagtgcaaccctcgcccccccgccccaacgcgaacactctttccctcctgtctccgccccgcggaccccctctcgtcccccgctttggtctgcgcccccatctccatccccgctccgttcatcagcatcctcctatccctactccgctcgacgcccccgcccttactgtctggctcnacatccgccaccccactctgtttctctccctgcatctcccg

SEQ ID NO: 29922 - DNA, 687 bp, Zea mays
  misc_feature: Ceres CLONE 1405230-F
  misc_feature: Encodes the peptide sequence at SEQ ID NO. 29923
  misc_feature (488)..(488): n is a, c, t, g, unknown, or other
  misc_feature (542)..(542): n is a, c, t, g, unknown, or other
  misc_feature (564)..(564): n is a, c, t, g, unknown, or other
  misc_feature (588)..(588): n is a, c, t, g, unknown, or other
  misc_feature (635)..(635): n is a, c, t, g, unknown, or other
  misc_feature (643)..(643): n is a, c, t, g, unknown, or other
  misc_feature (673)..(673): n is a, c, t, g, unknown, or other
aagctggagctccccgcggtggcggccgctctagaactagtggatcccccgggctgcaggaattcgcacgagaccattacctagaacatcctaatcgaaaactcactatatactcactcctgctgttttccgtccatccgcccaccggttcgcagcccgcgcctcaaaaccctagccccgggcggatcgcggggcgcctccgcggtgccagcgacgcggctcgtttgatccgattgttggtcgagccccgccctcgctgccgcgcttcgctccggctgtgcagcggcgtgagcaccgagcacactcgcgaatggggaactgctggggtgcgcggatcaaggatgggagccctcaccctggcgcctcaggaatgttctcaaagagtagtggcaaggatgggagtaggcttagcggctgtagtagtcgagcctcttcagcttctatgccaccaagtgcgaagactgaatgtgaaatcctgcaatccgccnatgttaagatcttcaccttcaataatctcaaggcagccacaaggaatttccgtncctgatagtgtttaggtgaaangaaggggttttggatctgtctatnaagggatggatagatgagaacacattatcaccttgcagacctggacntggaatcngctgttgctgtgaaagactccacccatganggtttgcaaggcac

SEQ ID NO: 29923 - protein, 77 aa, Zea mays
  misc_feature: Ceres CLONE 1405230-F
  misc_feature: SWISSPROT Homolog: EC 2.7.11.1 Non-specific serine/threonine protein kinase
  misc_feature (60)..(60): Xaa is any aa, unknown, or other
MGNCWGARIKDGSPHPGASGMFSKSSGKDGSRLSGCSSRASSASMPPSAKTECEILQSAXVKIFTFNNLKAATRNFR

SEQ ID NO: 29924 - DNA, 637 bp, Zea mays
  misc_feature: Ceres CLONE 1405231-F
  misc_feature: Encodes the peptide sequence at SEQ ID NO. 29925
cgctcagaactagtggatcccccgggctgcaggaattcgcacgagaccattacctaaacatcctaatcgaaaaaccaacccttgtagtctcagtcaatctgtagattgagactacgatgagcctgtcaccgctcgactcctcctccccgccggccgcggctgcggctgctgctacggaggagcccctcgccccgggcttccgcttccaccccaccgacgaggagctcgtctcctactacctccgccgccgcgtcctcggccgccgcctccgcgtcgacgccatcggcgagatcgacctctaccgcctcgagccctgggacctcccctccctctcccgcatccgcagccgcgacggccagtggtacttcttcgcccgtctcgaccgcaaggtcgccggcgctggcgccgggggccggggcggccccggcaacaggaccaagcgagctacgccgaggcggcactggaagaccacgggcaatgaccgtgaggtggaccaccgcgggaagcccgtccggatgaagaagacgctcgacttccacgccgggagggcgcctaagggcgagaggaccaactgagtcatgcacgagtaccgactcctcgatgcagatggacctcaggatgtgcatgcggatggtag

SEQ ID NO: 29925 - protein, 152 aa, Zea mays
  misc_feature: Ceres CLONE 1405231-F
  misc_feature (24)..(153): Pfam Name: NAM Pfam Description: No apical meristem (NAM) protein
MSLSPLDSSSPPAAAAAAATEEPLAPGFRFHPTDEELVSYYLRRRVLGRRLRVDAIGEIDLYRLEPWDLPSLSRIRSRDGQWYFFARLDRKVAGAGAGGRGGPGNRTKRATPRRHWKTTGNDREVDHRGKPVRMKKTLDFHAGRAPKGERTN

SEQ ID NO: 29926 - DNA, 699 bp, Zea mays
  misc_feature: Ceres CLONE 1405232-F
  misc_feature: Encodes the peptide sequence at SEQ ID NO. 29927
aaagctggagctccccgcggtggcggccgctctagaactagtggatcccccgggctgcaggaattcgcacgagaccattacctaaaacatcctaatcgaaaaacttctccattccattgcggttctgcgagcccctacctccctgtggtgcttggccatggcggactaccacttcgtgtataaggacgtggagggggcgagcacagagtgggacgacatccagcgccgcctcgggaacttgcccccgaagccggagcccttcaagccgccgcccttcgccccgaaggttgacgccgacgagcagcccaagtccaaggaatggcttgacgtgcgcgagcccgaagagctcgaggaactagaggacgatctggatgacgaccggttcctcgaggagtacaggaaaattgaggttcgcaaagctgaggggaagccgcaaaaggccgcgcgatttggaattatacttccccatcactggggttccgaatttcgggggggaaggattcacaggacacaatcaaaggttttgggttgggggccttcccctaaaaaggatgggaaaacctgaaaggggggattggcttccaaaattgtttgtggaaaaaatttggctaactagggtatccccgcggaccaaaattttgtgtgaaaatttatatttcccaaaaaaagggggttcccccccaacatccccccaatgtg

SEQ ID NO: 29927 - protein, 135 aa, Zea mays
  misc_feature: Ceres CLONE 1405232-F
MADYHFVYKDVEGASTEWDDIQRRLGNLPPKPEPFKPPPFAPKVDADEQPKSKEWLDVREPEELEELEDDLDDDRFLEEYRKIEVRKAEGKPQKAARFGIILPHHWGSEFRGGRIHRTQSKVLGWGPSPKKDGKT

SEQ ID NO: 29928 - DNA, 743 bp, Zea mays
  misc_feature: Ceres CLONE 1405234-F
  misc_feature: Encodes the peptide sequence at SEQ ID NO. 29929
  misc_feature (561)..(561): n is a, c, t, g, unknown, or other
  misc_feature (570)..(570): n is a, c, t, g, unknown, or other
  misc_feature (586)..(586): n is a, c, t, g, unknown, or other
  misc_feature (701)..(701): n is a, c, t, g, unknown, or other
ggagctccccgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggacgaaggagttcatggaagcccttgctgccggcgctgatgtgtccatgattgggcagttcggcgtcggtttctactctggctacctcgtcngcgatagangtgtcgtgaccaccangcacacgatgacgagcagtacgtgtgggagtccccaagcggcgggtcgttcactggtactcgtgacacgtcaggggagcagcttggcaggggcactaagatcacactggtccttnaggacgatcagctggagtactttgaggagcgtcgcctcaggg

SEQ ID NO: 29929 - protein, 193 aa, Zea mays
  misc_feature: Ceres CLONE 1405234-F
  misc_feature (133)..(133): Xaa is any aa, unknown, or other
  misc_feature (136)..(136): Xaa is any aa, unknown, or other
  misc_feature (141)..(141): Xaa is any aa, unknown, or other
  misc_feature (179)..(179): Xaa is any aa, unknown, or other
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGTKEFMEALAAGADVSMIGQFGVGFYSGYLVXDRXVVTTXHTMTSSTCGSPQAAGRSLVLVTRQGSSLAGALRSHWSXRTISWSTLRSVASG

SEQ ID NO: 29930 - DNA, 701 bp, Zea mays
  misc_feature: Ceres CLONE 1405236-F
  misc_feature: Encodes the peptide sequence at SEQ ID NO. 29931
agagctggagctccccgcggtggcggccgctctagaactagtggatcccccgggctgcaggaattcgcacgagaccattacctagaacatcctaatcgaaaaacccctgttcctctgcgatttgggctcgtcctgtgtccttcctgttgctcaaaagctcgctcattcgatgtccctgtctgaaaggcgacaaatcccactggaattcggagcacagagctttgaatccaggggccaaaactttttgctcatctcccttgcggaaaagcgcctcctctgcgtctgaaagtcggatcttttttcacagattcgatttgaagttcccgagcagctcgaggaccgcggtgtcggtaagacttgctttgaagatcttgatcaccacaagagatttgctgaatttccggtcactgtactttttccactggacatgtcctttcgcagcatagtccgtgatgttagggaaagctttggtagcttatcaagacggagccttgaggtcaggatttctggtttgcctggtctgtctaaatctgttggatctgtgagtgacctgcgcgacagacctgtagtagttgatcaaagcagggggggttggctttcctcctgaattgcttccaaacgcaatgaacaagctcgaggaatgtgaaacatattgccctcccggacaaccgtgtttgctcgagcacccccctctcaaacct

SEQ ID NO: 29931 - protein, 59 aa, Zea mays
  misc_feature: Ceres CLONE 1405236-F
MSFRSIVRDVRESFGSLSRRSLEVRISGLPGLSKSVGSVSDLRDRPVVVDQSRGGWLSS

SEQ ID NO: 29932 - DNA, 723 bp, Zea mays
  misc_feature: Ceres CLONE 1405237-F
  misc_feature: Encodes the peptide sequence at SEQ ID NO. 29933
  misc_feature (573)..(573): n is a, c, t, g, unknown, or other
  misc_feature (594)..(594): n is a, c, t, g, unknown, or other
  misc_feature (722)..(722): n is a, c, t, g, unknown, or other
  misc_feature (723)..(723): n is a, c, t, g, unknown, or other
aaagctggagctccccgcggtggcggccgctctagaactagtggatcccccgggctgcaggaattcgcacgagaccattacctagaacatcctaatcaaaaaattgattggttgcttggttgcttgcttcgtttcacgctttccccttcctttgctgagatccaaaagctgagactcagcttgtcgatccatctgttctgtgcgcctactcgtatcttaggatccatctgtatgttgtttacttgttttcctgattgaatcgcgcattggatgcctggtggttggccttgctcctagtcttttcatttacacgagctttcgacgaagccgcgtctggtctgtctgctccatcacaagagcacgcaaatggttcgatctgccgtgccagatgattgctgcattcagtgggacgtcatgcacatccacgatggattgtagcgtcagcactctgatctttccttgtcgatttgtttgtcgcagctgagttcccccaccccccaacaaacaattactagagtagctgcattgggcgggaaataaagcgctagaagctcagcagcaatggcggagcangcgggcgcccggaagtactgntgccacatgtgcgcccgcggcgttagccccgcggagggcgaggtggagatgaaatgcccgttctgccacagcggcttccctcgagagatggagacccgcccgcgggccgcgaccgacgaacgtgacgnn

SEQ ID NO: 29933 - protein, 53 aa, Zea mays
  misc_feature: Ceres CLONE 1405237-F
  misc_feature: The sequence is a functional homolog of SEQ ID NO 1722 in the 11/479,226 US patent application
  misc_feature (4)..(4): Xaa is any aa, unknown, or other
  misc_feature (11)..(11): Xaa is any aa, unknown, or other
MAEXAGARKYXCHMCARGVSPAEGEVEMKCPFCHSGFPREMETRPRAATDERD

SEQ ID NO: 29934 - DNA, 722 bp, Zea mays
  misc_feature: Ceres CLONE 1405239-F
  misc_feature: Encodes the peptide sequence at SEQ ID NO. 29935
aaagctggagctccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaatcaatttcttcgtccgccttcgcccctgcttacgtccccgctactaaccctaggatcattctgtcttttctcgtttcttatccgactcttcttcgttttatgcctatcagttatgaggttgaacgccttcagaagcttctctactagattagtgtaaatagtagacttgttcgagtttagcttggctggaagaattagtctctggtcccgtgttatatctgctagcaataatggctgcgatgaacggagaggtattgggtgaatgtggcaagaacataaatagtctcaagagaaaagcggagagccccgctgcatatgctgctggcgtattctgcaccctctgaatgcatcagcatactggcaatggatctgctgttaggtttcatcctggaaaggaccgtagg

SEQ ID NO: 29935 - protein, 37 aa, Zea mays
  misc_feature: Ceres CLONE 1405239-F
MAAMNGEVLGECGKNINSLKRKAESPAAYAAGVFCTL

SEQ ID NO: 29936 - DNA, 824 bp, Zea mays
  misc_feature: Ceres CLONE 1405240-F
  misc_feature (15)..(15): n is a, c, t, g, unknown, or other
  misc_feature (16)..(16): n is a, c, t, g, unknown, or other
  misc_feature (40)..(40): n is a, c, t, g, unknown, or other
  misc_feature (41)..(41): n is a, c, t, g, unknown, or other
  misc_feature (43)..(43): n is a, c, t, g, unknown, or other
gggggggggggaganngggggggaaaaaaaaaaaaaaaannantggaaaaaagaacaaaactggagctccaccgcggtggcggccgctctagaactagtggatcccccgggctgcaggaattcgcacgagaccattacctaaacatcctaatcgaaaaaccaacccttgtagtctcagtcaatctgtagattgagactaccatgagcctgtcaccgatcgactcctcctccccgccggtcgcggctgcggctgctgctacggaggcgcccctcgccccggggttccgcttccagcccacagacgaggagatcgtctactactacctccgccgtcgcgttcctctcccgtcgcctccgagtctacgccatcccacgagattgacctctaccgacctcgagccctggtacctcccctcccctctcccgcatccgcaggccgcggacaaaccacagggcaatttcttgggcccgtcctcgacccgcacagggtcgcccgacacactgggtcgacaaaaaaccaggacgcggggcgccacaaaaaacacaaggggccgggaacaccacaacaaaaccccacaactttataactggggatacacccaccctcggtcacgaaccaaacaagggggtcacccaccctcggacggagccccacaaccgagggggcgggcacaaaaaaactctgtcttatcccacgaaggacaaaggctgtgtcaaaaaaaacaggacataaaacaaaagggcggcccaacgccccgcggggcccgccctcacttgcctgagataaacccgaactgactagaaacatcaacgcctactccctc

SEQ ID NO: 29937 - DNA, 660 bp, Zea mays
  misc_feature: Ceres CLONE 1405241-F
  misc_feature (484)..(484): n is a, c, t, g, unknown, or other
  misc_feature (497)..(497): n is a, c, t, g, unknown, or other
  misc_feature (576)..(576): n is a, c, t, g, unknown, or other
  misc_feature (607)..(607): n is a, c, t, g, unknown, or other
aagctggagctccccgcggtggcggccgctctagaactagtggatcccccgggctgcaggaattcgcacgagaccattacctagaacatcctaatcgaaaactttttgctcggctgacaccaggtagccgcccctcctctatccaccccttcacttgcttggtcttccactcacccctctctcgttattcacccggtctcctctcctgcaaagaggtacgtaactgcactttcctgctcagtcttttgatcggtttcagtgatgcactgatgctgtagagtttcgtttctgttagtactctaatcaacggacaacggtttctgttagtattcttgggttcatggctgtctgcagattgtcgcccttgctctgcctgctctattcggcctcagttcattctgtcgtaaacctcacctcgtaactgaaataagccatatgcgccgcgcgtcgaagcttagtgtctgatcgatacgctatccctacnattttctgagctngtgaactcctgcgcccgtctcctcgtcgaggacaggaagatgagctcgctacacgcacacgagcggagcttggcctggntgtcctgtacctgaacaaagcgaggccgggnacaaatctgcagggcgatccatacgcttccaggtcgtaagcaagggcaggctg

SEQ ID NO: 29938 - DNA, 673 bp, Zea mays
  misc_feature: Ceres CLONE 1405242-F
  misc_feature: Encodes the peptide sequence at SEQ ID NO. 29939
aaagctggagctccccgcggtggcggccgctctagaactagtggatcccccgggctgcaggaattcgcacgagaccattacctagaacatcctaatcgaaaaactactagggatcagaccagtgatctagctactggaccatgcatttgctgtatgacaccctgcggcaaggaataatgggagtagcgtctgcctccaatcgcgcgtcggccctcgtctactgctactactatgtagaagccgtgccgccagggtcccggaatgcccgctcctcggccctcgccggtgatgtgcatcgagtgggcgctcagaccccctccctcttcactgttactgtggagggatccgtgcatgccaacgcggggcgcgtgacccataaaggtaaacgcgcctccttttttctcttctggcgccccgcttttccaatccctcctcaacctcatccgccccgcccgcaccatcaccaaaaaggtccccgccttcttcttcctcttctcctctgcccctgcttgtcgtttgctcgtgctcccccaccccctttctgattcagccagggttccttccgcggcgcggcgcgtcgccatgggcaactgctggggcgccaagatcagatccgacagcccctcccgcggcgcctcctccccgtcaggtacggcgtccaagttggcgagca

SEQ ID NO: 29939 - protein, 30 aa, Zea mays
  misc_feature: Ceres CLONE 1405242-F
MGNCWGAKIRSDSPSRGASSPSGTASKLAS

SEQ ID NO: 29940 - DNA, 665 bp, Zea mays
  misc_feature: Ceres CLONE 1405242-R
  misc_feature: SWISSPROT Homolog: EC 2.7.11.1 Non-specific serine/threonine protein kinase
cgattgggtaccgggccccccctcgaggtcgacggtatcgataagctttttcttttttttttttgtaaaaaaaactacttaatatacagaaaacatccagaactctgcctgcctctttacaaatccctctaagaaacctactatattacctacacctacaaatggatgggaaaaaaaaaagagagatactctggcatataaaatccaatcactcaaactggttttacatgaggagcaggcttccccttccctgccgctttgccgccattgttatccaagctccggctgcctgggctcttctgtaagtgatggttacctccttctttggtgtcctggagctgctctaacgcgtgtgaccacctcatccatgctgggcctgtgcctggactccaccgagaggcattgcagggtgagctgccgcagccttctgcaccctggcaagggagtactgcccgcccagccgtgggtccaggatgcgaaatatgcgccgcttgcttctcaggtatggcctagaccactccaacaagttgtgctccccggtcgggcggttcttgtccagcgtccgccgccctgacagcatctctaggagcaccaccccaaagctgtacacgatcgctcttggtggtcagatgacctgtcgcaaggtattctggagctgcataccc

SEQ ID NO: 29941 - DNA, 745 bp, Zea mays
  misc_feature: Ceres CLONE 1405251-F
  misc_feature: Translation starting site: 170
  misc_feature (391)..(391): n is a, c, t, g, unknown, or other
  misc_feature (470)..(470): n is a, c, t, g, unknown, or other
  misc_feature (482)..(482): n is a, c, t, g, unknown, or other
  misc_feature (520)..(520): n is a, c, t, g, unknown, or other
  misc_feature (521)..(521): n is a, c, t, g, unknown, or other
  misc_feature (563)..(563): n is a, c, t, g, unknown, or other
  misc_feature (657)..(657): n is a, c, t, g, unknown, or other
  misc_feature (697)..(697): n is a, c, t, g, unknown, or other
  misc_feature (710)..(710): n is a, c, t, g, unknown, or other
aaagctggagctccccgcggtggcggccgctctagaactagtggatcccccgggctgcaggaattcgcacgagaccattacctaaaacatcctaatcaaaaagcgccgcctggatcgagcagccgagcgactaagcgaagactcccttttccccgagcacaagagaaccatggcggcggcggcagtttacggcggcttcaaagggaagcttggcgtcgaggatgcccccgagctgcagctcaaccgcatccgcatcacactctcatccaagaacgtcaagaacttggagaaagtttgtgcggatttggtaaagggagccaaggacaagcatttgagggttaagggacctgtccggatccctactaaggttctccacatcaccactcgcaangtccccttgcggtgaaggaacaaacacatgggatcggtttgagttccgcattcacaagaagggtgattgacctaatcangctcccctgatngtggtgaagcagatcacctccatcacattgagcccggnngttaaaagagttgaggtgaccatttgccgagctggaaagggnacgtgaagtttcagcaatgtcatcgacaatctttttttctttgtggctcccctgtgtgctcgccaaagaaaagaattttggatttattatttgnagcatacaagacttctttccccccctataatcttatggcntagctgggttggnctgaaactattgggcctggtcaactttgagatttt

SEQ ID NO: 29942 - DNA, 744 bp, Zea mays
  misc_feature: Ceres CLONE 1405252-F
  misc_feature: Encodes the peptide sequence at SEQ ID NO. 29943
  misc_feature (521)..(521): n is a, c, t, g, unknown, or other
  misc_feature (669)..(669): n is a, c, t, g, unknown, or other
  misc_feature (719)..(719): n is a, c, t, g, unknown, or other
tggagctccccgcggtggcggccgctctagaactagtggatcccccgggctgcaggaattcgcacgagaccattacctagaacatcctaatcgaaaagcactcgcagttggcgcgcgctcccgtcctaaccaagcaaaacccacaaccctagcctccgccggcgccgccatctgccgggcctccctccggtcccggccgaccgtagcctcgcagcaccctaaccctatccctcccccgctgccgcgggagcagggtaaaaaaatgccgcgtgagatcatcacgatccaggtggggcaatgtggaaaccagatcgggatggagttctggaagcagctctgtctcgagcacggtatcggcaaggacggcctgctcgaggacttcgccactcaggggggcgacaggaaggacgtcttcttttaccaggctgatgatcagcacttcatacccaggtctctgcttattgacctggagccgagagtgatcaatggaatccagaacagtgagtacaggaacctgtacnaccacgagaacatatttgtcgctgagcatggtgggtggtgccggaaacactgggccagtgggtatcatcagggtgaaaacaagtgtgatgatatcatggacatggttgacagagaagcagatggaagtgatagccttgagggttttgnccttttgcattctatgctggggaactggttcaagtatgggttcttatctngtgaagaccctgaatgatcatacag

SEQ ID NO: 29943 - protein, 157 aa, Zea mays
  misc_feature: Ceres CLONE 1405252-F
  misc_feature (46)..(158): Pfam Name: Tubulin Pfam Description: Tubulin/FtsZ family, GTPase domain
  misc_feature (87)..(87): Xaa is any aa, unknown, or other
  misc_feature (136)..(136): Xaa is any aa, unknown, or other
  misc_feature (153)..(153): Xaa is any aa, unknown, or other
MPREIITIQVGQCGNQIGMEFWKQLCLEHGIGKDGLLEDFATQGGDRKDVFFYQADDQHFIPRSLLIDLEPRVINGIQNSEYRNLYXHENIFVAEHGGWCRKHWASGYHQGENKCDDIMDMVDREADGSDSLEGFXLLHSMLGNWFKYGFLSXEDPE

SEQ ID NO: 29944 - DNA, 744 bp, Zea mays
  misc_feature: Ceres CLONE 1405253-F
  misc_feature: Encodes the peptide sequence at SEQ ID NO. 29945
  misc_feature (1)..(1): n is a, c, t, g, unknown, or other
  misc_feature (2)..(2): n is a, c, t, g, unknown, or other
  misc_feature (18)..(18): n is a, c, t, g, unknown, or other
  misc_feature (19)..(19): n is a, c, t, g, unknown, or other
  misc_feature (21)..(21): n is a, c, t, g, unknown, or other
  misc_feature (22)..(22): n is a, c, t, g, unknown, or other
  misc_feature (47)..(47): n is a, c, t, g, unknown, or other
nncccccccccccccctnntnncccctccctctcatttttttctccngcccaaagctggagctccaccgcggtggcggccgctctagaactagtggatcccccgggctgcaggaattcgcacgagaccattacctagaacatcctaatcgaaaatcacctataatattttgagcattcagaaacacacctagggaagcgcactagcaacgacctaacaacaatggctaccaagatattatccctccttgcgcttcttgccctttttgtgagcgcaacaaatgtgttcattattccacaatgctcacttgctcctagtgccattattccaaagttcctcccaccagttacttcaatgggcttcgaacacccagctgtgcaagcctacaggctacaacaagcgcttgcggcgagcgtcttacaacaaccaattgcccaattacaacaacaatccttggcacatctaacaatacaaaccatcgcaacgcaacagcaacaaacagttcctaccagcactgagccacctagccatggtgaaccctgccgccctacttgcaacaacaactgcttgcatccaacgcacttgctctggaaaacgtagttgcaaaccagcaacaacaatagttggcaacgtttctgccagcgcttcagcaactacccatggtggaacccggccggcctacctacgacaggaaacatcttgctttcatcctaggcccgttggcttgtggccaatggcaccctac

SEQ ID NO: 29945 - protein, 125 aa, Zea mays
  misc_feature: Ceres CLONE 1405253-F
  misc_feature (1)..(126): Pfam Name: Zein Pfam Description: Zein seed storage protein
MATKILSLLALLALFVSATNVFIIPQCSLAPSAIIPKFLPPVTSMGFEHPAVQAYRLQQALAASVLQQPIAQLQQQSLAHLTIQTIATQQQQTVPTSTEPPSHGEPCRPTCNNNCLHPTHLLWKT

SEQ ID NO: 29946 - DNA, 705 bp, Zea mays
  misc_feature: Ceres CLONE 1405261-F
  misc_feature: Encodes the peptide sequence at SEQ ID NO. 29947
  misc_feature (545)..(545): n is a, c, t, g, unknown, or other
  misc_feature (590)..(590): n is a, c, t, g, unknown, or other
  misc_feature (610)..(610): n is a, c, t, g, unknown, or other
  misc_feature (665)..(665): n is a, c, t, g, unknown, or other
aagagctggagctccccgcggtggcggccgctctagaactagtggatcccccgggctgcaggaattcgcacgagaccattacctgaacatcctaatcgaaaaacactacatcccacctacctcctcgcatcaggcaggcgggcctcgcgtttataagccacccttcctctcctccacggccctcgccctgcaaagcacagacacaaaccacgagcgcgaggcacgacctacatcgaatcggccacgaaccaccatggcggcctcacgcgcgctcctccccagcccgcaggtgagccctgcgagcgcgcgggtccgcctggccgcggccgtgccgtcgtcgctcacgctcgcggcgcgcggcggggccggggccggcgcgcgtctccgcgtgcggtgcgcgatcttgtcgtcgcccgcgcccgtggcgcccaccgagtcgaggccggcgcgccggatctcgccgtccgcgccggacggcgcgctgcggcccaagccggcggtgctggtcgccgagaagctgagcgaggccgggctggccgtgctgncgcagttcgcggacgtggagtgcgcctacggcatgtcccccgcgnagctcctcgccaagggcgcngcagtcgacgcgctcatcgtgcgcagcggcacaaggttgacgcggaagtgctggnagccgggcagggcccgcttgcggtggtgggcccgcgcggt

SEQ ID NO: 29947 - protein, 150 aa, Zea mays
  misc_feature: Ceres CLONE 1405261-F
  misc_feature: SWISSPROT Homolog: EC 1.1.1.95 Phosphoglycerate dehydrogenase
  misc_feature (98)..(98): Xaa is any aa, unknown, or other
  misc_feature (113)..(113): Xaa is any aa, unknown, or other
  misc_feature (138)..(138): Xaa is any aa, unknown, or other
MAASRALLPSPQVSPASARVRLAAAVPSSLTLAARGGAGAGARLRVRCAILSSPAPVAPTESRPARRISPSAPDGALRPKPAVLVAEKLSEAGLAVLXQFADVECAYGMSPAXLLAKGAAVDALIVRSGTRLTRKCWXPGRARLRWWARA

SEQ ID NO: 29948 - DNA, 711 bp, Zea mays
  misc_feature: Ceres CLONE 1405264-F
  misc_feature: Translation starting site: 388
  misc_feature (649)..(649): n is a, c, t, g, unknown, or other
tggagctccccgcggtggcggccgctctagaactagtggatcccccgggctgcaggaattcgcacgagaccattacctagaacatcctaatcgaaaaaatgaccattgcgtgatagatcgcaccggtctcggtctccgtgtctcactctcaagttgcagcagccagtcatttcgttggcaaccagggcagaaataaatatccgtggataagagctgcgctgtgtgctgctgagatatcaagaacggtagggtggaagacaaggccccgttctcgattaacccaagccaaagagtcagagggagagagagagagagagtcgtattggtcgtcacctgtcgaaggttttcggtgtctcctgagccacagctgctgctgctgctggaaccatggagatggaggccgtggagtcgcacggcggcgccggtcgccggacgcccaagagggatcgcggcatctcctgggcctgcgtcttcatcctggcgagtaactgcttccagttcatcgcctacttcgccgtgtcgacgaacctggtgaactacctcaaggaccgcctgcaccagggcagcaaagccgccgcgaacggcgcccccaaactggatgggcacgagcgccatcacgccgctcgtcgccgccttcctcgccgacgcnttcctcggcagatactggaccatcgcgctcttcctggtcatcccgtcctgggcctacgtgtt

SEQ ID NO: 29949 - DNA, 676 bp, Zea mays
  misc_feature: Ceres CLONE 1405268-F
  misc_feature: Translation starting site: 118
  misc_feature (671)..(671): n is a, c, t, g, unknown, or other
tggagctccccgcggtggcggccgctctagaactagtggatcccccgggctgcaggaattcgcacgagaccattacctagaacatcctaatcgaaaaattcgtccatcccacctaccatgggcaccgcctccggcactgacgccggtgcccagccgcgcgacgaccccagcctcctccccttcgcgtccttctcgctcggcctctccatccgcgcgccggccacccccagactcgcctccgtcccctccaccctccacctccccactcaaatctctacactcgccgtctgcctccacccctccgccgcgcagccctcctcccgccgcaccacccgcctcaattccgccacctcctccgtcatcgccccgctgccctcctcaacgcccggtctctcccgctccttcccttcgggcgcgcccgccgcagcagggcgccgccgcacgctcgtctggttccgcgccgacctccgactccacgagcatgagccgtgtcacgcgcgcagcgggggcgtcgtcctccctcctccccgatttcgtcttcgatccgcgggacttcggcaagcccccctcggggttcgaccggacgggcccgtaccgcgccaacttcctggctcgattcgagcgcgaccttgcgccggagctccccggggcccggcgctgaagaaccaggntggtg

SEQ ID NO: 29950 - DNA, 729 bp, Zea mays
  misc_feature: Ceres CLONE 1405269-R3
tttttaccgattgggtaccgggccccccctcgaggtcgacggtatcgatattttttttttttttttttaatgcaacagccaacagatacaggcagtgcaagacatatcgtactaaatttcaaaaacatcttctcatctctttcccttctatcttaatacatgctagtagtcaacttcctcgcaaatgatcacctcaccaaaaaatgggatctacacatctatagcagtatagaacaacatcaagacatacatacacctctgctcaaatacaggtatctttgtgccgaaccccactgattacaacgcaaagtttggagcccccccatcagacttcacttctggatggccaattgccagccaacaactcatccatccatacgatgcatgccacgatttccacgatagcggctacgctcgaggtctcctctattctcatcgcacaagcacatcttgtgactgttgcttccatacatcacaaggctccacctcaaccttgaacggtttatcgatccactggaaaacacagccacgtgcctcaacatttttttatcggttgaggaagccatccatgggaatttgaaaatggcttccatggaaaacttttccacttttccggtcaaaaacccccccggcgaaaacccccttaagaagaagtttgggcgtttttaaaaaaaacccccttttgggggggggggtttttttttaaccccccccctccaaaaaaaaagg

SEQ ID NO: 29951 - DNA, 667 bp, Zea mays
  misc_feature: Ceres CLONE 1405269-R2
ccaattgggtaccgggccccccctcgaggtcgacggtatcgatattttttttttttttttttaatgcaacagccaacagatacaggcagtgcaagacatatcgtactaaatttcaaaaacatcttctcatctctttcccttctatcttaatacatgctagtagtcaacttcctcgcaaatgatcacctcaccaaaaaatgggatctacacatctatagcagtatagaacaacatcaagacatacatacacctctgctcaaatacaggtatctttgtgccgaaccccactgattacaacgcaaagtttggagcccccccatcagacttcacttctggatggccaattgccagccaacaactcatccatccatacgatgcatgccacgatttccacgatagcggctacgctcgaggtctcctctattctcatcgcacaagcacatcttgtgactgttgcttccatacatcacaaggctccacctcaaccttgaacggtttatcgatccactggaaaacacagccacgtgcctcaacattttttatcgtatgaggaggcatcatggatttgaatgcttcatgaagcttcactttcgtcaaaccaccgcaaaccataagagttgctgtcaagccattgggcgttatacccgctaaatggacgatggtcatg

SEQ ID NO: 29952 - DNA, 908 bp, Zea mays
  misc_feature: Ceres CLONE 1405269-R
  misc_feature: Encodes the peptide sequence at SEQ ID NO. 29953
ttgggaccgggcccccccccgaggtcgacagtatcgatatagcattcttgttttttgtaatgcaccagccaacatatacacgctgtgcaagacactatgcgtactaaatttcaaaaacaatcttctcatctgtttcccttctatcctaagacatgcgagtagtcaactgtcctcacaaatgatcacctcaccataaaatgggatctacacatctatagcactatataacaccatcaagacatacatacacctctgctctaatacaggtatctttgtgacgaaccccactgattacaacgcaaagcttggagcccccccaccagacttcacttctggatggccaattgccagccaacaaactcagtccatccatactatgcatgccacgatttccaccatagcgggctaccctccaagtctcctctattctcatcgcacaaagcacatcttgtgactgttgctttccatagcatcacaaggctccacctcaaccttgaaaagtttatcaatccactggaaaacacagctccgggccctcaaacattttttatcgggatggaggaaggcatcttggattttggaatgcggcatgaagcttcacttttcgtcaaaaaccacccgcaaaaccctgaaggagttgctgaaaaggccattggggcggtttaaacccgcctaaatgggaaccaaaggtcttgtttctacaggcccaaaaattgtggtgaaaagggaaaagggaccccaactcccgtggaaagtaacaattttgaccaggtgttttcccgaccgagggcctataaaccgaaaccggggaaaagggaaaatcattctcaaaccctatttgtattcccggaagaaattggtgtttaagtcaaagccttggaaataaatcaccggtacccccctacccg

SEQ ID NO: 29953 - protein, 109 aa, Zea mays
  misc_feature: Ceres CLONE 1405269-R
MANCQPTNSVHPYYACHDFHHSGLPSKSPLFSSHKAHLVTVAFHSITRLHLNLEKFINPLENTAPGPQTFFIGMEEGILDFGMRHEASLFVKNHPQNPEGVAEKAIGAV

SEQ ID NO: 29954 - DNA, 696 bp, Zea mays
  misc_feature: Ceres CLONE 1405269-F
  misc_feature: Encodes the peptide sequence at SEQ ID NO. 29955
  misc_feature (552)..(552): n is a, c, t, g, unknown, or other
  misc_feature (557)..(557): n is a, c, t, g, unknown, or other
  misc_feature (558)..(558): n is a, c, t, g, unknown, or other
  misc_feature (595)..(595): n is a, c, t, g, unknown, or other
  misc_feature (596)..(596): n is a, c, t, g, unknown, or other
  misc_feature (601)..(601): n is a, c, t, g, unknown, or other
  misc_feature (602)..(602): n is a, c, t, g, unknown, or other
  misc_feature (619)..(619): n is a, c, t, g, unknown, or other
ggagctccccgcggtggcggccgctctagaactagtggatcccccgggctgcaggaattcgcacgagaccattacctagaacatcctaatcgaaaaaccttctccatctccatcgccggcctccatttcttgcctatcccgtgccagccagtcactctcgtccgccacagatcgagaagccaccaccaccgccaccgcatggccatggcagcccagcagcaccggcaccacaagcgccgccgcatcgccctctccccctccccgtccccgtccctcgcgcccatccccggcgcccccacgccgccgctcgactcgctggccgacgagctcctcttcctggtcctggaccgcgtggcccaggccgacccgcgggcgctcaagtccttcgcgctggcctcccgcgcctgccacgccgcggagtcccggcaccgccggacgctccgcccgctccgcgcggacctcctgtccgccgcgctggcgcggtacccgtccgcgacccgcccacctcaccctctgcgcgcgcgtccccgacgccgcccatcgctcccgcgntgtcnntcggtcctccgccctccgcgccgtcgacctctcccgnntccgnnggttcggcgccgccggngtcgccgcgctcgccgccgcgtgccgggacctttgcgacctcgaactctccatggggtccacctcggggacgccggg

SEQ ID NO: 29955 - protein, 164 aa, Zea mays
  misc_feature: Ceres CLONE 1405269-F
  misc_feature (118)..(118): Xaa is any aa, unknown, or other
  misc_feature (131)..(131): Xaa is any aa, unknown, or other
  misc_feature (133)..(133): Xaa is any aa, unknown, or other
  misc_feature (139)..(139): Xaa is any aa, unknown, or other
MAAQQHRHHKRRRIALSPSPSPSLAPIPGAPTPPLDSLADELLFLVLDRVAQADPRALKSFALASRACHAAESRHRRTLRPLRADLLSAALARYPSATRPPHPLRARPRRRPSLPRCXSVLRPPRRRPLPXPXVRRRRXRRARRRVPGPLRPRTLHGVHLGDAG

SEQ ID NO: 29956 - DNA, 826 bp, Zea mays
  misc_feature: Ceres CLONE 1405272-R
  misc_feature: Pfam Name: Mpp10 Pfam Description: Mpp10 protein
ttggacttcagcaataaaactctcgaacttgtgtgcttcggtagaaatataaatggtcactttttactgttcatgtaaaagctactagcagagggtacaatacaaaatttggaaaatatgtatggccagtttatcgctcttgtaccatttagaacctagtgagaaaaaaacattgagtttaatctttctgcaacttggctggcgctgtcctctccttatgggatgctgcatacctccttttctggttagctcttcttcccttgcgctcaacctgtgtaagttccccctcttccttaacatcaccttttccttcaaatatctcttcgggggcaagcattgcaccatcggaaacagctacaggtgcaatctcttccatggctaaagcaggcacatttgcttgcacagacatatcctcaatgactggctttggaccaaagtggaaatgcaatagcccatccaattgcaaacatatcctcttaaataaagtatttgcctcttcctttagttcatctgaaataaaaagtggggcaggtgcaaggcctgctttttgtgcatagtcatcctcatacagttcagcaagacccttcttgctcttagtttcatccagtccctagtgctcctttggagctttggacggcaaaaaagacggcttctcaacatcatcaaaatgactctctgcaacacttttctttatcactgcgtcaagggaagctgtcacttcctcggttattacaggcgcaggtctcacattgtgctcaaaatcaatgtcccctcctaggggcactgttactgcgctcctgaaaagcagtaacttccccctgaatgc

SEQ ID NO: 29957 - DNA, 657 bp, Zea mays
  misc_feature: Ceres CLONE 1405276-F
  misc_feature: Encodes the peptide sequence at SEQ ID NO. 29958
  misc_feature (357)..(357): n is a, c, t, g, unknown, or other
  misc_feature (380)..(380): n is a, c, t, g, unknown, or other
  misc_feature (401)..(401): n is a, c, t, g, unknown, or other
  misc_feature (442)..(442): n is a, c, t, g, unknown, or other
  misc_feature (510)..(510): n is a, c, t, g, unknown, or other
  misc_feature (642)..(642): n is a, c, t, g, unknown, or other
ggagctccccgcggtggcggccgctctagaactagtggatcccccgggctgcaggaattcgcacgagaccattacctagaacatcctaatcaaaacatccagagagagacacggaggacctgggtttggttgcgctgcttgactcgctccgtgttccaagcgccttttgagcattcaggcagatataaaattcctctttttacactacaatccccgctgaatcagcagcagcaactctctccctctccgttcttggtggtccgagacccttggccgtacgctctgcctcactcctccgtctcttgcttcccttgccgccggcggcgcgcggcgccgggcgcggatcggcggcgggcnatgggttggaggccgccgccggncgccagacaggcaccagccgncggcggcctagcggcagcggaggggagcaccggcacctggncgcgctcgccgtcgccgcgcgcgtcgccatggtcaccacccggtccgtgggtccagcagcagtagcgnaaggtgatggagcgggagctgctgtaacagatgccggcgccgctggcggtggcggacgatgcatggaggacttcttcgactgcctcctcggtttgctcggcgcgttaggcatgacatgggctgcggcgcggncccagcggcaaccgc

SEQ ID NO: 29958 - protein, 62 aa, Zea mays
  misc_feature: Ceres CLONE 1405276-F
  misc_feature (14)..(14): Xaa is any aa, unknown, or other
  misc_feature (58)..(58): Xaa is any aa, unknown, or other
MVTTRSVGPAAVAXGDGAGAAVTDAGAAGGGGRCMEDFFDCLLGLLGALGMTWAAARXQRQP

SEQ ID NO: 29959 - DNA, 700 bp, Zea mays
  misc_feature: Ceres CLONE 1405279-F
  misc_feature: Encodes the peptide sequence at SEQ ID NO. 29960
  misc_feature (505)..(505): n is a, c, t, g, unknown, or other
  misc_feature (508)..(508): n is a, c, t, g, unknown, or other
  misc_feature (544)..(544): n is a, c, t, g, unknown, or other
  misc_feature (568)..(568): n is a, c, t, g, unknown, or other
  misc_feature (569)..(569): n is a, c, t, g, unknown, or other
  misc_feature (638)..(638): n is a, c, t, g, unknown, or other
  misc_feature (662)..(662): n is a, c, t, g, unknown, or other
  misc_feature (664)..(664): n is a, c, t, g, unknown, or other
  misc_feature (665)..(665): n is a, c, t, g, unknown, or other
tggagctccccgcggtggcggccgctctagaactagtggatcccccgggctgcaggaattcgcacgagaccattacctagaacatcctaatcgaaaaaggcctcgccactcttccgaacctgtagtcgcttacccactgccaactcagcgccaaactgtggagaattttttttttacctatttctatttatggtggtggtggtgtgcaatcgcaggaacaatcaccaccgttattaagaagatgatgcgctgcgctgcaacgggcggcgggtgcgtcgcttcgtggagcggcgattggagattgccggcggtcaacccctgcagcgtgcggatgccgacgggcaacgatgggtggtgcgccggcctgaggtcgcgggcggcggatctcgccggcctcgagatggccaacctgcgcggcgggcgtcggggggctcttccgcgcgagcccgcgctacgggcgcttgcaagccacggcggcagttgaccctgaagatattccattggnagnaaggttcaagttagatcctcaggacatgttctgcantatgttggcgttgctttgtttggnngcctattctgtttgttaccctccttggtggtgtcaatggcgcacttgatatctcgcgaaggatcttggnattgctgaaatgctgtcttgcacngnntggggtggttagcacatccttggctggggaacact

SEQ ID NO: 29960 - protein, 80 aa, Zea mays
  misc_feature: Ceres CLONE 1405279-F
MMRCAATGGGCVASWSGDWRLPAVNPCSVRMPTGNDGWCAGLRSRAADLAGLEMANLRGGRRGALPREPALRALASHGGS

SEQ ID NO: 29961 - DNA, 664 bp, Zea mays
  misc_feature: Ceres CLONE 1405280-F
  misc_feature: Encodes the peptide sequence at SEQ ID NO. 29962
  misc_feature (187)..(187): n is a, c, t, g, unknown, or other
  misc_feature (357)..(357): n is a, c, t, g, unknown, or other
  misc_feature (469)..(469): n is a, c, t, g, unknown, or other
  misc_feature (515)..(515): n is a, c, t, g, unknown, or other
tggagctccccgcggtggcggccgctctagaactagtggatcccccgggctgcaggaattcgcacgagaccattacctagaacatcctaatcgaaaaatttccaagtcccaatccaccgacgaattccaaaccctgcctaggacctcggcgccactcgccgcacgtcgtccacgtccgcctccaccnccaatccgatggggtatgaagagagcaaaaaacatctcctcagtctcagctaccctgagctgcaatgtttgtgcaaaaggtataaccttcctgctaagaagacccactctcagttagcaagttcgctcgcctcgctgcttgaggcatctccatctcctgctcctcctccntgtcaattagcaaatatgaaaagaagcatcccacatgcaaatcattgctaaaacacaaaagaggcccataccatggcaggggatgatggtaaacccacttgtgcatgcgaancatcaaaaaggagatcagacaccttggtgatgaaacatcttaaaanggggattgacactggtacgaggatatccttcggtttctattgaccatgggaaaaccgaataatctgggcatttattctcctgaactgaggaatgcccataaatttcaggtccaaaagggactggggatttgcgactaaaacaccaaatt

SEQ ID NO: 29962 - protein, 70 aa, Zea mays
  misc_feature: Ceres CLONE 1405280-F
MGYEESKKHLLSLSYPELQCLCKRYNLPAKKTHSQLASSLASLLEASPSPAPPPCQLANMKRSIPHANHC

SEQ ID NO: 29963 - DNA, 625 bp, Zea mays
  misc_feature: Ceres CLONE 1405281-F
  misc_feature: Encodes the peptide sequence at SEQ ID NO. 29964
cgctctagaactagtggatcccccgggctgcaggaattcgcacgagaccattacctagaacatcctaatcgaaaaccccaaataacaccaaggcaccaagcccagcgaggccaccagctgtccagctccacctcgtcgactcctccccgcacaagacaaaaaaaccctcgccttggagggtggaggcgcgtgagcccgacacccagagcgaaaaaagcaaggggtctgaccgccggcgatggcgtccatctccggagcggcggcggcgccatcttccgctgcgtgccggctgcggctgcgtaggcacatcctgctgcggccctcgcacctccgcctccgcgcgccccactccatcgccgacctctcccgctcctccagctcctctagttccgccccgacccgggcccagccgctgggctccaggccggagaacggcggcggcgtccgcgcggtggagaaggacccgatcaagctgtgggagcgctacgtcgagtggctctaccagcacaaggagctcggcctcttcgtcgacgtcagccggatggggttcacggaggacttcctgcgccagatggagccgcggatgcagcgggccttcgccgccatgcgggagctcgagaagggc

SEQ ID NO: 29964 - protein, 129 aa, Zea mays
  misc_feature: Ceres CLONE 1405281-F
  misc_feature: SWISSPROT Homolog: EC 5.3.1.9 Glucose-6-phosphate isomerase
MASISGAAAAPSSAACRLRLRRHILLRPSHLRLRAPHSIADLSRSSSSSSSAPTRAQPLGSRPENGGGVRAVEKDPIKLWERYVEWLYQHKELGLFVDVSRMGFTEDFLRQMEPRMQRAFAAMRELEKG

SEQ ID NO: 29965 - DNA, 717 bp, Zea mays
  misc_feature: Ceres CLONE 1405292-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (31)..(31): n is a, c, t, g, unknown, or other
  misc_feature (32)..(32): n is a, c, t, g, unknown, or other
  misc_feature (35)..(35): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (60)..(60): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (717)..(717): n is a, c, t, g, unknown, or other
nnnnnnnnnnnnnnnnnnccccnnnnccccnnaanaccccacnnnnnnnaccgggccaantaataatnnnnnnnccagagctggagctccaccgcggtggcggccgctctagaactagtggatcccccgggctgcaggaattcgcacgagaccattacctagaacatcctaatcgaaaagtagcggttacctccctttcgctctactgctctctctctctctctggaccttggcgttctctcccctcgtcggaatcagcccgcttcctgtgctctcctatgctccccttccggtcgtagcctcggcctttcgtctccctccatggacccgggctaaatgcatccggagattccaaacggggagggtttttttctggtccatcccccgaaaaaaggaaaaaaaggggcctccctttcccccccgggggggggggaaaccttccgaaaaaacccccctcacaaattttctggggggggggggaaaaaaaaagccccccccccttttaggggggagaaaaatttttttgggcccctttggggggggaataaaaaaaaaaacacccccccaggggggggttctcccccttttataaaaaaaaaaaaagtggggccggaaaggatcccccgggcgggcttatattagaaaatctggggggcgccaaaaaaccaaaaaatattttttttctcccccgcccgcgaaaaacggccgcgtttattn

SEQ ID NO: 29966 - DNA, 716 bp, Zea mays
  misc_feature: Ceres CLONE 1405293-F
tccccgcggtggcggccgctctagaactagtggatcccccgggctgcaggaattcgcacgagaccattacctagaacatcctaatcgaaaaaactaccagcgcagtcactcgcctctgcacacgtcgatgatgctcgtcttccttccttcccatcctttataaggaccggccgcggatctgatcgcctctcctcccttccctcccgtagcgtatcagtctcccggattctctccggctcgtgagagggccaaagcttctagttaggaaaaccctaccgttgtgggagcagcctccggagatggctgcgccggcgatcctgccggagctggcgacgcaggtgctcatcccggtcgcgccgcccgtgaacatcgcggtcgcggtggaggaagtgcgttgctggccttccagagtgggggtcaccccccgtacgccgacctgaacgtgggaatcccttggaaaaacgggccccagggcactaccttcatcgagggaagcacgttggggactcaatggacaacaaagcccaatggtacagaaggcgcccgaggatcaagagacggccattttcccgaaatgggggtaacatctttttctttttcccccaagggaaaaaccgcggggggggaaatattgcaggggtggaggtaattcgacacccccaaaaatccccccatccccccggcagcccaaggcacacaccaaaccataaccacac

SEQ ID NO: 29967 - DNA, 600 bp, Zea mays
  misc_feature: Ceres CLONE 1405298-F
ggagctccccgcggtggcggccgctctagaatagtggatcccccgggctgcaggaattcgcacgagaccattacctagaacatcctaatcgaaaagcgaccgcgactcggatcggatctctctcctgtgtagagccatgctgtgctgtgctggtagtagcagcagcagtagcaatgagtagtccagtccacagctccaagaacacgtggccgtcctttcctttgctctccctatcggatcccgggaaacgcagggggaagggggccaccgggtttttaccagggcctggccctttttgccccccccggggccggtggggcccctttgggttctttcccctcccccccttgaaaaaagggttttgggaaaatttgaaactcttaaaagaccccccgatttttttcccgcccggggggttttttttttttccccccaggttccggggggaaatttttccccccccctttttttttttcccccccccccccacagaaaaaattctcccctggtcgcgcgggaattttgaaaaaaaaaggggggggggtaaaaaaaagggggggggggccccccaccaaagggggggagaaaaaaaaaacccct

SEQ ID NO: 29968 - DNA, 639 bp, Zea mays
  misc_feature: Ceres CLONE 1405303-F
  misc_feature: Encodes the peptide sequence at SEQ ID NO. 29969
  misc_feature (412)..(412): n is a, c, t, g, unknown, or other
  misc_feature (441)..(441): n is a, c, t, g, unknown, or other
  misc_feature (574)..(574): n is a, c, t, g, unknown, or other
  misc_feature (575)..(575): n is a, c, t, g, unknown, or other
tccccgcggtggcggccgctctagaactagtggatcccccgggctgcaggaattcgcacgagaccattacctagaacatcctaatcgaaaaatctgcagttctcgacctctcctcctacctcctcttcactccccccctcccttcctccctcttgcatcactatcaccaccaacaacaaggctaacgcacaccaatccaacaaggagaacaaaaaacaattaatcgtgttttgatatcacctcgttcgagttaagtgcgtgaagaggtaataatggtggcagtggaggttgtgccggcgtccgcggagtccccgattccgatcgaggctaaggccgcggtgacgtcggaggcggaggcggaggccgagggcgaagtggaggcggagatgaagggtgatgcggcagccacggngggagaaaacggaggaggaggaggagganggaaggaaaaagtgtacaagagcgacctgaagaagctggagaacctcatgtccaagcttaaccctccgcgcaaggagttccgtgccgtcgtcgcgccgcacggcccagcgccgtgggggcgcgaaccgcgggnnaaaaaaaagggtgctctcgcgaccgccccccgtggttctgggcccgcgccgaaaaataacgggg

SEQ ID NO: 29969 - protein, 122 aa, Zea mays
  misc_feature: Ceres CLONE 1405303-F
  misc_feature (47)..(47): Xaa is any aa, unknown, or other
  misc_feature (57)..(57): Xaa is any aa, unknown, or other
  misc_feature (101)..(101): Xaa is any aa, unknown, or other
MVAVEVVPASAESPIPIEAKAAVTSEAEAEAEGEVEAEMKGDAAATXGENGGGGGGXKEKVYKSDLKKLENLMSKLNPPRKEFRAVVAPHGPAPWGREPRXKKKGALATAPRGSGPAPKNNG

SEQ ID NO: 29970 - DNA, 645 bp, Zea mays
  misc_feature: Ceres CLONE 1405306-F
  misc_feature (363)..(363): n is a, c, t, g, unknown, or other
  misc_feature (611)..(611): n is a, c, t, g, unknown, or other
tccccgcggtggcggccgctctagaactagtggatcccccgggctgcaggaattcgcacgagaccattacctagaacatcctaatcgaaaagttgctttcttccccactacaacatctggcaccgcgaaatcacgactacctccttctgacttctgggacttctccgcgggggtatccaggtccgatcgccgcccctccataccaaagccatagcgtctgcggatgcggcgttccgcatcgtacaatggtgtctgatcgctactcgatcgatgctacatcgagcgcatgctccacgacgtccctgtcatgaaggtccgcggacgcgactccgacgccggagcgacgccgagctgcgttgtaangccagacggatctgctgcggcaggggtacttcatcgcgcagaccatggacaacgcctcgaggtccaggtgagtggatgcggcacctcaggggcgcgttatttcctgcgaccctccagtaacaatttccccgagtctccgaaagaaagctcgccaaggacgaggcttggcggaggacccacccaagtcgttctccaaatatattgagaggaccgcgcaaaatttaaaataacttcgcgcgcaccccggnatgaaacaagaaaccttgcgagaaagcttaggtc

SEQ ID NO: 29971 - DNA, 665 bp, Zea mays
  misc_feature: Ceres CLONE 1405308-F
  misc_feature: Encodes the peptide sequence at SEQ ID NO. 29972
  misc_feature (333)..(333): n is a, c, t, g, unknown, or other
  misc_feature (338)..(338): n is a, c, t, g, unknown, or other
tggagctccccgcggtggcggccgctctagaactagtggatcccccgggctgcaggaattcgcacgagaccattacctagaacatcctaatcgaaaaatccaatacccccacgaacccactctctctccccacgatggcaaaaatggcgatggcgtcctcccgcctcccggctctcctctgcctcgccgacgtcgccgtcgccgtcgcggcggaggccgccgccgccgccggagaaggcggcctccgcctgccccgcgacgccacgttcccggcggcgcaggcggagcggatcatccgcgcgctcaacctcctgcctaagagaacgagggggngccgnccgcgggcgggggggtacgggcccagcgtggggcccaggggaggtcctagagggtcgggtccgggatggccggatcggccccccgggatggggaaacccccgacaaaaatgggaaaaaaataaacctgggccgaaaagaaaccacccggaaaaaggggcccccacctaccttgcgagggggggggaaaacaggaaaggggggggccccccgccccggaacctgggttctaccggaggggccgcaattgaaaaccccaaaaaaggcccccttttaaaaaagaaagggcccccctgctccattaaccaacaaaatggggagcccgcggg

SEQ ID NO: 29972 - protein, 108 aa, Zea mays
  misc_feature: Ceres CLONE 1405308-F
  misc_feature: SWISSPROT Homolog: EC 3.4.16.5 Carboxypeptidase C
  misc_feature (67)..(67): Xaa is any aa, unknown, or other
MAKMAMASSRLPALLCLADVAVAVAAEAAAAAGEGGLRLPRDATFPAAQAERIIRALNLLPKRTRGXRPRAGGYGPSVGPRGGPRGSGPGWPDRPPGMGKPPTKMGKK

SEQ ID NO: 29973 - DNA, 647 bp, Zea mays
  misc_feature: Ceres CLONE 1405311-F
  misc_feature: Encodes the peptide sequence at SEQ ID NO. 29974
  misc_feature (91)..(91): n is a, c, t, g, unknown, or other
  misc_feature (226)..(226): n is a, c, t, g, unknown, or other
ccaccgcgggtggcggccgctctagaactagtggatcccccgggctgcaggaattcgcacgagaccattacctagaacatcctaatcgaanaaaaaaatccatttccctttcttctgaagtcgtcctcttcttcccgtcgcttcgccgtgccgcacctgcgaggagaggagacttcgccgcgaagctcaccatgatctcgccggagaggagctcgtcacagagccngcggtcggcggcggcgggggcgcccttcctgtcgatctccgtcacggatcccgtaaaagatgggtaacgggggggaatcctaacatctcctacgggggtatcaccaaaaaccaacctccctggaattgggggaacagaaaaaaattgttattccgggcgcttggggatttaaaagggtggcaaagaccgtttggctaaaaagacaaaagggtttttttatcccccccctttcccgaaaaaaaaggggttgggaaaaaatcccggtttaaaaaaggagggttttttgtaatttggggggccccacccttttttattttttttcttaaaaagggatattttctccccccccgcaaaccaaaaaaaaagggggggttttttgggaaaattttttttccccaaaaaaaaaaaaaaaataaggggg

SEQ ID NO: 29974 - protein, 96 aa, Zea mays
  misc_feature: Ceres CLONE 1405311-F
  misc_feature (30)..(30): Xaa is any aa, unknown, or other
  misc_feature (75)..(75): Xaa is any aa, unknown, or other
TAGGGRSRTSGSPGLQEFARDHYLEHPNRXKKSISLSSEVVLFFPSLRRAAPARRGDFAAKLTMISPERSSSQSXRSAAAGAPFLSISVTDPVKDG

SEQ ID NO: 29975 - DNA, 656 bp, Zea mays
  misc_feature: Ceres CLONE 1405314-F
  misc_feature: Encodes the peptide sequence at SEQ ID NO. 29976
  misc_feature (416)..(416): n is a, c, t, g, unknown, or other
  misc_feature (476)..(476): n is a, c, t, g, unknown, or other
  misc_feature (484)..(484): n is a, c, t, g, unknown, or other
  misc_feature (537)..(537): n is a, c, t, g, unknown, or other
  misc_feature (538)..(538): n is a, c, t, g, unknown, or other
  misc_feature (608)..(608): n is a, c, t, g, unknown, or other
cgcggtggcggccgctctagaactagtggatcccccgggctgcaggaattcgcacgagaccattacctagaacatcctaatcgaaaaactgccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatcntccgtggcggggctcaaggtgcgcagcatcgagatggtggcgcgctccgtgctccccagnttctacgncgggcgacgtgcacccgagagactttgggagggtgttcagctccttcggcagnncgctacgtcgtccgccagccccagggggtcatggtcgagcccttcgccaggcctcctagcgcccgaaaangggtcgcgggaccccaaaattggtgggaggcccaaagggaaacgaaag

SEQ ID NO: 29976 - protein, 163 aa, Zea mays
  misc_feature: Ceres CLONE 1405314-F
  misc_feature: SWISSPROT Homolog: EC 2.3.1.15 Glycerol-3-phosphate O-acyltransferase
  misc_feature (84)..(84): Xaa is any aa, unknown, or other
  misc_feature (104)..(104): Xaa is any aa, unknown, or other
  misc_feature (124)..(124): Xaa is any aa, unknown, or other
  misc_feature (148)..(148): Xaa is any aa, unknown, or other
MVASPRFKPIEECCSEGRSEQTVAADLDGTLLISRSAFPYYLLVALEAGSVLRAALLLLSVPFVYVTYAFFSESLAISTLVYIXRGGAQGAQHRDGGALRAPQXLRRATCTRETLGGCSAPSAXRYVVRQPQGVMVEPFARPPSARKXVAGPQNWWEAQRETK

SEQ ID NO: 29977 - DNA, 652 bp, Zea mays
  misc_feature: Ceres CLONE 1405324-F
  misc_feature: Encodes the peptide sequence at SEQ ID NO. 29978
  misc_feature (409)..(409): n is a, c, t, g, unknown, or other
  misc_feature (429)..(429): n is a, c, t, g, unknown, or other
tggagctccccgcggtggcggccgctctagaactagtggatcccccgggctgcaggaattcgcacgagaccattacctagaacatcctaatcgaaaaattcgcctcgccttgatctccaaccccttccttccttgcttaggagagagagggaggagaggagaggaggaagaagatggagagggcggccccagtgaggagttcccacacctccacggccggcctactcgcgtggcctcaacccgatggcgccgcgtcgcaggcaccacgtcggcctaaccagccgacggaggaattcaggaaggtggtggttcggggggcaggtcaccgaaggaggccgacggtctcaacaagacgaagatgaggacgacggcctccgcacccaagtcgaaggagacaacagggatcggncatgtttaaggccgagagcngccgccgccgccgtcacactggcatcccgtgatcgccaggctagccagatcacctttttctcaggacgggaccattcctcccaggagccaacttcagtttggctggggtggcgaggcagcgcgaacttagcaaaccggttgagaaggttccgggggacggtaggatgaaaccggcaggtggtccaatgcgaaaccaagggaagctcagtggtcacaacatctt

SEQ ID NO: 29978 - protein, 62 aa, Zea mays
  misc_feature: Ceres CLONE 1405324-F
MERAAPVRSSHTSTAGLLAWPQPDGAASQAPRRPNQPTEEFRKVVVRGAGHRRRPTVSTRRR

SEQ ID NO: 29979 - DNA, 653 bp, Zea mays
  misc_feature: Ceres CLONE 1405327-F
  misc_feature: Encodes the peptide sequence at SEQ ID NO. 29980
  misc_feature (571)..(571): n is a, c, t, g, unknown, or other
  misc_feature (633)..(633): n is a, c, t, g, unknown, or other
tccccgcggtggcggccgctctagaactagtggatcccccgggctgcaggaattcgcacgagaccattacctagaacatcctaatcgaaaagtttcccgctccgatccaacccagacatctgtaccgcgccgcgcgagcacgtccggcgccggtgcggcaggtgaaatccgagagtactcctcccccgctacgccgcaccgcccatggtcgcaggtagccgcatatagagagaggcgcaggcgagggcgtgcagatccagatccggtgggcgggaaggacttgatcgcccccaccaccatggtacggcgcggcgacggcgctcttcctgctgggcatgaagggccgcggtctcgtctggcgcgactaccgcggcgatgtctccgcgctccaggccgagcgcttcttcaccaagctcctcgacaaggagggcgattcgtaagtgcactcgcctgtggtctacgacgacgctggcgtcacttacatgttcatgcagcacgacaatgtacttcctcctcaccgccgctcgccagaaactgtaacgcgtgcagcaatcctcctcttcctccccgngggaaaatagagtgtgctcaagcactacttcgaggagctggaaggaggaccccactcagagnaaacctttcgccgcgggggg

SEQ ID NO: 29980 - protein, 34 aa, Zea mays
  misc_feature: Ceres CLONE 1405327-F
MKGRGLVWRDYRGDVSALQAERFFTKLLDKEGDS

SEQ ID NO: 29981 - DNA, 673 bp, Zea mays
  misc_feature: Ceres CLONE 1405328-F
  misc_feature: Encodes the peptide sequence at SEQ ID NO. 29982
tccccgcggtggcggccgctctagaactagtggatcccccgggctgcaggaattcgcacgagaccattacctagaacatcctaatcgaaaaaccgatgtcctgagattggaaagagggaagccgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttcaactctgatctacttcaacatcttcctgggcgacatgtggtccgccatgaagtcggagaagaagcgccagaagcagcacgacgagaacgtgcagaaggtcgtgaagcggctcaagcagaggaaccgaaagaaggacgggtcttgtttgcacggccaggaagcccctggatcgctgttggcatgcgcaacgtggactacaagcggggagggaattttcgaggtcgaccttttcttcctcaagaaacatccttgagatcgacaaagagaaggaggggttgccaaggtccaagccctttgtcaaaatggggccagataa

SEQ ID NO: 29982 - protein, 120 aa, Zea mays
  misc_feature: Ceres CLONE 1405328-F
MADVHEPLVRRKRKKVLVDYLVKFRWILVIFVVLPISTLIYFNIFLGDMWSAMKSEKKRQKQHDENVQKVVKRLKQRNRKKDGSCLHGQEAPGSLLACATWTTSGEGIFEVDLFFLKKHP

SEQ ID NO: 29983 - DNA, 681 bp, Zea mays
  misc_feature: Ceres CLONE 1405330-F
  misc_feature: Encodes the peptide sequence at SEQ ID NO. 29984
cgcggtggcggccgctctagaactagtggatcccccgggctgcaggaattcgcacgagaccattacctagaacatcctaatcgaaaaacagcacgctctccctctccccgacggctgctagctagcgacaacggatcgacggccacaccgatgtgcgaggccaacgccacaggcacgccagccaccgcgacggtgcgcgtgctgatcgtggcgcgcgtcgcgccggctacggagccgggagaggtggaccccgtcgtcgtaaagctgtccttcttcgacacgcccctgtgtcgtgctgccgcccatcctgcgcgtgttcctgtacgagctgcctggatggcgacggtgacgtcacggtcggcagtgacgcgcctcaatagctccctcgccgccacggcatgacgtggaacctgccgctggccggggaagactgaaggtacgcgcccgaaccccgaggggagggggcccgggggactgaagcaagctccccggggccctgggctttggtttggaggaaaaaggagggtttttctttgaaaaaaatataagaaaaagggcgacgaacatctcaaagggggtcagggggggattggacaccccggctggaacccaccagttggggaggaagagaggataaccaggccagggtggaatgcattggcgacgtatactatatggtcg

SEQ ID NO: 29984 - protein, 83 aa, Zea mays
  misc_feature: Ceres CLONE 1405330-F
MCEANATGTPATATVRVLIVARVAPATEPGEVDPVVVKLSFFDTPLCRAAAHPARVPVRAAWMATVTSRSAVTRLNSSLAATA

SEQ ID NO: 29985 - DNA, 667 bp, Zea mays
  misc_feature: Ceres CLONE 1405332-F
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (292)..(292): n is a, c, t, g, unknown, or other
tggagctcaccgcggtggcggccgctctagaactagtggatcccccgggctgcaggaattcgcacgagaccattacctagaacatcctaatcgaaaaacacgcccagtctcctcaatcctcacatcctattggccacggcaactgccatcgccatggccgggaggcgtccggcaccggcggccctcctcctcctcgccgtagccttcgctnnncccatcctccttcccggccgtttcggccccagtctccgatggcgcacagatccgctgccnnnnnnnagagnnnnnnnanaaggaggacaggctcgttttctataaaaacacccaaccccacaacctttacaccgccgccggcgtccactccacaatagggccgcccccgggaccaaacccgcaaaaccgcgaaacacgagacaccggcccgaagccacccgcaggccgccaccgcaaccggcacccaaccccaacgggcggatcacaaagggcgggtatgttacgaacacccatcttttcctccccctgccgggggagtgcggaagaaaaaaaaacgaggggggggggggtccttttttcccccccccccccctttcttgttttcctgtcccgcgaggacaggttttccgccgtgcgcagggcgcaaagaactggagggggcccggtggggggg

SEQ ID NO: 29986 - DNA, 624 bp, Zea mays
  misc_feature: Ceres CLONE 1405336-F
  misc_feature: Encodes the peptide sequence at SEQ ID NO. 29987
  misc_feature (318)..(318): n is a, c, t, g, unknown, or other
agtggatcccccgggctgcaggaattcgcacgagaccattacctagaacatcctaatcgaaaaatcccaagaagagccgccctacctattccttctccccgccgtcgagctgcccaacccagagcaccagcagccctcacctccttcctctcggccggtccttccaacgagcccgctggtcttggagccgccaccgttctcgttctggacgaacgttcaaggagattgcatttgtggatgctctaatggagtcgaaaggtggcaagaagtctagtagtagtagtagtaatttcatgtacgaagctccccttggctacnagatcgaggacgttcgcccagccggaggaatcaagaagttccagactgctgcttattccaactgcgtccgccagccatcctgatatcgcctcacatgcaattccgcggagaagaggatttttaattcagttttcctcctggggccggaagtttttccggtgggctctggctggccttcctctgccttctgaaaattccaactttggctttgccaatctctcccttttccctctcccatccccctcttttctgggaaaggcatcccaaggggggggaggtcttcaaaaagaatttttggggtctctt

SEQ ID NO: 29987 - protein, 51 aa, Zea mays; identical to SEQ ID NO: 25716
  misc_feature: Ceres CLONE 1405336-F
  misc_feature (1)..(51): Pfam Name: AdoMetDC_leader Pfam Description: S-adenosyl-l-methionine decarboxylase leader peptide
  misc_feature (25)..(25): Xaa is any aa, unknown, or other

SEQ ID NO: 29988 - DNA, 706 bp, Zea mays
  misc_feature: Ceres CLONE 1405339-F
  misc_feature: Encodes the peptide sequence at SEQ ID NO. 29989
  misc_feature (494)..(494): n is a, c, t, g, unknown, or other
  misc_feature (512)..(512): n is a, c, t, g, unknown, or other
  misc_feature (595)..(595): n is a, c, t, g, unknown, or other
  misc_feature (616)..(616): n is a, c, t, g, unknown, or other
aaagctggagctccccgcggtggcggccgctctagaactagtggatcccccgggctgcaggaattcgcacgagaccattacctagaacatcctaatcgaaaaatctctctcgctttctctagccatgacgctggtgaggatgccttgccgcctctgctgcttcctgctcgtcgtcgccgcctccgccgtctccgggcggtggcgggtggtcaccaccctcccgggctacgagggccgcctccccttccacctcgaaacaggctatgtggaggtggacgaggacgccggcgcggagctcttctactacttcgtccgggccgagtccggcgccgacgacagcgacaccccgttcgtcctccggatccccggcggccaacgctgctccgccttcagcggcctcgcctacgagataggtcccatcatgttcgtcgtggagccctacaacggcagcttgccgcgcctgcgctacaacccaaactcgtggacaaaggtgncgcatattctttttgtgnattcgccagttggggccgggttttccttctcagagatgccaaaggctacaacgctggagcggtatcaaccacgctgcacttgncgaaagtcctcaacaagtggntcacgaccatcctgagtaccatgcaaaatctttctacatcgatggagaatcatacgctgggaaaattgtaccattcctttgcacagatga

SEQ ID NO: 29989 - protein, 168 aa, Zea mays
  misc_feature: Ceres CLONE 1405339-F
  misc_feature: SWISSPROT Homolog: EC 2.3.1.92 Sinapoylglucose--malate O-sinapoyltransferase
  misc_feature (124)..(124): Xaa is any aa, unknown, or other
  misc_feature (130)..(130): Xaa is any aa, unknown, or other
  misc_feature (157)..(157): Xaa is any aa, unknown, or other
MTLVRMPCRLCCFLLVVAASAVSGRWRVVTTLPGYEGRLPFHLETGYVEVDEDAGAELFYYFVRAESGADDSDTPFVLRIPGGQRCSAFSGLAYEIGPIMFVVEPYNGSLPRLRYNPNSWTKVXHILFVXSPVGAGFSFSEMPKATTLERYQPRCTXRKSSTSGSRPS

SEQ ID NO: 29990 - DNA, 708 bp, Zea mays
  misc_feature: Ceres CLONE 1405340-F
  misc_feature: Encodes the peptide sequence at SEQ ID NO. 29991
ggagctccccgcggtggcggccgctctagaactagtggatcccccgggctgcaggaattcgcacgagaccattacctagaacatcctaatcgaaaaataaatccccaatctccgcgctttccttccgccccacactcgtccactcaccccctctttgctctgcctcgccgcgccgcatagcagagcatggcgcccccacgacctctcctcgccgtcgtcttcctcgccgcgaaggatctgctcctcctttctccggcagaggcggggacggtgggcgtgaactacggccgcgtgacgaacaacctgcccaacccagcggcggttgtgcagctgctcaagcagcacggcgtcgcgcatgtgaagctgtacgacgccgaccccaccgtgctgcgcgccctcgcgaacaccggcatcaaggtggtggtgacgctgcccaacgagcaggtcgcggcgtcggcgtcgcgcgcgtcctacgcgctgctgtgtgtgcgccggaacgtggcgatgtaccacccggccacgcagatccagggcatcgccgtggacaacgatgtgttcgcgtcgtgcaagaacgagacggcttatctggtcccggccatggccaacgtgcacgccgcgctggacaggctcgacctcgacggtgtcgtcaaggagtcgtctctcatcgcgctcactgggctcgcgtcgtcctacccgtcctcagagact

SEQ ID NO: 29991 - protein, 174 aa, Zea mays
  misc_feature: Ceres CLONE 1405340-F
  misc_feature (29)..(174): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
MAPPRPLLAVVFLAAKDLLLLSPAEAGTVGVNYGRVTNNLPNPAAVVQLLKQHGVAHVKLYDADPTVLRALANTGIKVVVTLPNEQVAASASRASYALLCVRRNVAMYHPATQIQGIAVDNDVFASCKNETAYLVPAMANVHAALDRLDLDGVVKESSLIALTGLASSYPSSET

SEQ ID NO: 29992 - DNA, 712 bp, Zea mays
  misc_feature: Ceres CLONE 1405342-F
  misc_feature: Encodes the peptide sequence at SEQ ID NO. 29993
  misc_feature (478)..(478): n is a, c, t, g, unknown, or other
  misc_feature (550)..(550): n is a, c, t, g, unknown, or other
  misc_feature (635)..(635): n is a, c, t, g, unknown, or other
  misc_feature (642)..(642): n is a, c, t, g, unknown, or other
  misc_feature (647)..(647): n is a, c, t, g, unknown, or other
caaagctggagctccccgcggtggcggccgctctaaaactagtggatcccccgggctgcaggaattcgcacgagaccatttacctagaacatcctaatcgaaaaaccaaccaaccagtgctgccctccgccgatccactgacctaccgcgagcgccaatggcgaccgccgcggtcctggccgccacattagcgctgttcctccgcgccgccgccgcaacggccgcgacggctgcggcggaggcggaccggatcggcaggctgcctggccagccgccggtcaacttctccatgtactccggctacgtcaccgtggacgcggcgacggggcggcccctcttctactggttcatcgaggcggccggcgtgcccgcggagtccgcgccgctcgtgctgtggctcaacggcgggcccgggtgctcctccgtcggctacggcgcgtcagaggagctcggtgccttccggatcaacgccgacggnaggacgctctacttgaacccctacccctggaataaagtggcgaacatgctgttcttggactcgccgggcggngtcggttactcatactccaactccacctccgatctgtacactgccggtgacaacaagacagcccatgactcgtacaatttcttgntgactgnactgnatcgtctccacaatacaggcatcgcgatttctacatcacaagagagagctacgcaggccactacc

SEQ ID NO: 29993 - protein, 185 aa, Zea mays
  misc_feature: Ceres CLONE 1405342-F
  misc_feature (36)..(185): Pfam Name: Peptidase_S10 Pfam Description: Serine carboxypeptidase
  misc_feature: SWISSPROT Homolog: EC 3.4.16.6 Carboxypeptidase D
  misc_feature (160)..(160): Xaa is any aa, unknown, or other
  misc_feature (162)..(162): Xaa is any aa, unknown, or other
  misc_feature (164)..(164): Xaa is any aa, unknown, or other
MATAAVLAATLALFLRAAAATAATAAAEADRIGRLPGQPPVNFSMYSGYVTVDAATGRPLFYWFIEAAGVPAESAPLVLWLNGGPGCSSVGYGASEELGAFRINADGRTLYLNPYPWNKVANMLFLDSPGGVGYSYSNSTSDLYTAGDNKTAHDSYNFLXTXLXRLHNTGIAISTSQERATQATT

SEQ ID NO: 29994 - DNA, 645 bp, Zea mays
  misc_feature: Ceres CLONE 1405343-F
  misc_feature: Encodes the peptide sequence at SEQ ID NO. 29995
  misc_feature (425)..(425): n is a, c, t, g, unknown, or other
  misc_feature (462)..(462): n is a, c, t, g, unknown, or other
  misc_feature (468)..(468): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
tggagctccccgcggtggcggccgctctagaactagtggatcccccgggctgcaggaattcgcacgagaccattacctagaacatcctaatcaaaactgtccctccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcggccccgagccgtcgcgcggtcgcctccacatctcgtcgtgctttaaggtctttggcctccgccgttcttggacaggggcacaccactgtccaccggtgcccactacgcgaaatacgagtccctcgtgcggctccgtagggtggaagagatccatcaggcggtgagtgggaggggcgncgtccacaccaaccggaggggaggggggcaatggcgnccgtgncaggcccactctgcacgtggctcgtcgccgcgtgcttatctgcggcatgcgacgctgaagagcacaagcagaagcatttctgcgcaggcggaaagcgcgctgggggcggtgtcatgctcggcaggcgcgctcgcgcgcgggccgtttgccctagaggtagagtgggcacgcnnnnnn

SEQ ID NO: 29995 - protein, 61 aa, Zea mays
  misc_feature: Ceres CLONE 1405343-F
  misc_feature (3)..(3): Xaa is any aa, unknown, or other
  misc_feature (5)..(5): Xaa is any aa, unknown, or other
MAXVXGPLCTWLVAACLSAACDAEEHKQKHFCAGGKRAGGGVMLGRRARARAVCPRGRVGT

SEQ ID NO: 29996 - DNA, 700 bp, Zea mays
  misc_feature: Ceres CLONE 1405344-F
  misc_feature (491)..(491): n is a, c, t, g, unknown, or other
  misc_feature (532)..(532): n is a, c, t, g, unknown, or other
  misc_feature (576)..(576): n is a, c, t, g, unknown, or other
cagagctggagctccccgcggtggcggccgctcttacctagtggatcccccgggctgcaggaattcgcacgagaccattacctagaacatcctaatcgaaaagagaaaaaacataggggtcccggtgacctaactctgcctccgggccatcgccggagttgcgccgccgccctagtctacagtgctaccaccacctagataggctacctgcaggttgtggcgtcggatgcttcaccgtgcactcgaaccctacgagagtcttggaagtgcaactcgcgcgacggtagcgaggggaagcgaatcagcagacggaacagagtccagacgagggaggggaaggcggcttccggctccagccgagaacccacaggagatccggaaaacgacacgagcactgcctgcctgcgcaccgcctccagttggcacttggcagccgactataaatcccaccgcgggccggatccccattcgtctgccccccgtgccctcgncgatcagcgatcaacaaaccactccttttccctcccctcgncatgggagtccggacttcccgttgcctcaaaatcaagggttganctgacaaaaggaattcttgggagtctaagggctttaccaacccaaaaaagcttaccttcccttgccatggccaattaaaaggacccccggaaagggggagggcccccccccttgaacgggggcg

SEQ ID NO: 29997 - DNA, 828 bp, Zea mays
  misc_feature: Ceres CLONE 1405350-R
ttccaattgggtaccgggccccccctcgaggtcgacggtatcgataagcttttttttttttttttttattgaaaccaaatttcatacataaccatcaccagctgaagtgggcatagaaacctccgacggtagagcaaacataacagggctcagaatacatatagatgggcatttatctgtccagaccattacggtccaacaagggtaaccacacaaacacatatatcactagtccagacatatatgccagcaataaaataactgcaaggtactactcaatatagcaaggaaacagcaagtcatggtgtcaaaaacaacaggcagaaaaaaaaataacttgtagttgtagaccctaaattagatgcgtaattatattaagcaacagcgcggaggaaaccacacggcagggtcttggaaaatgtttgttcccaattagctgctgaagctcaagtttcagcggatgtttgggcgcccccactgttttcaagagctgtcaaagctgttgttccaagggccgcagcaggggcagcagagtgatcctgggatgcagcaggaggtgttgcttcagtagagtaggctggaggctgcccatagcttgcactaccataagcatcgccataagactgctgctggccatagccctggtggcttgcaatgggtgcaccaggataagctggtggtgcaccgtaagcaggttggctgtaaccatactgcccgtaaacagcccttagcagaaccacgaagcagagcctgtccattaggtgacaatggaaggaagtttctggcccctttggagaaagctgccccataagcgccctgaccatatct

SEQ ID NO: 29998 - DNA, 890 bp, Zea mays
  misc_feature: Ceres CLONE 1405350-R2
  misc_feature (1)..(1): n is a, c, t, g, unknown, or other
  misc_feature (890)..(890): n is a, c, t, g, unknown, or other
nttttctgataatcgtcacctgatgaagtgggcatagaaacctccgacggtggagaatactaagagggctcagaataatatagatgggcatttatctgtccagaccattgcggtccaacgagggtaaccacactaactcatttatcactagtccagacttttatgccagcaataaaataactgcgtggtactactcaatatagcgaggaaacatcaagtcgtggtgtcaaaaacaacaggcagaaaaaaaaataagttgtagttgtacaccctaaattagatgcgtaattatattaagcaacggcgaggaggaaaccacacggcagggtcttggaaaatgtttgttcccaattagctgctgaagctcaagtttcagctgatgtttgggcgcccccaccctcttgaggagccgtcgaagctgttgttccaagggccgcagcaggggcagcagaatgatcctgggatgcagcaggaggtgttgctttcagaataggtagctggaggctgccaatatcttgcactaccataaacatcgccataagactgctgctgggccaaaacccctgaggggcttgctaagtggggtgcaccaaggttaaggtgggggtgcaccaataaaggaggtgggttgtaacccattacctggccattaaaccaggcctggaggagaaccgaggaatggaaaatccctgtccaatgatggcgaccaatagggagggaggttttcccgcccccatctggaaagaaatgccaccccaatatagactccccttgaaacataatccccaccattgtaatttgggctgggtttgggtgtcacattatcaaaaaaaatagtatagatgcgtagggaaaccttcccttttatttccagtgattgtgccgtcatn

SEQ ID NO: 29999 - DNA, 681 bp, Zea mays
  misc_feature: Ceres CLONE 1405350-F
  misc_feature: Encodes the peptide sequence at SEQ ID NO. 30000
aaagctggagctcaccgcggtggcggccgctctagaactagtggatcccccgggctgcaggaattcgcacgagaccattacctagaacatcctaatcaaaaaagcttgctcacgagggttttccgctgaaatatcccttggttcactgatcgatgcagcctccgacgaaaccctagcaaccgcgtcctccgccatgtccgacgaccactactcctctaagagtaagtacgacgattcctcgccggcaacgaggagcacggcctactcttcgggcccggcgccagactctgcgttcgtgtcacagtgccccatcatacaacagcgcggcaccgcctcacgatgaaattcagctcgttaagcaacgtgcggacgacatcgcggtgcgcatctttaagcgacgagagcgaaagcaacctggaggcgaccatggcgacgatgacagcaactcttctctgaacgcctgcgcagcactggagccggcgaccgtatcggagatggacgactctgctgctgtcgtctgacgtgatgaacacgcgtctactatgccgagtaatctttcgcagacgccacgtcagtactctgcttatgtagtatcaccgggacagacaaggcatcgaactgcaatgacatgggtactgtatcattggacaacggcgcaactattagggtatccgctgcaga

SEQ ID NO: 30000 - protein, 49 aa, Zea mays
  misc_feature: Ceres CLONE 1405350-F
MSDDHYSSKSKYDDSSPATRSTAYSSGPAPDSAFVSQCPIIQQRGTASR

SEQ ID NO: 30001 - DNA, 672 bp, Zea mays
  misc_feature: Ceres CLONE 1405353-R
  misc_feature: Pfam Name: PDZ Pfam Description: PDZ domain (Also known as DHR or GLGF)
caattgggtaccgggccccccctcgaggtcgacggtatcgataagcttttttttttttttttttcgcacttccaacatcagactggctcagcaatgatctttaaggcaatgccaagcacgagaagtgaagctcatgatcatgctcatacacgtgcatggaagggaatgtccagagcgaaaaggacacttcaataattcctagtgaaatggaattgtttccaatgggacgacagtcgtggacagctcggtatacgtgggttctattttccacaaactgctcacatgtctgcctcttctaaaggcagcgtcgcctccagggtctcggagcctcgccggatcgtcaagctcacctggtctccgacaccgtagtcatctggaaccctcagcaggtcagatttgcctttaacaggcttgccatccacagcgacaacgatgtcaccgagaacgaggttaccggcaaaacccctgctggtcggagcaagccctgctttggctgcggcgctgccccccagtaccttgagtaataaagctccgttgcgcacgtttagctgatacgccacttggatcttgagccaagtccacgttcaagccagcaccgcgaactttttcaaactgggattaactgaggagcggattttagataccgtttgatcaattggataaccgaaaccc

SEQ ID NO: 30002 - DNA, 805 bp, Zea mays
  misc_feature: Ceres CLONE 1405353-F
  misc_feature (441)..(441): n is a, c, t, g, unknown, or other
  misc_feature (507)..(507): n is a, c, t, g, unknown, or other
  misc_feature (508)..(508): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (556)..(556): n is a, c, t, g, unknown, or other
  misc_feature (559)..(559): n is a, c, t, g, unknown, or other
  misc_feature (563)..(563): n is a, c, t, g, unknown, or other
  misc_feature (588)..(588): n is a, c, t, g, unknown, or other
  misc_feature (621)..(621): n is a, c, t, g, unknown, or other
  misc_feature (622)..(622): n is a, c, t, g, unknown, or other
  misc_feature (632)..(632): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (729)..(729): n is a, c, t, g, unknown, or other
  misc_feature (757)..(757): n is a, c, t, g, unknown, or other
  misc_feature (758)..(758): n is a, c, t, g, unknown, or other
  misc_feature (767)..(767): n is a, c, t, g, unknown, or other
  misc_feature (789)..(789): n is a, c, t, g, unknown, or other
  misc_feature (790)..(790): n is a, c, t, g, unknown, or other
  misc_feature (792)..(792): n is a, c, t, g, unknown, or other
aaagctggagctccccgcggtggcggccgctctagaactagtggatcccccgggctgcaggaattcgcacgagaccattacctagaacatcctaatcgaaaacccaaactcgattgcagctcgtgcaccacacacggacacgaatcctcctccgggcctccctctgggaaaccaggactacctcggatcagatgcagcccctaccctgcggaccgcccaccaacgcgcccgctgcttatgccgcgcccaggagcgtaagccggccccccgccgtcgttcaggtcgtcagctcggtccccccccatagtcagggacccgcccccccagcccttttcgcttaaactacccaccctgatggcccccgccctgtcgggggctttcggggtcccccgcaccccagccccccttgttgtgccggtggcccgccttcttactcccccnctcccatttgtggcggacgagccagtcccacttacttttcctccttggccgcccccgcgctccggnngaagatccgcacccaatgnnnactgcgccgcccaccaggttgtcagantcngggncccgcccaccccccacgctcggcgntaaggccctttgtggagcccttacgccgtcggnncacccgcgcncccccccccccgcataacggagagccgcggcacggcacgccaaacaannnttctctcacccaccccctgtcgaccaggcgcacagccgggtgggtgntttcgccgggaaggcgggaccacgggtnngggaacccngcgagtaacataccgccgccanngnagtctattccctt

SEQ ID NO: 30003 - DNA, 703 bp, Zea mays
  misc_feature: Ceres CLONE 1405356-F
  misc_feature: Encodes the peptide sequence at SEQ ID NO. 30004
  misc_feature (617)..(617): n is a, c, t, g, unknown, or other
  misc_feature (680)..(680): n is a, c, t, g, unknown, or other
aaagctggagctccccgcggtggcggccgctctagaactagtggatcccccgggctgcaggaattcgcacgagaccattacctagaacatcctaatagaaaaactgccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatctagatggtggcgcgctccgtgctccccaggttctacgcgggcgacgtgcacccggagagctggagggtgttcagctccttcggcaggcgctacgtcgtcacggccagccccagggtcatggtcgagcccttcgccagggccttcctaggcgccgacnaggtcgtcgggaccgagctggaggtcggcagggacggcaaggccacgggcttcatggccaggncaggcgtgctcgtcgggaccaca

SEQ ID NO: 30004 - protein, 93 aa, Zea mays; identical to SEQ ID NO: 24566
  misc_feature: Ceres CLONE 1405356-F
  misc_feature: SWISSPROT Homolog: EC 2.3.1.15 Glycerol-3-phosphate O-acyltransferase

SEQ ID NO: 30005 - DNA, 698 bp, Zea mays
  misc_feature: Ceres CLONE 1405359-F
  misc_feature (658)..(658): n is a, c, t, g, unknown, or other
aagctggagctccccgcggtggcggccgctctagaactagtggatcccccgggctgcaggaattcgcacgagaccattacctagaacatcctaatcgaaaagacgacacacctgacacgtgggtctatcagtcatcctggtccttttattttctttcttctctcacccggttcttcctcctcccgagtcccgaactctcgatccactcatccgctgagggcgtcggccttctggcccttctccccccggccgacctcgcccctccggcgctccgtccgcttcctgaactcgtctccctcacggacgttctcctccctccgctcgccgcgccgcaacccggagaggagaccgccgctcggtcgagcaccacctggggcccagcgtcctcgcgaccagctctagcgcggcgtccgccctctgcagccctggtgtccccgcgactggcttcggccggcacacaactccacagttaggtctccgtctgcacagcgcggcgatcttctctctccttcccgccctctgcagtccctctcagtccctctccgtctgcttgattctgctccaacctcagactaccctcgctctgaaaatgtcattacgcacccaatgcgcttgtagctgtatgctgcaaccctactctgcctcgtcttctccatcnacctaagatgcgcgcaaccccactcaccacgacggcccgg

SEQ ID NO: 30006 - DNA, 661 bp, Zea mays
  misc_feature: Ceres CLONE 1405360-F
  misc_feature (378)..(378): n is a, c, t, g, unknown, or other
  misc_feature (399)..(399): n is a, c, t, g, unknown, or other
  misc_feature (420)..(420): n is a, c, t, g, unknown, or other
  misc_feature (421)..(421): n is a, c, t, g, unknown, or other
  misc_feature (425)..(425): n is a, c, t, g, unknown, or other
  misc_feature (433)..(433): n is a, c, t, g, unknown, or other
  misc_feature (434)..(434): n is a, c, t, g, unknown, or other
aagctggagctccccgcggtggcggccgctctagaactagtggatcccccgggctgcaggaattcgcacgagaccattacctagaacatcctaatcgaaaaaccacgctccggtcagcctcgcctcccttctccgtctcattcccccaatcccacgccactcccgcaggaatccccacccaaattcccgtctccccgatcgccgcccttctcggtgcccgtaaaccctacccccggagtcgcccgtgcgctgtcgtgcccgcgttgccaccgtcggtggtccgcggcgcccgtaaccaaaacctaaccgcagcctgcagatcccgattcccgcagggagcgggagaggtgaaggccgcctcgccgcaaatggagcccngcggcgcgcgcaaggagtggngcgccgtccccggttcctcgnntcgntcaatggnngcgaggatgccgcggaccacgggaacttgggcagtcggaggaccaacctatctaccaggaaaggggcggtggaacttggagacttctggcccatcacatttgaggggaggggagggctcaaggaggaaatcctggaaaaaggccctgaaaaaggttttggcggaaaaggaaccaccttccaaaagcccaaaagggagtttgggggccaagcccttttaccaccccga

SEQ ID NO: 30007 - DNA, 684 bp, Zea mays
  misc_feature: Ceres CLONE 1405361-F
  misc_feature: Encodes the peptide sequence at SEQ ID NO. 30008
  misc_feature (439)..(439): n is a, c, t, g, unknown, or other
  misc_feature (443)..(443): n is a, c, t, g, unknown, or other
tggagctccccgcggtggcggccgctctagaactagtggatcccccgggctgcaggaattcgcacgagaccattacctagaacatcctaatcgaaaaaaaaccctgtttcacactagttctgtattcgtgtcctctggtctctcgcaggccaaacaaaagcgccgccgccgccggcaatgttccgccgcctcctcccccaccgtcgctacatctccacctcgcccgcctccaactccaacccgaccctctactctgacggaaccatcccattctctatcctctcgtggggccgtggcgcttccggacagctcggcggtggcaaggaggagcgccgcctctacccatcccccgtcgcccacctacttctcgccgaatcagacccacgccttgctcccacccccggacgccttccctctgcagaggagacgtctggagtgnaggntgggatctcttgtgggctcttccactcctcgctcctcgtcgaaggagcgcctggggtgtgggcaagggcgacggaggccgctcggtctcggtgacgagtcttccgccttcgtgcccgctctaacccaatctccgcgatctcccgctccttgcgcttggcggcatccactcccgcgcgctgaccacttccgtgacgtcttcacctgggggtattgtggaatgggagctctgggtcaccatgg

SEQ ID NO: 30008 - protein, 119 aa, Zea mays
  misc_feature: Ceres CLONE 1405361-F
  misc_feature (88)..(88): Xaa is any aa, unknown, or other
  misc_feature (89)..(89): Xaa is any aa, unknown, or other
MFRRLLPHRRYISTSPASNSNPTLYSDGTIPFSILSWGRGASGQLGGGKEERRLYPSPVAHLLLAESDPRLAPTPGRLPSAEETSGVXXGISCGLFHSSLLVEGAPGVWARATEAARSR

SEQ ID NO: 30009 - DNA, 574 bp, Zea mays
  misc_feature: Ceres CLONE 1405363-F
  misc_feature: Encodes the peptide sequence at SEQ ID NO. 30010
  misc_feature (218)..(218): n is a, c, t, g, unknown, or other
  misc_feature (257)..(257): n is a, c, t, g, unknown, or other
aaagctggagctccccgcggtggcggccgctctagaactagtggatcccccgggctgcaggaattcgcacgagaccattacctagaacatcctaatcgaaaagtttcctctctccaattcccacccgcgtcaaggagcttctcgtctgagcccgagctaacaagctcaccggcgggcaggatgctggcggcgtccaccaaggtcggctctaggctggnctctccgcacgcctccttttgtcgcggtgctgcagcggncggccctggccaagctcccccgtgctgggggtttcggggaatgctcccaggggcccgggttcggggggaaaggggaaggccccccccccggggggaaaacccccccccccccccttttcttttggagttcccccccgggggggggtttcgggggggaaaattattatcccggggaaaaaaaacatggggggaaaaaaaaaagggggggggccccccccccccctttttttggggggggaaaaaaagccccccccccttttttttttttttgcccccccccccacccccttttttttttttgtggggggggggcgccc

SEQ ID NO: 30010 - protein, 92 aa, Zea mays
  misc_feature: Ceres CLONE 1405363-F
MLPGARVRGERGRPPPRGENPPPPPFLLEFPPGGGFRGGKLLSRGKKTWGEKKKGGGPPPPFFWGGKKSPPPFFFFLPPPPPPFFFLWGGGA

SEQ ID NO: 30011 - DNA, 644 bp, Zea mays
  misc_feature: Ceres CLONE 1405368-F
  misc_feature: Translation starting site: 203
  misc_feature: SWISSPROT Homolog: EC 2.3.1.119 Icosanoyl-CoA synthase
  misc_feature (471)..(471): n is a, c, t, g, unknown, or other
  misc_feature (472)..(472): n is a, c, t, g, unknown, or other
  misc_feature (478)..(478): n is a, c, t, g, unknown, or other
  misc_feature (511)..(511): n is a, c, t, g, unknown, or other
  misc_feature (568)..(568): n is a, c, t, g, unknown, or other
  misc_feature (598)..(598): n is a, c, t, g, unknown, or other
  misc_feature (599)..(599): n is a, c, t, g, unknown, or other
tggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcagggnntgtggngggaggccacctacgacctcgccaccgtgctcngcttcctcggccgtctcgccttcaccatctccgtctacatcatgtccaggcccaggnccgtgtacctcatcgacttcgcatgctacnnagccggcgacgagctcaaggtgtccaaggcggagttcatcgacct

SEQ ID NO: 30012 - DNA, 678 bp, Zea mays
  misc_feature: Ceres CLONE 1405370-F
  misc_feature: Encodes the peptide sequence at SEQ ID NO. 30013
  misc_feature (517)..(517): n is a, c, t, g, unknown, or other
aagctggagctccccgcggtggcggccgctctagaactagtggatcccccgggctgcaggaattcgcacgagaccattacctagtacatcctaatcgaaaaacctgccacatctggccatctctcagtctcacacgcgctgccatggacggatccatgtggtgcgctgccaactacgtgcctctgacgccgctcagcttcctggagcgcgccgcggtcgtgtacggcgaccgcgcggccgtcgtttgcggcgataggcggttctcgtggcgcgagacaagggagcggtgcctcgccggggcagccgctctcgctcgtctcggcgttggccgccgcgacgtggtcgcggtcatcgcctcgaacgtaccggcgatgtacgagctccatttcagcgtgccgatgaccggcgccgtcctgtgcacgctcaacacccgccacgacgcggccatggtgtccgtcctgctgaaacactcggaagccaaggtcttcctcgtggagtcgcagttccacgccgtggnccgcgacgcgctcaggctcctcgccgacgccaaagacaggcttcctctcgtcatcacggtttctgaccctagcagcagcagcaccggcggcggctgcggcagcaacgacggcagcgtcgcggtcgcggagtacgaagcgctcctgcggagcgcgcgcgcga

SEQ ID NO: 30013 - protein, 178 aa, Zea mays
  misc_feature: Ceres CLONE 1405370-F
  misc_feature (125)..(125): Xaa is any aa, unknown, or other
MDGSMWCAANYVPLTPLSFLERAAVVYGDRAAVVCGDRRFSWRETRERCLAGAAALARLGVGRRDVVAVIASNVPAMYELHFSVPMTGAVLCTLNTRHDAAMVSVLLKHSEAKVFLVESQFHAVXRDALRLLADAKDRLPLVITVSDPSSSSTGGGCGSNDGSVAVAEYEALLRSARA
